United States Patent 8,362,325 (NUCLEOTIDE SEQUENCES AND CORRESPONDING POLYPEPTIDES CONFERRING MODULATED PLANT CHARACTERISTICS) - sequence listing, part 6

SEQ ID NO: 9973 - DNA, 1815 bp, Sorghum bicolor
  misc_feature: Ceres ANNOT ID no. 6108762
  misc_feature: Encodes the peptide sequence at SEQ ID NO 9974
atggcggaagtggaggacaagctcaaggactacgagatcaagaaggagggagaggcagagatcctcttgcacaagaagaacgccgtcttctataatcccgtgcaggttcacaacagagatatgtccattgctgttttaaggacctttgttgccaagcgcaaggaagaacatgaagcgctggtggacaagaggaatacatcacatgaaaaaaacaaacagagtgaaacatcgagtcaaactggagaggatgcgtcaactggccagcaagatgaaatggatgttgtttgtgaaaaggagctaaataaagctgaagatcaaattgatgatctgccaaaagaagcaacaaaaccttcctggaaagtaaccagggagcttaagccaccacttgtcctcgaggctttggctgctactgggttgcgatctctccggtatgcccgtgaagttgagggcttaggaaaggtagttgctctggataatgataaagcatctgtcgaagattgcaagcgaaacataaagttcaatggcgcttccgctgctagtaaggtggaagcttacttggttgatgctcgaattcacatgctgatgcatccaaaagaatttgatgtggttgatcttgacccttatggatcaccatctatatttctcgactcagctgtacaggctgttgctgatggtggtttattaatgtgcactgccactgatatggcagttctttgtggtaccaatggagaagtttgttactcgaagtatggttcattcccaaccaagggcaagtattgccacgaaatggctttgaggatcctccttgccagtattgagagccacgcaaatcggtacaagcgatatattgtgcctgttctctctgtgttcatggatttttatatccgtgtttttgttcgagtattcacttctgcaagtgaaataaagaatacacctcttaaactttcttacatatatcagtgtgttggctgtgactctttccatcttcagtgtcttgcaaggactgttccgaagaagaataatggtgtgaagcatgcacctgctattggacctgttgttcctcaagaatgcagtgattgtggaaagaaatttaatataggtgggccaatatggtcagctcctattcatgaccaagactgggtagtttctactttgacaggtgttaagtcaatgaaggatagatatcctgcatatgataaaattacttcagttctaactactgtgtcagaggagttacatgacattccattgtttttcagtctccataacatagctggcactgttaagtgcacatctccatctttggttatgtttcgatctgcagttctaaatgcagggtatcagatctcaagcacccatgttaacccacttggcattaagtctgatgccccttgggatgttatttgggacatcatgcgctgctgggtgaagaatcatcctattaaggaacagccccgtgattcaccgggcacggcgatcctttcaaaatcgccaaagctagaagcaaatttttcaagagcagttgctgccctcagcaaggctcaggcgaagaagattaaacgattccttccaaacccagaacggcactggggtccaaaggtcagagcaggcaggaagatcacgagcaaacatatctctctgttgggccctgacgctatcaatggcgctctgaatggtggtgactgccacgaagaaggaaacggtgctggtctagataatacagccccagaacccgaggggatcaaagacgttgagaatgaaccctcaaacaaacgccaaaaaaccagcgacggcgaaccagcaagcgaaccttga

SEQ ID NO: 9974 - protein, 604 aa, Sorghum bicolor
  misc_feature: Ceres ANNOT ID no. 6108762
  misc_feature (3)..(473): Pfam Id: TRM Pfam Desc: N2,N2-dimethylguanosine tRNA methyltransferase
  misc_feature (4)..(597): NCBI GI: 30685545 NCBI Desc: n2,n2-dimethylguanosine trna methyltransferase family protein [arabidopsis thaliana]
  misc_feature (4)..(597): NCBI GI: 12230763 NCBI Desc: probable n(2),n(2)-dimethylguanosine trna methyltransferase (trna(guanine-26,n(2)-n(2)) methyltransferase) (trna 2,2-dimethylguanosine-26 methyltransferase)
  misc_feature (4)..(597): NCBI GI: 12230763 (continued) (trna(m(2,2)g26)dimethyltransferase)
  misc_feature (4)..(597): NCBI GI: 9755626 NCBI Desc: n2, n2-dimethylguanine trna methyltransferase-like protein [arabidopsis thaliana]
  misc_feature (4)..(596): NCBI GI: 79386788 NCBI Desc: rna binding / s-adenosylmethionine-dependent methyltransferase/ trna (guanine-n2-)-methyltransferase [arabidopsis thaliana]
  misc_feature (130)..(546): NCBI GI: 84029593 NCBI Desc: n(2),n(2)-dimethylguanosine trna methyltransferase (trna(guanine-26,n(2)-n(2)) methyltransferase) (trna 2,2-dimethylguanosine-26 methyltransferase)
  misc_feature (130)..(546): NCBI GI: 84029593 (continued) (trna(m(2,2)g26)dimethyltransferase)
MAEVEDKLKDYEIKKEGEAEILLHKKNAVFYNPVQVHNRDMSIAVLRTFVAKRKEEHEALVDKRNTSHEKNKQSETSSQTGEDASTGQQDEMDVVCEKELNKAEDQIDDLPKEATKPSWKVTRELKPPLVLEALAATGLRSLRYAREVEGLGKVVALDNDKASVEDCKRNIKFNGASAASKVEAYLVDARIHMLMHPKEFDVVDLDPYGSPSIFLDSAVQAVADGGLLMCTATDMAVLCGTNGEVCYSKYGSFPTKGKYCHEMALRILLASIESHANRYKRYIVPVLSVFMDFYIRVFVRVFTSASEIKNTPLKLSYIYQCVGCDSFHLQCLARTVPKKNNGVKHAPAIGPVVPQECSDCGKKFNIGGPIWSAPIHDQDWVVSTLTGVKSMKDRYPAYDKITSVLTTVSEELHDIPLFFSLHNIAGTVKCTSPSLVMFRSAVLNAGYQISSTHVNPLGIKSDAPWDVIWDIMRCWVKNHPIKEQPRDSPGTAILSKSPKLEANFSRAVAALSKAQAKKIKRFLPNPERHWGPKVRAGRKITSKHISLLGPDAINGALNGGDCHEEGNGAGLDNTAPEPEGIKDVENEPSNKRQKTSDGEPASEP

SEQ ID NO: 9975 - DNA, 1410 bp, Sorghum bicolor
  misc_feature: Ceres ANNOT ID no. 6108766
  misc_feature: Encodes the peptide sequence at SEQ ID NO 9976
atggacatggagccgatccttcttctctgcctgtctctccttgcccacggggcggaggcggcgtgcagagatgccaggttcgaggggacagttcttcctctgagggtgcagcagctggtggtggcgccgcctacacggtcaccggcggcgaacaggctccggttccgccacgacgtcagcctgacagtgccggtggccgtgggcgcgccgccgcagaacgtcacgatggtgctcgacaccggcagcgagctctcctggctgctctgcaacgggagccgcgtgccgtccacaccgccacagccacaggctcccgcggcgttcaacgggtcggcgtcgtccacgtacgccgccgcgcattgctcgtcgtcgcccgagtgccagtggcgcgggcgcgacctccccgtcccgccgttctgcgccgggccgccgtccaactcctgccgcgtgtccctctcctacgccgacgcctcgtctgccgacggcgtcctggctgccgacacgttcctcctcggcggggcgccgcccgtgcgcgcgctcttcggctgcatcacctcctactcgtcctcctccactgccgacggcaacggcaacggcaacgacgccagcgccaccaactcctcggaggcggcgacggggctcctcggcatgaaccggggcagcctgtccttcgtaacgcagactggcaccctccgcttcgcctactgcattgccccaggggacgggcccggcctcctcgtcctcggcggcgacggcgacggcgccgccctgtcggcggcaccgcagctaaactacacgccgctgatagagatgtctcaaccgctgccgtacttcgacagggtggcctactccgtgcagctggagggcatccgcgtgggcgccgcgctgctgcccatccccaagtccgtgctcgcgccggaccacacgggcgcgggccagaccatggtggactcgggcacgcagttcacgttcctcctcgccgacgcctacgcgccgctcaagggcgagttcctgaaccagacgagcgcgctcctggccccgctcggcgagcccgacttcgtgttccagggcgcgttcgacgcctgcttccgcgcgtcggaggcgcgggtggccgcggcgacggcgagccagctgctcccggaggtgggcctcgtcctccgcggcgcggaggtggcggtcggcggggagaagctcctgtacatggtgcccggcgagcgtcgcggtgagggcggctccgaggcggtgtggtgcctgacgttcgggaactcggacatggcgggcatgtcggcgtacgtgatcggacaccaccaccagcagaacgtctgggtggagtacgacctccagaatagccgcgttggctttgcgcccgcgcgctgcgacctcgccacccagcgcctcgccgcccgagcatag

SEQ ID NO: 9976 - protein, 469 aa, Sorghum bicolor
  misc_feature: Ceres ANNOT ID no. 6108766
  misc_feature (64)..(456): Pfam Id: Asp Pfam Desc: Eukaryotic aspartyl protease
  misc_feature (314)..(465): NCBI GI: 92875680 NCBI Desc: peptidase aspartic, catalytic [medicago truncatula]
  misc_feature (203)..(367): NCBI GI: 115473845 NCBI Desc: os07g0658600 [oryza sativa (japonica cultivar-group)]
  misc_feature (63)..(392): NCBI GI: 11994761 NCBI Desc: chloroplast nucleoid dna binding protein-like; nucellin-like protein [arabidopsis thaliana]
  misc_feature (65)..(309): NCBI GI: 38344829 NCBI Desc: osjnba0064h22.10 [oryza sativa (japonica cultivar-group)]
  misc_feature (65)..(309): NCBI GI: 116310063 NCBI Desc: h0818e04.1 [oryza sativa (indica cultivar-group)]
MDMEPILLLCLSLLAHGAEAACRDARFEGTVLPLRVQQLVVAPPTRSPAANRLRFRHDVSLTVPVAVGAPPQNVTMVLDTGSELSWLLCNGSRVPSTPPQPQAPAAFNGSASSTYAAAHCSSSPECQWRGRDLPVPPFCAGPPSNSCRVSLSYADASSADGVLAADTFLLGGAPPVRALFGCITSYSSSSTADGNGNGNDASATNSSEAATGLLGMNRGSLSFVTQTGTLRFAYCIAPGDGPGLLVLGGDGDGAALSAAPQLNYTPLIEMSQPLPYFDRVAYSVQLEGIRVGAALLPIPKSVLAPDHTGAGQTMVDSGTQFTFLLADAYAPLKGEFLNQTSALLAPLGEPDFVFQGAFDACFRASEARVAAATASQLLPEVGLVLRGAEVAVGGEKLLYMVPGERRGEGGSEAVWCLTFGNSDMAGMSAYVIGHHHQQNVWVEYDLQNSRVGFAPARCDLATQRLAARA

SEQ ID NO: 9977 - DNA, 828 bp, Sorghum bicolor
  misc_feature: Ceres ANNOT ID no. 6108768
  misc_feature: Encodes the peptide sequence at SEQ ID NO 9978
atggagtcgtcgccggtgtcctactggtgctacagctgcagccgcttcgtgagggtgtctccgtcgactgtcgtctgcccggagtgcgacggcggcttcctggagcagtttacgcagccgccgccgcggggcggcggcgggagcggccggcgcgggacgatgaacccggtcatcgtgctccgcggcggatcgctttccgggttcgagctctactacgacgacggcgcaggcgaagggctgcggccgctgcccggtgacgtccagcacctcctcatggggtccggtttccaccgcctgctcgaccagttctcgcggctggaggcggcggctccgcgtccgccggcgtcgaaggctgcggtggagtccatgccgtcggtgacggtcgccggaggtggtgctcactgtgccgtgtgccaggaggcctttgagcccggcgccgccggccgggagatgccgtgcaagcacgtctaccaccaggactgcatccttccctggctctcgctccgcaactcctgccccgtctgtcgccaagagcttccggccgcagccaccccagatgcggaggcggatgctgggctcaccatatggcgacttccacgcggtggatttgccgtaggcaggttcgccggtgggcctagagagcagctcccggtcgtctacacggagctggatggcggcttcagtaacggggttgggccgaggcgggtgacatggccagagggagaaggacaagtggatggtggtgaaggtcggattcgccgcctacttaggaatctatttggctgttttggtcagccagcgagttcgtcgcagtcccgtagtggctga

SEQ ID NO: 9978 - protein, 275 aa, Sorghum bicolor
  misc_feature: Ceres ANNOT ID no. 6108768
  misc_feature (135)..(175): Pfam Id: zf-C3HC4 Pfam Desc: Zinc finger, C3HC4 type (RING finger)
  misc_feature (66)..(274): NCBI GI: 115461675 NCBI Desc: os05g0110000 [oryza sativa (japonica cultivar-group)]
  misc_feature (62)..(275): NCBI GI: 92879545 NCBI Desc: zinc finger, ring-type; thioredoxin-related [medicago truncatula]
  misc_feature (63)..(275): NCBI GI: 87241270 NCBI Desc: zinc finger, ring-type; thioredoxin-related [medicago truncatula]
  misc_feature (46)..(246): NCBI GI: 17380612 NCBI Desc: at5g59550/f2o15_210 [arabidopsis thaliana]
  misc_feature (43)..(262): NCBI GI: 92875682 NCBI Desc: zinc finger, ring-type; thioredoxin-related; ringv [medicago truncatula]
  misc_feature: Useful for making plants with altered Lignin content
  misc_feature: Useful for making plants with altered alkaloid content
  misc_feature: Useful for making plants with altered lutein content
  misc_feature: Useful for making plants with modulated biomass
  misc_feature: Useful for making plants with modulated heat sensitivity
  misc_feature: Functional homolog of the protein sequence given in SEQ ID NO 13434
  misc_feature: Functional homolog of the protein sequence given in SEQ ID NO 13462
  misc_feature: The sequence is a functional homolog of SEQ ID NO. 271 in the 11/188,298 US application
  misc_feature: The sequence is a functional homolog of SEQ ID NO. 329 in the 11/188,298 US application
MESSPVSYWCYSCSRFVRVSPSTVVCPECDGGFLEQFTQPPPRGGGGSGRRGTMNPVIVLRGGSLSGFELYYDDGAGEGLRPLPGDVQHLLMGSGFHRLLDQFSRLEAAAPRPPASKAAVESMPSVTVAGGGAHCAVCQEAFEPGAAGREMPCKHVYHQDCILPWLSLRNSCPVCRQELPAAATPDAEADAGLTIWRLPRGGFAVGRFAGGPREQLPVVYTELDGGFSNGVGPRRVTWPEGEGQVDGGEGRIRRLLRNLFGCFGQPASSSQSRSG

SEQ ID NO: 9979 - DNA, 1155 bp, Sorghum bicolor
  misc_feature: Ceres ANNOT ID no. 6108771
  misc_feature: Encodes the peptide sequence at SEQ ID NO 9980
atggcgggggatcggctgagctgggcggggctgctgaaatggagcctctcctacgtcgacggggcggggccgtcccgcgccgtcagcgaggaggagcggcggtggctggcggaggcggtggagcggcacatgatgatggacgtggtgagccggatgagggagattgcgctgctcatgagcaccccgcccgccgtcctggaggcgcagggcatcacccacgacgacatcgaagatttgctgagtgagctgcaggtgcatgtggagtctatcgacatggcaaatgatttgcattctgttggtgggttggttccagttatcaagtacctcagaaattctaatgcccgtatccgagcgaaagcagctgatgtggtaacaacagtggttcagaacaatccgaccagccagcagttggtcatggaagctagtggttttgaacctctcttatccaatttcagatcagatcctgaccttactgctcggataaaagctcttggtgcactatcttctctgatacggaacaacaaaccaggagtttctgcatttcgtttagccaacggatatacaggactaagagatgcattgaattcagaaagtgcaaggtttcagaggaaagcgttgagtctgactcactatctgctcagcgaaagccattcagattgttcagtatttgcacagttaggtttcccccaccttatgatgcgtttggcatccagcgatgactctggtgttcgagaggcagcattagggggcttgcttgagctagcaagggacacaacacttggaaataggagtctactagcagaacatgacaggttacggcggcttctctgtggacgtatggaaagcataaggacgatgactcctgaagatttggatgctgcacgagaagagaggcagcttgttgactcactgtggatcacatgctaccatgaaccctccatgctccgcaatgaaggcctccttgttctgcctggggaggaatctttcgaacaacctcctgatgtggctggtagattctttgagccaatgcgccgagcttctgctaggaggacaccccctgttgatagatcagatccaggggatgaaactgggggaggtatggttttgcttttgggtccagcaccagatggtagatcaaattccccccgtcactga

SEQ ID NO: 9980 - protein, 384 aa, Sorghum bicolor
  misc_feature: Ceres ANNOT ID no. 6108771
  misc_feature (38)..(358): NCBI GI: 145332008 NCBI Desc: binding [arabidopsis thaliana]
  misc_feature (24)..(313): NCBI GI: 47939891 NCBI Desc: hsp70-interacting protein [rattus norvegicus]
  misc_feature (20)..(309): NCBI GI: 29436427 NCBI Desc: zgc:55259 protein [danio rerio]
  misc_feature (24)..(313): NCBI GI: 21245112 NCBI Desc: hsp70-interacting protein [rattus norvegicus]
  misc_feature (24)..(313): NCBI GI: 12803139 NCBI Desc: hspbp1 protein [homo sapiens]
MAGDRLSWAGLLKWSLSYVDGAGPSRAVSEEERRWLAEAVERHMMMDVVSRMREIALLMSTPPAVLEAQGITHDDIEDLLSELQVHVESIDMANDLHSVGGLVPVIKYLRNSNARIRAKAADVVTTVVQNNPTSQQLVMEASGFEPLLSNFRSDPDLTARIKALGALSSLIRNNKPGVSAFRLANGYTGLRDALNSESARFQRKALSLTHYLLSESHSDCSVFAQLGFPHLMMRLASSDDSGVREAALGGLLELARDTTLGNRSLLAEHDRLRRLLCGRMESIRTMTPEDLDAAREERQLVDSLWITCYHEPSMLRNEGLLVLPGEESFEQPPDVAGRFFEPMRRASARRTPPVDRSDPGDETGGGMVLLLGPAPDGRSNSPRH

SEQ ID NO: 9981 - DNA, 1587 bp, Sorghum bicolor
  misc_feature: Ceres ANNOT ID no. 6108774
  misc_feature: Encodes the peptide sequence at SEQ ID NO 9982
atggcgttcctcgcgcctccgcagttcaagtggctcccttccgcccgcgcggccgtgttcagggagccctccggcggcgcaggatcccgccccagtcggataaactgctctttctcctccacggcagtcgccgatgcagagctatccgtcgagccgccgccttctcctcaccgaacccttccgggatgtttcggtgaggcgcttctcaacaaggaggccatggtggcggctgcggccgcggaagccgtcgctctggctcgagcagcggccgaagtcgccggagaagtcgcccggatggcgcaaaaggaccacccggcggacttaccgcggcgtgatgacacgggggacagcttcttgtcaagagaggtcctccgcaccgaggtggggttgttggaggcgaggcgcgccgggctcgaattgctggagggcgaagagttcagcagcatcttcagcgacgaatccgaggatgatgatgatgatgacagcgggcatagcatagccgtggcggtgaagtcggcgcggcggaccgagagaaaggctcggagagtgagggcagcgatgaaggcggctaagtgtttcagcagcaggaatgctgttggagcgtcctccacgaggaagaagcggttgaagggttgccagactcctctcgggtgcttctataagatgaccggcccgaggcttctgacggcggaacaagaagtcgagttctcagaaggcattcaggacctcctgaaactggaagccatccaaaaggaggttgcacaatataatggcggtgagccaacattttcccagtgggcggcagcagctggaacagatgagaacactctgcggagacgcctgaatcatggggtttactgcaagaacaggatggtgaaatctaacgtgcgacttgtaatctcaattgcaaaagaacatgaaggccctggaatggagttttctgatcttattcaggaagggatgcaagggctgataagaggcgcagaaaagtttgatgcttcaaagggttttaggttctccacttactctcattggtggatcaaacaagcaatacgcaagtccgttttagaacaaacccagataattcgcctgccggcacatatggccgaagcaagttcccgagtgaaggaatgctgccggcgactccgtcgtgagttgaaacggctacccagcaacgaagagattgcggtggacactggcatgacgatccggcgggtggaggcagccatgagcctcccaaaatacagcgtgtccttcacgagcaaggtcgggtgcacggacgtcacataccaggagatcatgccggacacgagcgccgagacggccgaggaggtgctgcaccggtggctgatgaagaaggacgtgaacacggcgctggagagcctgagcccgcgcgagaagctggtgatgcggtaccggttcggcatcgagggcgggcggcccaggaccctgcacgacatcgggcagatcatgggggtgagccgggagcggatccggcagatcgagctgggcgcgttccggaagctgcggagcaagaagagggtgcagtcgctgcagcactacctgcagccggcggagagctggtag

SEQ ID NO: 9982 - protein, 528 aa, Sorghum bicolor
  misc_feature: Ceres ANNOT ID no. 6108774
  misc_feature (458)..(511): Pfam Id: Sigma70_r4 Pfam Desc: Sigma-70, region 4
  misc_feature (365)..(446): Pfam Id: Sigma70_r3 Pfam Desc: Sigma-70 region 3
  misc_feature (291)..(361): Pfam Id: Sigma70_r2 Pfam Desc: Sigma-70 region 2
  misc_feature (1)..(528): NCBI GI: 4336608 NCBI Desc: sigma factor sig2b; zmsig2b [zea mays]
  misc_feature (1)..(528): NCBI GI: 4336606 NCBI Desc: sigma factor sig2a; zmsig2a [zea mays]
  misc_feature (66)..(528): NCBI GI: 32351878 NCBI Desc: plastid sigma factor 2a [oryza sativa (japonica cultivar-group)]
  misc_feature (53)..(527): NCBI GI: 7363218 NCBI Desc: sigma factor 2 [sinapis alba]
  misc_feature (70)..(522): NCBI GI: 85813983 NCBI Desc: sigma factor [spinacia oleracea]
MAFLAPPQFKWLPSARAAVFREPSGGAGSRPSRINCSFSSTAVADAELSVEPPPSPHRTLPGCFGEALLNKEAMVAAAAAEAVALARAAAEVAGEVARMAQKDHPADLPRRDDTGDSFLSREVLRTEVGLLEARRAGLELLEGEEFSSIFSDESEDDDDDDSGHSIAVAVKSARRTERKARRVRAAMKAAKCFSSRNAVGASSTRKKRLKGCQTPLGCFYKMTGPRLLTAEQEVEFSEGIQDLLKLEAIQKEVAQYNGGEPTFSQWAAAAGTDENTLRRRLNHGVYCKNRMVKSNVRLVISIAKEHEGPGMEFSDLIQEGMQGLIRGAEKFDASKGFRFSTYSHWWIKQAIRKSVLEQTQIIRLPAHMAEASSRVKECCRRLRRELKRLPSNEEIAVDTGMTIRRVEAAMSLPKYSVSFTSKVGCTDVTYQEIMPDTSAETAEEVLHRWLMKKDVNTALESLSPREKLVMRYRFGIEGGRPRTLHDIGQIMGVSRERIRQIELGAFRKLRSKKRVQSLQHYLQPAESW

SEQ ID NO: 9983 - DNA, 822 bp, Sorghum bicolor
  misc_feature: Ceres ANNOT ID no. 6108786
  misc_feature: Encodes the peptide sequence at SEQ ID NO 9984
atggccgcggcggagacctcgggcacggcgatagggacctcggggagatgggcactgcacggcaagacagccctcgtcaccggcggcacccgcggcatcgggcgtgcggtagttgaggagctggctgcgctgggggcggccgtgcacacatgctcccgaaaggcggaggagctcggcgagcgcatcaaggagtgggaggccaggggattccgcgttacgggctccgtttgcgacctctccgagagggaccagcgggagcggctgctccgcgaggtcggcaaccgcttcggcggcaagctcaacatcctcgtaaacaatgtaggaacaaacataaggaaaccaactactgaatttactgcagaggaatactcgtttgtgatggctactaatcttgaatctgcatatcacttgtgccaaattgcacatcctcttttgaaattatctgggtcaggcagcattatattcatatcatctgtttgtggaatggtgggtgtctttagtggaactatatatgctatgactaaaggtgccattaaccagctaaccaagaacatagcatgtgaatgggcaaaggacaacataagagccaactctgttgctccgtggtacatcaccacttcacttacggaaagacttttggcaaataaggatttcgaggaacaagttgtgagtcgaactccacttggacgtgttggagaacctgaagaaatatcggcacttgttgcttttctttgcatgccaggttccacttatattaccggccagacgattgccgttgatggaggtatgactgtgaacgggttttacccaaccaagccctag

SEQ ID NO: 9984 - protein, 273 aa, Sorghum bicolor
  misc_feature: Ceres ANNOT ID no. 6108786
  misc_feature (22)..(190): Pfam Id: adh_short Pfam Desc: short chain dehydrogenase
  misc_feature (23)..(205): Pfam Id: KR Pfam Desc: KR domain
  misc_feature (13)..(273): NCBI GI: 21536785 NCBI Desc: short chain alcohol dehydrogenase-like [arabidopsis thaliana]
  misc_feature (3)..(268): NCBI GI: 38707448 NCBI Desc: short chain alcohol dehydrogenase-like protein [daucus carota]
  misc_feature (110)..(273): NCBI GI: 6457349 NCBI Desc: short chain alcohol dehydrogenase [arabidopsis thaliana]
  misc_feature (14)..(268): NCBI GI: 8778545 NCBI Desc: f22g5.20 [arabidopsis thaliana]
  misc_feature (15)..(268): NCBI GI: 18138053 NCBI Desc: tropinone reductase i [calystegia sepium]
  misc_feature (1)..(267): SWISSPROT Homolog: EC 1.1.1.206 Tropinone reductase 1
  misc_feature (14)..(268): SWISSPROT Homolog: EC 1.1.1.236 Tropinone reductase 2
  misc_feature: The sequence is a functional homolog of SEQ ID NO. 389 in the 11/188,298 US application
MAAAETSGTAIGTSGRWALHGKTALVTGGTRGIGRAVVEELAALGAAVHTCSRKAEELGERIKEWEARGFRVTGSVCDLSERDQRERLLREVGNRFGGKLNILVNNVGTNIRKPTTEFTAEEYSFVMATNLESAYHLCQIAHPLLKLSGSGSIIFISSVCGMVGVFSGTIYAMTKGAINQLTKNIACEWAKDNIRANSVAPWYITTSLTERLLANKDFEEQVVSRTPLGRVGEPEEISALVAFLCMPGSTYITGQTIAVDGGMTVNGFYPTKP

SEQ ID NO: 9985 - DNA, 1395 bp, Sorghum bicolor
  misc_feature: Ceres ANNOT ID no. 6108792
  misc_feature: Encodes the peptide sequence at SEQ ID NO 9986
atggcgcggaagcagcagcatattgcgatatttaccacagcgtgcttgccgtggatgactgggactgctgtaaacccactgtttcgagctgcataccttgccaaggctggaaactgggaggtcacgctggtggtgccttggctgtccaagggagatcaggagctcgtttatccaaacaagatgaagttcagttcgccagcagagcaggaaaactatgtgcggcagtggcttgaggagcggactgggccgttgccgaagtttgacataaagttctatcctgggaagttttcaactgagaaaagaagtattttacctgttggagacatcagtcagacaatatctgatgataaagcagatattgcagtgctagaagagccagaacatcttacttggtaccatcatggacggaggtggaaaagcaagttcccaaaagttataggtgttgttcacacaaactatttggaatacgtgaaaagagagaaaaatggatatatcagtgcgtttatcttaaaacacattaattcttgggttacagacatctactgtcataaggttataagattgtctgcagcaactcaggatgttcctaggtctgtgatttgtaatgttcatggagttaaccccaaatttattgaaattggcaaattgaaacatcaggagctatgccaaagagaacaagcattcttcaagggtgcatattatattggaaagatggtttggagtaaaggttacacagagcttcttcatcttcttcataagcaccaaatggaattgtctgttcttaaaatggagttgtatggcagtggggaagatgctgatgaagtaaaagcatcagctgagcgactgagcttagatattagagtctatccaggccgtgatcatggagattcaatatttcacgactacaaggttttcataaacccaagcacaactgatgtggtatgcacaacaactgcagaagctttggcgatggggaagattgtgatctgtgcaaaccatccttcaaatgattttttcaaaagatttcctaattgtcacatgtacagtactgagaaagagtttgtgacactaacaatgaaagctttgggagaagaacctatcccactgtcagatgatttgaggcatgagctttcctgggaggcagcaacagaaagattcgttagggttgccgatattgcaccaactatgcctgtggggcaacaaccaccagcttctccgcatttcatgcgcatctccccagacaacctacagaagaacatggaagaggcatcagcatttttccataacactatctctgggattgaaactgcccgttgtgtgttcggtgcaataccaaacacgttgcagccggatgaacagcaatgcaaggaacttgggtggaaattgcagggataa

SEQ ID NO: 9986 - protein, 464 aa, Sorghum bicolor
  misc_feature: Ceres ANNOT ID no. 6108792
  misc_feature (4)..(459): NCBI GI: 49617331 NCBI Desc: digalactosyldiacylglycerol synthase 2 [glycine max]
  misc_feature (4)..(459): NCBI GI: 49617335 NCBI Desc: digalactosyldiacylglycerol synthase 2 [lotus corniculatus var. japonicus]
  misc_feature (3)..(462): NCBI GI: 33589694 NCBI Desc: at4g00550 [arabidopsis thaliana]
  misc_feature (1)..(458): NCBI GI: 116310807 NCBI Desc: osigba0092m08.9 [oryza sativa (indica cultivar-group)]
  misc_feature (2)..(458): NCBI GI: 76800640 NCBI Desc: digalactosyldiacylglycerol synthase 1 [vigna unguiculata]
  misc_feature (4)..(459): SWISSPROT Homolog: EC 2.4.1.241 Digalactosyldiacylglycerol synthase 2, chloroplast
MARKQQHIAIFTTACLPWMTGTAVNPLFRAAYLAKAGNWEVTLVVPWLSKGDQELVYPNKMKFSSPAEQENYVRQWLEERTGPLPKFDIKFYPGKFSTEKRSILPVGDISQTISDDKADIAVLEEPEHLTWYHHGRRWKSKFPKVIGVVHTNYLEYVKREKNGYISAFILKHINSWVTDIYCHKVIRLSAATQDVPRSVICNVHGVNPKFIEIGKLKHQELCQREQAFFKGAYYIGKMVWSKGYTELLHLLHKHQMELSVLKMELYGSGEDADEVKASAERLSLDIRVYPGRDHGDSIFHDYKVFINPSTTDVVCTTTAEALAMGKIVICANHPSNDFFKRFPNCHMYSTEKEFVTLTMKALGEEPIPLSDDLRHELSWEAATERFVRVADIAPTMPVGQQPPASPHFMRISPDNLQKNMEEASAFFHNTISGIETARCVFGAIPNTLQPDEQQCKELGWKLQG

SEQ ID NO: 9987 - DNA, 969 bp, Sorghum bicolor
  misc_feature: Ceres ANNOT ID no. 6108796
  misc_feature: Encodes the peptide sequence at SEQ ID NO 9988
atggcggcggcgccagcggcgggagggcagggcggcgtgggcatggacaccgcgctcgtcgacgacatcatccgccgcctgctcgaggtgcggaccgcgcgccccgggaagcaggtgcagctctccgagtcggagatccgccagctctgcaacgtctcccgcgaaatcttcctcagccagcccaacctcctcgagctcgaggcgcccatcaagatctgcggtgacatccatggtcaatacagtgatcttctaaggctttttgaatatggaggctttcctcctgaagccaactatctattcttaggcgattatgttgatcgaggcaaacaaagtttggagactatatgccttcttcttgcttacaaaatcaagtaccctgagaacttttttcttctgaggggcaatcatgaatgtgcctcgataaacagaatatatggattttatgatgaatgcaagcgtcgatttaatgtgcggctatggaaggtcttcacagaatgttttaacactctacctgtggctgctcttatcgatgataaaatattatgtatgcacggcggactctcccctgatctagcacacttggatgagataaagagcttgcaacgtccaaccgatgtaccagatcaaggactactgtgtgatttgctttggtcagatccaggaaaagatgttcaagggtggggcatgaatgatagaggagtctcatatacctttggcgctgacaaggtttcagaattcttgcaaaagcatgatcttgatcttatttgtcgtgctcaccaggttgttgaagatgggtatgaattctttgctgacagacagcttgtcaccatattctcggcccccaattattgtggtgaatttgataatgctggtgcaatgatgagtgttgatgaaactttgatgtgttcgttccaaattctgaagcctgctgagagaaaaaacaaatttatggggtcaaacaaaatgtga

SEQ ID NO: 9988 - protein, 322 aa, Sorghum bicolor
  misc_feature: Ceres ANNOT ID no. 6108796
  misc_feature (68)..(263): Pfam Id: Metallophos Pfam Desc: Calcineurin-like phosphoesterase
  misc_feature (1)..(322): NCBI GI: 108935873 NCBI Desc: serine/threonine-protein phosphatase pp1
  misc_feature (10)..(322): NCBI GI: 951336 NCBI Desc: protein phosphatase 1 [oryza sativa]
  misc_feature (6)..(322): NCBI GI: 5917726 NCBI Desc: serine/threonine protein phosphatase 1; pp1 [malus x domestica]
  misc_feature (15)..(319): NCBI GI: 3176072 NCBI Desc: protein phosphatase 1, catalytic beta subunit [medicago sativa]
  misc_feature (15)..(319): NCBI GI: 114213458 NCBI Desc: catalytic subunit of protein phosphatase 1 [vicia faba]
  misc_feature (1)..(322): SWISSPROT Homolog: EC 3.1.3.16 Serine/threonine-protein phosphatase PP1
MAAAPAAGGQGGVGMDTALVDDIIRRLLEVRTARPGKQVQLSESEIRQLCNVSREIFLSQPNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTECFNTLPVAALIDDKILCMHGGLSPDLAHLDEIKSLQRPTDVPDQGLLCDLLWSDPGKDVQGWGMNDRGVSYTFGADKVSEFLQKHDLDLICRAHQVVEDGYEFFADRQLVTIFSAPNYCGEFDNAGAMMSVDETLMCSFQILKPAERKNKFMGSNKM

SEQ ID NO: 9989 - DNA, 1527 bp, Sorghum bicolor
  misc_feature: Ceres ANNOT ID no. 6108799
  misc_feature: Encodes the peptide sequence at SEQ ID NO 9990
atgctaacccaagcaatttcgtatggtgttgtgtccatgtgtttgttgctcttgtccagtgcagagaggagatccggtttcatgaagtggctctgcaatttcctgaaggggccgaagcccggcgaaccgaaccgccgccggccccaggtgacggccggagaagaggaggatgcgctttggcaccaacgaccagttagaccaaagaatgatccacctagaaatgacaacgaagaactggaccgtgcaattgcagagtctcttacagaggatgtcaaaccccccaaagagaaaaaccataagggagacaacaacgacgaagatcttgcaagagccatacaggacagtctcaacatgaacccttacacgccttataacccctatgctccctctcaggcccaacctagagggcacagggtatgtggaagctgcaagcatgagataggacatggccattacttgagttgcatgggaatttactggcaccctcagtgcttccgctgcagctcctgcggtcaccctatccgcgagaccgagttcaccttgctaggtacagatccataccacaagttgtgctacaaggagctgcatcatccaaaatgcgacgtctgccttcagtttatcccaacgaacaggagtggcttgatagagtatagagcccatccattctggggccagaagtattgccctttgcatgagcatgacaggacgccacgttgctgcagctgtgagaaaatggagccaaggaacacaaagtatatgtcactgggagacggccgcagcttgtgtatggaatgcctgggatctgcagttatggacaccggtgaatgccagcccctataccattctatcagagactactatgaggggatgaacatgaaactggaccagcagatacccatgctcttggttgaacgacaagcgcttaacgaagccatggaaggagagagtagaggcccacaccacatgcctgaaacaaggggtctatgtctgtcggaggagcagactgtgagcagtatacttaggaggcccagaattggtggaaaccgattactagacatgagaactcagccacaaaagctgactaggagatgtgaagttactgcaatacttgtcttgtatggcctccccaggctactaacaggctccatcctcgcccatgagctgatgcacgggtggttgcgcctcaaaggttaccgaaacctaaacgcggaggttgaagaaggcatatgccaggtcatgtcttacctgtggctggaatcagagattcttccgtcatcctcaaggcacgcgcagccttcatcctcttatgcctcgtcctcctcttcgtcttacccaccaacatcgtccaagaagggtggaatatctcatactgagaagaagctgggcgagttcttcatgcaccagattgccaatgacacgtcaacggcctatggtgacggtttcagaactgcgtatgctgccgtcaacaagtatggccttcgccaaacactgaaccatatacgcctaacaggaggcttccctgtataa

SEQ ID NO: 9990 - protein, 508 aa, Sorghum bicolor
  misc_feature: Ceres ANNOT ID no. 6108799
  misc_feature (140)..(196): Pfam Id: LIM Pfam Desc: LIM domain
  misc_feature (28)..(507): NCBI GI: 55771369 NCBI Desc: lim domain containing protein-like [oryza sativa (japonica cultivar-group)]
  misc_feature (72)..(507): NCBI GI: 140063803 NCBI Desc: lim, zinc-binding; ubiquitin interacting motif; peptidase m, neutral zinc metallopeptidases, zinc-binding site [medicago truncatula]
  misc_feature (28)..(507): NCBI GI: 115454203 NCBI Desc: os03g0626600 [oryza sativa (japonica cultivar-group)]
  misc_feature (62)..(508): NCBI GI: 15221983 NCBI Desc: ubiquitin interaction motif-containing protein / lim domain-containing protein [arabidopsis thaliana]
  misc_feature (137)..(503): NCBI GI: 8954064 NCBI Desc: contains a weak similarity to an actin-binding lim protein, isoform a, from homo sapiens gi4504999 and contains multiple lim proteins pf00412 and ppr repeats pf01535. est
  misc_feature (137)..(503): NCBI GI: 8954064 (continued) gbn96780 comes from this gene. [arabidopsis thaliana]
MLTQAISYGVVSMCLLLLSSAERRSGFMKWLCNFLKGPKPGEPNRRRPQVTAGEEEDALWHQRPVRPKNDPPRNDNEELDRAIAESLTEDVKPPKEKNHKGDNNDEDLARAIQDSLNMNPYTPYNPYAPSQAQPRGHRVCGSCKHEIGHGHYLSCMGIYWHPQCFRCSSCGHPIRETEFTLLGTDPYHKLCYKELHHPKCDVCLQFIPTNRSGLIEYRAHPFWGQKYCPLHEHDRTPRCCSCEKMEPRNTKYMSLGDGRSLCMECLGSAVMDTGECQPLYHSIRDYYEGMNMKLDQQIPMLLVERQALNEAMEGESRGPHHMPETRGLCLSEEQTVSSILRRPRIGGNRLLDMRTQPQKLTRRCEVTAILVLYGLPRLLTGSILAHELMHGWLRLKGYRNLNAEVEEGICQVMSYLWLESEILPSSSRHAQPSSSYASSSSSSYPPTSSKKGGISHTEKKLGEFFMHQIANDTSTAYGDGFRTAYAAVNKYGLRQTLNHIRLTGGFPV

SEQ ID NO: 9991 - DNA, 1230 bp, Sorghum bicolor
  misc_feature: Ceres ANNOT ID no. 6108803
  misc_feature: Encodes the peptide sequence at SEQ ID NO 9992
atggccgccgccgccgccaccacctcctcccacctgctccttctctcccgccagcaccgatgccgcctctccttcctcggccagtccagaaggcccgcaggcagggtcacgtccccgcaggcgccggccgctaataacgtgcggtgcatggcggccgtggacactgcgtccgccgcggcgacggagacgacgagcccgaagtcgagcagctacgagatcgtgacgctcacgacgtggctgctgcagcaggagcgcaccggcgcgatcgacaacgagatgaccatcgtgctggccagcatctccacggcgtgcaagcagatcgccgcgctggtgcagcgcgcgcccatctccaacctcacgggcgtccagggcgccgtcaacgtccagggcgaggaccagaagaagctcgacgtcgtctccaacgaggtgttctcgaactgcctcaggtcgagcgggcgcaccggcgtgatcgcttcggaggaggaggacgtgccagtagcggtggagcagagctactccggcaactacatcgtggtgttcgaccctctcgatggctcctctaacatcgacgccgccgtctccaccggctccatcttcggcatctacgcccccaacgacgagtgcctcgccaacgtcgaggacaatgagacccttgactcggtggagcagaggtgcattgtgagcgtgtgccagccggggagcaacctgctggccgccggctactgcatgtactcgagctcggtgatcttcgtgctcaccgtcggcacgggggtgtacgtgttcacgctggaccccatgtacggcgagttcgtgctgacgcaggagaagctgcagatccccaaggccggcaagatctacgccttcaacgagggcaactatgcgctctgggacgacaagctcaagaagtacatggacagcctcaaggagcccggcgactcagggaagccttactccgcgcgctacatcggcagcctcgtcggcgatttccaccgcactctgctctacggaggcatctacgggtaccccagggacaaaaagagcaagaacggcaagctgcggcttctctacgagtgcgcgcccatgagcttcatcgtcgagcaggccggtggcaagggctctgatggccaccagaggattcttgacatcacacctacagaggtccaccaaagagtgcctctgtacatcgggagcgtggaggaagtggagaaggtggagaaattcctggcttga

SEQ ID NO: 9992 - protein, 409 aa, Sorghum bicolor
  misc_feature: Ceres ANNOT ID no. 6108803
  misc_feature (74)..(410): Pfam Id: FBPase Pfam Desc: Fructose-1-6-bisphosphatase
  misc_feature (3)..(409): NCBI GI: 3041777 NCBI Desc: fructose-1,6-bisphosphatase [oryza sativa]
  misc_feature (1)..(409): NCBI GI: 4218951 NCBI Desc: fructose-1,6-bisphosphatase precursor [brassica napus]
  misc_feature (2)..(409): NCBI GI: 289367 NCBI Desc: fructose-1,6-bisphosphate [brassica napus]
  misc_feature (2)..(409): NCBI GI: 11242 NCBI Desc: fructose-bisphosphatase [arabidopsis thaliana]
  misc_feature (1)..(409): NCBI GI: 4585576 NCBI Desc: fructose-1,6-bisphosphatase precursor [solanum tuberosum]
  misc_feature (3)..(409): SWISSPROT Homolog: EC 3.1.3.11 Fructose-1,6-bisphosphatase, chloroplast precursor
  misc_feature: The sequence is a functional homolog of SEQ ID NO. 285 in the 11/188,298 US application
  misc_feature: The sequence is a functional homolog of SEQ ID NO. 474 in the 11/188,298 US application
MAAAAATTSSHLLLLSRQHRCRLSFLGQSRRPAGRVTSPQAPAANNVRCMAAVDTASAAATETTSPKSSSYEIVTLTTWLLQQERTGAIDNEMTIVLASISTACKQIAALVQRAPISNLTGVQGAVNVQGEDQKKLDVVSNEVFSNCLRSSGRTGVIASEEEDVPVAVEQSYSGNYIVVFDPLDGSSNIDAAVSTGSIFGIYAPNDECLANVEDNETLDSVEQRCIVSVCQPGSNLLAAGYCMYSSSVIFVLTVGTGVYVFTLDPMYGEFVLTQEKLQIPKAGKIYAFNEGNYALWDDKLKKYMDSLKEPGDSGKPYSARYIGSLVGDFHRTLLYGGIYGYPRDKKSKNGKLRLLYECAPMSFIVEQAGGKGSDGHQRILDITPTEVHQRVPLYIGSVEEVEKVEKFLA

SEQ ID NO: 9993 - DNA, 1143 bp, Sorghum bicolor
  misc_feature: Ceres ANNOT ID no. 6108809
  misc_feature: Encodes the peptide sequence at SEQ ID NO 9994
atggaggcgctgaagaagcaggccagcaagctccgggagcacgtcgccaagcagcagcaggcggttctcaagcagttcagtgcgcgatataatcaagatccttctcttgttgatgaagcggagcttgagtgccaccaaaatctccagaggctttacagtactacaagagcagctaagcatttccagcgaaatattgtacgaggggtggaaggtttcattgcgattagcaccaaacagatggagatagtgaaaaaactagccgaggattgttgtaaatatggaaacgacaatcaacattttggttttgctcttgcaagggcatctgaggagttcggtaaatctcataaacaaatagagaaagagcgggaggatcttcttaaaagtcttggagagcaggtttttgagcctctccgagaaatgataatgagtgctcctcttgaagatgctcgattgctaacttaccgctatcaacggatcagacaggacatggagtctcagatagctgatgtgatgagaaagcaacttaaatccaaggaaagtagtggtaacacagataactctgtgaaactgcaacatgcagaatcaaaattatcagatcttcgaactacactggcagcattaggaagagaagcaactgcagctatggaggctgtagaggctcagcaacagcaagttacatatgaacgtctccttgccatggttgatgctgagaggacatatcatcaaaatgcagctgatattctgaataaactccatgatgagatgctctatgcaaagcatcataatgagtcagcaaaccattatgatgaacagtcatcggagcctgaatcagatacaggcccagcacaagtgcactcacatagcacatctgaagatccagtattaactaaacctagcgagtccacagggaatagtcaggaggtgcaatttctgggggaggttattcatccattcgatgctcaggctgatggtgagctcagtctcgcggtgggtgaatatgttgtggtccgccaggtggcggcaaacggttggtctgaaggtgaatgcaagggaaaggctggctggttcccatctgcctatgtagagcagagggacaaagccccggcaagcaaggtgatagagcctggacttctgactacctga

SEQ ID NO: 9994 - protein, 380 aa, Sorghum bicolor
  misc_feature: Ceres ANNOT ID no. 6108809
  misc_feature (310)..(364): Pfam Id: SH3_1 Pfam Desc: SH3 domain
  misc_feature (311)..(363): Pfam Id: SH3_2 Pfam Desc: Variant SH3 domain
  misc_feature (1)..(374): NCBI GI: 92887266 NCBI Desc: sh3 [medicago truncatula]
  misc_feature (1)..(372): NCBI GI: 38344978 NCBI Desc: osjnba0011l07.8 [oryza sativa (japonica cultivar-group)]
  misc_feature (1)..(372): NCBI GI: 116310379 NCBI Desc: h0115b09.2 [oryza sativa (indica cultivar-group)]
  misc_feature (1)..(371): NCBI GI: 115459676 NCBI Desc: os04g0539800 [oryza sativa (japonica cultivar-group)]
  misc_feature (1)..(295): NCBI GI: 21928139 NCBI Desc: at4g18060/f15j5_30 [arabidopsis thaliana]
MEALKKQASKLREHVAKQQQAVLKQFSARYNQDPSLVDEAELECHQNLQRLYSTTRAAKHFQRNIVRGVEGFIAISTKQMEIVKKLAEDCCKYGNDNQHFGFALARASEEFGKSHKQIEKEREDLLKSLGEQVFEPLREMIMSAPLEDARLLTYRYQRIRQDMESQIADVMRKQLKSKESSGNTDNSVKLQHAESKLSDLRTTLAALGREATAAMEAVEAQQQQVTYERLLAMVDAERTYHQNAADILNKLHDEMLYAKHHNESANHYDEQSSEPESDTGPAQVHSHSTSEDPVLTKPSESTGNSQEVQFLGEVIHPFDAQADGELSLAVGEYVVVRQVAANGWSEGECKGKAGWFPSAYVEQRDKAPASKVIEPGLLTT

SEQ ID NO: 9995 - DNA, 594 bp, Sorghum bicolor
  misc_feature: Ceres ANNOT ID no. 6108816
  misc_feature: Encodes the peptide sequence at SEQ ID NO 9996
atgtttagcgggacgcagcagaagtgcaaggtgtgcaccaagacggtgtacccgatggaccagctctccaccgacggcgtcgccttccaccgctcctgcttcaagtgccagcactgcaagtccaccctctccctgagcaactattcctcgttcgaaggagtgccgtactgcaaggcccatttcgagcagctgttcaaggagaccgggagttacaacaagagcttccaatcacaatcacccgcaaagattactccggaaaagttggcccctgagctgaccagatcaccaagcaaagctgcaaggatgttttcaggaacacaagacaagtgtgcgacttgcggtaaaaccgcatatcctcttgagaaggtaacagttgaagaaaaggcataccataagtcatgcttcaaatgctcccacgggggctgtgcgattacaccttccaactatgcagccttggagggcatcctctactgcaaacaccatttctctcaacttttcaaggagaagggaagctacaaccacttgatcaagtgtgcttcggtcaagcgcgctgctgaagcacagccagaacaaccagcctccgattcctcctga

SEQ ID NO: 9996 - protein, 197 aa, Sorghum bicolor
  misc_feature: Ceres ANNOT ID no. 6108816
  misc_feature (9)..(65): Pfam Id: LIM Pfam Desc: LIM domain
  misc_feature (110)..(166): Pfam Id: LIM Pfam Desc: LIM domain
  misc_feature (2)..(190): NCBI GI: 117950171 NCBI Desc: lim domain protein wlim2a [populus tremula x populus alba]
  misc_feature (2)..(190): NCBI GI: 1841464 NCBI Desc: lim-domain sf3 protein [nicotiana tabacum]
  misc_feature (2)..(190): NCBI GI: 17227092 NCBI Desc: lim domain protein [gossypium hirsutum]
  misc_feature (2)..(169): NCBI GI: 1890352 NCBI Desc: transcription factor l2 [arabidopsis thaliana]
  misc_feature (2)..(187): NCBI GI: 8515104 NCBI Desc: lim domain protein plim-2 [nicotiana tabacum]
  misc_feature: The sequence is a functional homolog of SEQ ID NO 183 in the 11/479,226US patent application
  misc_feature: The sequence is a functional homolog of SEQ ID NO 2226 in the 10/374,780US patent application
  misc_feature: The sequence is a functional homolog of SEQ ID NO 42 in the 10/412,699US patent application
  misc_feature: The sequence is a functional homolog of SEQ ID NO 428 in the 10/412,699US patent application
  misc_feature: The sequence is a functional homolog of SEQ ID NO 616 in the 11/435,388US patent application
  misc_feature: The sequence is a functional homolog of SEQ ID NO 786 in the 10/225,066US patent application
  misc_feature: The sequence is a functional homolog of SEQ ID NO 826 in the 11/435,388US patent application
  misc_feature: The sequence is a functional homolog of SEQ ID NO 992 in the 11/479,226US patent application
  misc_feature: Useful for making plants with modulated growth and phenotype characteristics
  misc_feature: Useful for making plants with modulated heat sensitivity
  misc_feature: GREAT-hit functional homolog of the protein sequence encoded by LOCUS at2g39900
  misc_feature: The sequence is a functional homolog of SEQ ID NO 42 in the 20040045049 US patent application
  misc_feature: The sequence is a functional homolog of SEQ ID NO 428 in the 20040045049 US patent application
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Useful for making plants with altered carbohydrate content
  misc_feature: Functional homolog of the protein sequence given in SEQ ID NO 13763
MFSGTQQKCKVCTKTVYPMDQLSTDGVAFHRSCFKCQHCKSTLSLSNYSSFEGVPYCKAHFEQLFKETGSYNKSFQSQSPAKITPEKLAPELTRSPSKAARMFSGTQDKCATCGKTAYPLEKVTVEEKAYHKSCFKCSHGGCAITPSNYAALEGILYCKHHFSQLFKEKGSYNHLIKCASVKRAAEAQPEQPASDSS

SEQ ID NO: 9997 - DNA, 1053 bp, Sorghum bicolor
  misc_feature: Ceres ANNOT ID no. 6108823
  misc_feature: Encodes the peptide sequence at SEQ ID NO 9998
atggcggggtggtgcacgtggtgcatgtcttactcaagaggatccagtgaaaggtatggatctcgctcaccttactcgagaagcagctattcaaggtacagaagtcgctctaggagtgtggactcaagcgatgctgaaaaccctgggaacaacctgtacgtgactggtttgtcaactcgtgtaacggatcgagatctggagaagcacttttccactgagggagaggtgattgatgcaagcgttgtgcatgatccttggacaagggaatcacgagggtttggttttgttaccatggctactgttaaggaggcagatcgctgcatcaaatatctggaccgttctgtgttggaaggtcgggtcataactgttgagaaggcaaagagaagacgaggtagaaccccaacacctgggaagtatcttggcacaaaatcttcacgtggacggaggtactccccaagctactcacctgttagaagggaccgttacagttcccgctactcgcctgatcggagggaccgttacagttcccgctatcggagggaccgttacagttcccgctactcacctgaacgtgacctgtcttattctcctgatggtagaggccggtcatactctccatatgacagaaggcgatcatactctccccacggcaggcatggatcttattcccctgacgatcggcgtcgatcatactcaccttactacagaaaccgatatcgttcaaggtctccataccgctacagaagacggaggtcaccttctgtttcgccatactacagccggcaccggtatagatctgtctccaagtcacccagtgtttctccaacaaggaccagagagcggagctattcccacagtttatcgccacagagaagctactctcgcagccattccccagaatcggagagatcaacgagctactctcctaagaaagggagtagaagggaaccctcatgtagcagatattctggcaagaggcgtcgttcaagggaaagctactctcatagccgcagttcatactccaggtccgtgtctagggagcgctcagcttga

SEQ ID NO: 9998 - protein, 350 aa, Sorghum bicolor
  misc_feature: Ceres ANNOT ID no. 6108823
  misc_feature (52)..(123): Pfam Id: RRM_1 Pfam Desc: RNA recognition motif. (a.k.a. RRM, RBD, or RNP domain)
  misc_feature (38)..(345): NCBI GI: 8778550 NCBI Desc: f22g5.31 [arabidopsis thaliana]
  misc_feature (9)..(125): NCBI GI: 115452099 NCBI Desc: os03g0265600 [oryza sativa (japonica cultivar-group)]
  misc_feature (10)..(217): NCBI GI: 71143084 NCBI Desc: at4g35785 [arabidopsis thaliana]
  misc_feature (10)..(189): NCBI GI: 1781299 NCBI Desc: transformer-sr ribonucleoprotein [nicotiana tabacum]
  misc_feature (15)..(181): NCBI GI: 68036464 NCBI Desc: alternative splicing regulator [triticum aestivum]
  misc_feature: The sequence is a functional homolog of SEQ ID NO 1042 in the 10/374,780US patent application
  misc_feature: The sequence is a functional homolog of SEQ ID NO 852 in the 10/666,642US patent application
  misc_feature: Useful for making plants with modulated growth and phenotype characteristics
  misc_feature: The sequence is a functional homolog of SEQ ID NO 1042 in the 20060162006 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MAGWCTWCMSYSRGSSERYGSRSPYSRSSYSRYRSRSRSVDSSDAENPGNNLYVTGLSTRVTDRDLEKHFSTEGEVIDASVVHDPWTRESRGFGFVTMATVKEADRCIKYLDRSVLEGRVITVEKAKRRRGRTPTPGKYLGTKSSRGRRYSPSYSPVRRDRYSSRYSPDRRDRYSSRYRRDRYSSRYSPERDLSYSPDGRGRSYSPYDRRRSYSPHGRHGSYSPDDRRRSYSPYYRNRYRSRSPYRYRRRRSPSVSPYYSRHRYRSVSKSPSVSPTRTRERSYSHSLSPQRSYSRSHSPESERSTSYSPKKGSRREPSCSRYSGKRRRSRESYSHSRSSYSRSVSRERSA

SEQ ID NO: 9999 - DNA, 1776 bp, Sorghum bicolor
  misc_feature: Ceres ANNOT ID no. 6108824
  misc_feature: Encodes the peptide sequence at SEQ ID NO 10000
atgggcggcgaggccgagggcggggagcggcggctggggcgggtgctgagctttgggatcccggacacggcgctggggctagtgatggggtacgtggaggacccctgggaccgcgacgccatctcgctggtgtgccgccactggtgccgcgtcgacgcgctgagccgcaagcacgtcaccgtggccatggcctactccacgacacccgagcgcctgttccgccgcttcccgtgcctcgagtcactcaagctcaaagcaaagccccgcgcggccatgttcaacctcatctccgaggactggggcgggtctgcttcgccgtggatccaacagctctcggccaccttccacttcctcaagaagctccacctgcgcaggatgatagtatgcgacgacgatatcaacatcctcgtccgcgccaaggcgcacatgctcgtcgcgctgaagctcgaccgctgctccggcttctccacggcctccatcgcactcatcgcccgctcctgcaagaaactggaaacacttttcctggaagaaagcacgattgatgagagagacaatgatgaatggatccgtgagcttgctacgagcaattctgttcttgagacactgaatttctttctgacagatctcagggcatccccagagtatcttaccctccttgtgcgcaactgtcaaaggctgaaaaccctgaagattagtgaatgtttcatgcctgatctggttagtttgttccgaactgcacaaacactacaagagtttgctggtggttcctttgaagagcagggtcaacctgtggcaagtagaaattatgagaactactattttcctccttcgctgcaccgcttgagtttgctgtacatgggaacaaatgagatgcagatactgtttccatatgctgctgcacttaagaagttagaccttcagtttacattcctttccacagaggagcactgtcagatagttcagcgctgccccaatctggaaaccttagaggtgagggatgtcataggggatcgtggactacaagttgttgcgcagacctgcaagaaactgcagaggctcagagtagagagaggagatgatgatcaaggaggtcttgaggatgaacaaggtaggatttcacaggttgggttgatggctatagcccaaggctgccctgagttgacatactgggcaatacatgtatcggacattacaaatgcagctctagaggcggttggtacatgcagcaaaaatcttaatgatttccgccttgtccttcttgatagagaagcacatataactgaattgccactggacaatggggttcgtgctttgcttagaggttgcaccaaactccggaggtttgcattttatgtgagacctggggccctatctgatgttggtcttggctatgttggagaatttagcaagagcattcgttatatgttgcttggtaatgttggtgaatctgataatggaattatacaattatcaaaaggctgcccaagcttgcaaaaactggagctgaggggttgtttctttagtgagcatgctttagctatggctgcactagagctcaagtcactgaggtatctgtgggtgcaaggattcaggacatctccaactggaactgatcttatggcaatggtacgccccttctggaacattgagtatattgttcccgaccaagatgaaccttgcccagagcatcagaaacagattctggcatactactcccttgctggaaggaggacagattgtcctccatcggtaactctgctttacccggcattttga

SEQ ID NO: 10000 - protein, 591 aa, Sorghum bicolor
  misc_feature: Ceres ANNOT ID no. 6108824
  misc_feature (9)..(591): NCBI GI: 40218005 NCBI Desc: coronatine-insensitive 1 [lycopersicon esculentum]
  misc_feature (20)..(587): NCBI GI: 72154229 NCBI Desc: coronatine-insensitive 1 [glycine max]
  misc_feature (22)..(587): NCBI GI: 59797640 NCBI Desc: coronatine-insensitive protein 1 (f-box/lrr-repeat protein 2) (atfbl2) (coi-1) (atcoi1)
  misc_feature (17)..(589): NCBI GI: 116829914 NCBI Desc: coronatine-insensitive 1 [nicotiana attenuata]
  misc_feature (259)..(591): NCBI GI: 40557123 NCBI Desc: coronatine-insensitive 1 [nicotiana tabacum]
MGGEAEGGERRLGRVLSFGIPDTALGLVMGYVEDPWDRDAISLVCRHWCRVDALSRKHVTVAMAYSTTPERLFRRFPCLESLKLKAKPRAAMFNLISEDWGGSASPWIQQLSATFHFLKKLHLRRMIVCDDDINILVRAKAHMLVALKLDRCSGFSTASIALIARSCKKLETLFLEESTIDERDNDEWIRELATSNSVLETLNFFLTDLRASPEYLTLLVRNCQRLKTLKISECFMPDLVSLFRTAQTLQEFAGGSFEEQGQPVASRNYENYYFPPSLHRLSLLYMGTNEMQILFPYAAALKKLDLQFTFLSTEEHCQIVQRCPNLETLEVRDVIGDRGLQVVAQTCKKLQRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLELRGCFFSEHALAMAALELKSLRYLWVQGFRTSPTGTDLMAMVRPFWNIEYIVPDQDEPCPEHQKQILAYYSLAGRRTDCPPSVTLLYPAF

SEQ ID NO: 10001 - DNA, 1029 bp, Sorghum bicolor
  misc_feature: Ceres ANNOT ID no. 6108826
  misc_feature: Encodes the peptide sequence at SEQ ID NO 10002
atgtcagacgcgctgatcaacggcctcgccggcgccggcggcgggatcatcgcccagctccttacctacccgctgcagaccgtgaacgcgcggcagcagacggagcgcgacccctccaagccggcgttcaaggacggtgccgctcgccagttgtacctggttgtgaagaatgaggggtgggagcgcctgtacggcgggcttatgccctcgcttgtcggcaccgctgcctcccagggtgtctactactacttctaccaaatattcaggaacagagccgaggcaaaggcccttgagcgatcccggagaggactaggcgatgggtctgtcgggatgctgcagtctctcactgtcgctgcgttgtctggctgtgtcaatgtactgctcacaaacccgatttgggttgttgttacacgaatgcaaactcacagaaaggcaaacaaacagcaaagtcctcagggtttgacatgtgctcttgacaagccccttgaagcttctgcaactgaaaacactccatacaaaacaattgatgttgaactgcacaaagaagctggagttctcggcttctggaaaggggtaattccggctcttatcatggttagcaatcctgcaattcagttcatgctgtatgagactcttctgaagaaactgaagaagagacgggcctctaatttgaagggagctgatggactaactgctcttgaaatttttcttcttggtgccgttgcgaaacttggtgcaactgttgttacatacccccttctagttgttaaggcaagacttcaggcgaagcaaatgattaatgatgacaagaggcatcggtacaaaggtacatttgatgcgttcacaaagttggtacaatatgagggtctgacagggatgtataaaggaatgggcacaaaaattgtgcagagtgtttttgcttctgctttgctttttatgattaaggaggagctggtgaagggtgctcgactattggtgactggtaacactagtctggttaagaaactaccatcaaagccatcaagatga

SEQ ID NO: 10002 - protein, 342 aa, Sorghum bicolor
  misc_feature: Ceres ANNOT ID no. 6108826
  misc_feature (3)..(96): Pfam Id: Mito_carr Pfam Desc: Mitochondrial carrier protein
  misc_feature (110)..(220): Pfam Id: Mito_carr Pfam Desc: Mitochondrial carrier protein
  misc_feature (231)..(326): Pfam Id: Mito_carr Pfam Desc: Mitochondrial carrier protein
  misc_feature (159)..(342): NCBI GI: 115480061 NCBI Desc: os09g0508900 [oryza sativa (japonica cultivar-group)]
  misc_feature (159)..(342): NCBI GI: 115445117 NCBI Desc: os02g0225000 [oryza sativa (japonica cultivar-group)]
  misc_feature (63)..(320): NCBI GI: 145356747 NCBI Desc: mc family transporter: peroxisomal membrane protein [ostreococcus lucimarinus cce9901]
  misc_feature (167)..(335): NCBI GI: 126275418 NCBI Desc: peroxisomal membrane protein pmp47 [pichia stipitis cbs 6054]
  misc_feature (113)..(328): NCBI GI: 6648617 NCBI Desc: peroxisomal integral membrane protein [mus musculus]
  misc_feature: The sequence is a functional homolog of SEQ ID NO. 385 in the 11/188,298 US application
  misc_feature: The sequence is a functional homolog of SEQ ID NO. 517 in the 11/188,298 US application
  misc_feature: The sequence is a functional homolog of SEQ ID NO. 398 in the 11/188,298 US application
MSDALINGLAGAGGGIIAQLLTYPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLLTNPIWVVVTRMQTHRKANKQQSPQGLTCALDKPLEASATENTPYKTIDVELHKEAGVLGFWKGVIPALIMVSNPAIQFMLYETLLKKLKKRRASNLKGADGLTALEIFLLGAVAKLGATVVTYPLLVVKARLQAKQMINDDKRHRYKGTFDAFTKLVQYEGLTGMYKGMGTKIVQSVFASALLFMIKEELVKGARLLVTGNTSLVKKLPSKPSR

SEQ ID NO: 10003 - DNA, 1815 bp, Sorghum bicolor
  misc_feature: Ceres ANNOT ID no. 6108832
  misc_feature: Encodes the peptide sequence at SEQ ID NO 10004
  misc_feature: Up-regulated in shoot tissues in response to methyl jasmonate treatment
  misc_feature: Down-regulated in root tissues in response to salicylic acid treatment
atggaatccctagccgccacctccgtgttctcgccctcccgcgccgccgtcccggcggggggggcccgggttagggcggggacggtggtatcaaccaggcggaggagcagcagcaggagcggagccatcggggtgaagtgctctaccgtggcgccgcaggcgagctcagcggttagcaggagcgcggtggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggcctcagggcaccaccaacgtcggccgctacagcatggtaggagcccacccggtgatggagatagtggccaaagagcacaaggttacgatcatggaccacgagaagggccatgtgacggagcaggtagtggacgacccgatgcaggtccccaggaacatgatggagggatggcacccacagcagatcgacgagctccctgaatccttctccggtggatgggttgggttcttttcctatgatacggttcggtatgttgagaagaagaagctaccgttctctggtgctcctcaggacgataggaaccttcctgatgtgcacttggggctctatgatgatgttctagtcttcgacaatgttgagaagaaagtatatgttatccattgggtcaatgtggaccggcatgcatctgttgaggaagcataccaagatggcaggtcccggctgaacctgttgctatctaaagtgcacaattccaatgtccccacactctctcctggatttgtgaagctgcacactcgccagtttggtgcacctttgaacaagtcaaccatgacaagtgatgagtataagcatgttgttatgcaggctaaggaacatattatggctggggatatcttccagattgttttaagccagaggttcgagagacgaacatatgccaacccatttgaggtttatcgagccttgcgaattgtgaaccctagcccatacatggcgtatgtacaggcaagaggatgtgtgttggttgcatctagtcctgaaattcttacacgagtcagtaaggggaagattattaatcgaccacttgctggaactgctcgaaggggcaaaacagagaaggaagatcaaatgcaagagcaacaactattaagtgatgaaaaacagtgtgccgagcacataatgcttgtagacttaggaaggaatgatgttggcaaggtctccaaacctggatcagtaaaggtggagaagttgatgaacattgagcgatactcccatgttatgcacatcagctcaacggtcagtggacagttggatgatcatctccagagctgggatgccctgagagctgcgttgcctgttggaacagtcagtggtgctccaaaggtaaaagccatggagttgatagataagttggaagttacaaggcgaggaccatatagtggtggtctaggaggaatatcgtttgatggcgatatgcaaattgcactttctctgcgcaccatggtattctcaacagcgccaagccacaacacgatgtactcctacaaagatgcagataggcgccgggagtgggttgctcatctccaggctggtgcaggcattgttgccgacagttgcccagatgatgaacaacgtgaatgcgagaataaggctgcagcactagctcgggccatcgatcttgcagagtcagcttttgtagacaaagaatag

SEQ ID NO: 10004 - protein, 604 aa, Sorghum bicolor
  misc_feature: Ceres ANNOT ID no. 6108832
  misc_feature (313)..(593): Pfam Id: Chorismate_bind Pfam Desc: chorismate binding enzyme
  misc_feature (91)..(253): Pfam Id: Anth_synt_I_N Pfam Desc: Anthranilate synthase component I, N terminal region
  misc_feature (1)..(604): NCBI GI: 71841560 NCBI Desc: anthranilate synthase alpha subunit [zea mays]
  misc_feature (1)..(604): NCBI GI: 113929150 NCBI Desc: anthranilate synthase alpha 2 subunit [avena sativa]
  misc_feature (1)..(604): NCBI GI: 113929152 NCBI Desc: anthranilate synthase alpha 2 subunit [avena sativa]
  misc_feature (1)..(604): NCBI GI: 113929154 NCBI Desc: anthranilate synthase alpha 2 subunit [avena sativa]
  misc_feature (45)..(603): NCBI GI: 960289 NCBI Desc: anthranilate synthase alpha subunit
  misc_feature (76)..(602): SWISSPROT Homolog: EC 4.1.3.27 Anthranilate synthase component I-2, chloroplast precursor
  misc_feature: Up-regulated in shoot tissues in response to methyl jasmonate treatment
  misc_feature: Down-regulated in root tissues in response to salicylic acid treatment
MESLAATSVFSPSRAAVPAGGARVRAGTVVSTRRRSSSRSGAIGVKCSTVAPQASSAVSRSAVAAKAAEEDKRRFFEAAARGSGKGNLVPMWECIVSDHLTPVLAYRCLVPEDNVDAPSFLFESVEQGPQGTTNVGRYSMVGAHPVMEIVAKEHKVTIMDHEKGHVTEQVVDDPMQVPRNMMEGWHPQQIDELPESFSGGWVGFFSYDTVRYVEKKKLPFSGAPQDDRNLPDVHLGLYDDVLVFDNVEKKVYVIHWVNVDRHASVEEAYQDGRSRLNLLLSKVHNSNVPTLSPGFVKLHTRQFGAPLNKSTMTSDEYKHVVMQAKEHIMAGDIFQIVLSQRFERRTYANPFEVYRALRIVNPSPYMAYVQARGCVLVASSPEILTRVSKGKIINRPLAGTARRGKTEKEDQMQEQQLLSDEKQCAEHIMLVDLGRNDVGKVSKPGSVKVEKLMNIERYSHVMHISSTVSGQLDDHLQSWDALRAALPVGTVSGAPKVKAMELIDKLEVTRRGPYSGGLGGISFDGDMQIALSLRTMVFSTAPSHNTMYSYKDADRRREWVAHLQAGAGIVADSCPDDEQRECENKAAALARAIDLAESAFVDKE

SEQ ID NO: 10005 - DNA, 861 bp, Sorghum bicolor
  misc_feature: Ceres ANNOT ID no. 6108837
  misc_feature: Encodes the peptide sequence at SEQ ID NO 10006
atggcggcggtccgcggcggagaggcggtctccgtcgcgctcctcttctccctcgccttcttctgcgcccgcctcctgctcgaccgcctcgtctacaagccattggcagtctaccttttcaacaccaaagcttctaagttgatgaatgatgaggccaggcaagcaaagattgtcaagttctcagagtccagttggaaacttacctactatgcttctgttcaagcatgggtcctcatgataataaagcaggaaccatggtcattggatatgatgcaatactttgatggctggccgaatcaacccatcgcgtcctcattgatgcttttctacatgtgccagtgtggattttatatctacagcatcggtgctcttgttgcttgggaaacccgcagaaaagattttgctgtaatgatgtctcatcatgtaataacatctactctaattggagtttcatatctgaccggatttttccgaattgggaccatcattctcgctcttcatgatgcaagtgatgtgtttcttgagactgccaaattatgcaagtacacagaaaaagagctgggggctagcttgttttttggtctcttcgctatctcctggcttctattgcgtctaatttacttcccattttggataatcaaagcctcgagctatcattccatcgcgttcttgaggaagctggatgaattcccaacagctttgtactacatcttgaacacaatgcttctcacattgcttgtattccatatgtactggtggaaactcatatgtttgatgataatgagacaattgaataataaaggacaagttacagatgatgttcgatctggtaagagatttttctttgggggaattacttaa

SEQ ID NO: 10006 - protein, 286 aa, Sorghum bicolor
  misc_feature: Ceres ANNOT ID no. 6108837
  misc_feature (78)..(278): Pfam Id: LAG1 Pfam Desc: Longevity-assurance protein (LAG1)
  misc_feature (3)..(276): NCBI GI: 62899872 NCBI Desc: asc1-like protein 3 (alternaria stem canker resistance-like protein 3)
  misc_feature (12)..(276): NCBI GI: 7658241 NCBI Desc: lag1 homolog 2 [arabidopsis thaliana]
  misc_feature (15)..(278): NCBI GI: 62899859 NCBI Desc: asc1-like protein 2 (alternaria stem canker resistance-like protein 2)
  misc_feature (15)..(276): NCBI GI: 62899852 NCBI Desc: asc1-like protein 1 (alternaria stem canker resistance-like protein 1)
  misc_feature (14)..(275): NCBI GI: 7688742 NCBI Desc: asc1 [lycopersicon esculentum]
MAAVRGGEAVSVALLFSLAFFCARLLLDRLVYKPLAVYLFNTKASKLMNDEARQAKIVKFSESSWKLTYYASVQAWVLMIIKQEPWSLDMMQYFDGWPNQPIASSLMLFYMCQCGFYIYSIGALVAWETRRKDFAVMMSHHVITSTLIGVSYLTGFFRIGTIILALHDASDVFLETAKLCKYTEKELGASLFFGLFAISWLLLRLIYFPFWIIKASSYHSIAFLRKLDEFPTALYYILNTMLLTLLVFHMYWWKLICLMIMRQLNNKGQVTDDVRSGKRFFFGGIT

SEQ ID NO: 10007 - DNA, 2532 bp, Sorghum bicolor
  misc_feature: Ceres ANNOT ID no. 6108839
  misc_feature: Encodes the peptide sequence at SEQ ID NO 10008
atggcgctgtccgcgtcggcggcgtcagccgggcgggggtcgcgggcggagaaggtgaggaggatcttcgagcgcttcgacaccaacggggacggcgggctggaccgcaacgagatggccgcgctcgtcgtcgccgtcaacccgcgggtcaagttcagcgaggaccagatctctgccatcctcgacgaggtgttccgcacctacgccgagttcatcctccccgacggcaggggcctctccctgccggggctgctccgcacctacgacgacggcgccggggacgtcgaccgcgacttcctcgcgctctccctgcccgtcgtcgactctgacgcctcatccccggagatcgccgcgggggacgccgccgccctctcctccccgccctccggagctgccgccgcagcgtcgctgctcgacgaccacgccaagccgctcggcgccggcggcgctctgccgtcggtcagctcccgcgccgcggccgccgcgccggcgtgggcgacctcccctaaccacggcatcgccttcgactcctcatgggggctcctcgacgacctggagatactcgtcaagcgcctccgctcaaagcagctgcggaagggctccgtcgacggaagcggcggcgccggcaacaacaacttcgactccttctccgaggccgggtggtccagggagatctcaggcgctgcggattcggcatccaccgccgctccgtgggacgagacgagccgcgactacctcaccttcgtcaaggaactcgccgtgctccgcacgcgcgccgacgcctcccgctcgcgcgaggaggccttcgacaaccacatggtcatcggccgggcgctttctgagcaccgcctcttccgagacgccctagccagcttccgccgcgcctgtgagctgcagcccactgacgtccgtccccacttccgcgcggggaactgcctgtacgccctcggtcgctatgcagaggccaaggaggagtacctccttgcccttgaggctgcggaggctggcggctcacagtccgcggacatcctcccgcagatccatgtcaaccttggtattgccatggaggccgaagggatggtgcttggtgcctgtgagcattaccgagaagcagccatattgtgtccatctcatgccagggcactcaagctcctggggagcgctctctttggcgttggggagtaccgagctgctgagaaggcactggaggaggccatcttcttgaaggaagactatgctgatgcgcactgtgaccttgggtcggccctgcatgcggtaggggaggatgaccgtgcaatccaggagtttcagacagcaattgatctcaaacctggccatgttgatgccttgtacaatcttggtggattgaacatggatgcaggccgcttcgtacgggctgcggagatgtatactcgtgtgctgagcatccgaccaaaccattggcgcgcacagctaaacaaggctgtggctttgcttggacagggtgaatctgaggaggccaagaaggcactcaaggaggcgtttaagatgacacagagggtggaagtgtatgatgctatctcacatttgaagacattgcaaaagaagaagccaaagccttccaaaggaaaagatgatggtcaaggggagcaggcttatgttgttgtggaggcatccaagttcaagagggttggcaggaagactaccttgcggcaggatttggccaatgctctagatataagggccttcgagaggatgacgaaactaggccactgtgatgttgagcttcttagaaaagagatgaatgagactgatgtccctgtatcttactcaggcactggcatccctgagaagtcaatacgcaaagcagctcttgaggttattctccgcaggctcctgtcttttctcaagccagatacctttcagggtgctatcaaggcaatcaatgaaagaattctctctgtccttgatgctcctggctctggtcgtgttgatttgggaatgttcttcgccatcattgctccagtctgttctggccctgtggataggcgcaagcgtatcgtctttgatgcacttctttggcgtcctgctagcgaaggtagcaatggtcagataaggaggagtgatgcgttaacctacattaagcttcttcgggctgtttatatacccacacatggggctagtgacatgcttgaaatgcatggggagtctgaccctactatggtatcatacacggaattcttagagatgttcaatgacccagattggggatttgggatcctgagcactctggtgaagcttgaagagagtgatcacatacggcatggtcgctacacatgctccatctgccggtaccctatcattgggtcacggtttaaggaaacaaaacactcattcagcctgtgcaaccgatgctacagtgaagggaaggttccgtcagcctacaagttggaggagtacaggttcaaagaatacggtaacgagtctgaggccctcatcgataagtgcatgtgcttcaatttacattctaagaagctggaaagtgatgcttga

SEQ ID NO: 10008 - protein, 843 aa, Sorghum bicolor
  misc_feature: Ceres ANNOT ID no. 6108839
  misc_feature (413)..(446): Pfam Id: TPR_2 Pfam Desc: Tetratricopeptide repeat
  misc_feature (447)..(480): Pfam Id: TPR_2 Pfam Desc: Tetratricopeptide repeat
  misc_feature (379)..(412): Pfam Id: TPR_1 Pfam Desc: Tetratricopeptide repeat
  misc_feature (413)..(446): Pfam Id: TPR_1 Pfam Desc: Tetratricopeptide repeat
  misc_feature (447)..(480): Pfam Id: TPR_1 Pfam Desc: Tetratricopeptide repeat
  misc_feature (18)..(46): Pfam Id: efhand Pfam Desc: EF hand
  misc_feature (767)..(810): Pfam Id: ZZ Pfam Desc: Zinc finger, ZZ type
  misc_feature (107)..(837): NCBI GI: 144924257 NCBI Desc: zinc finger, zz-type; calcium-binding ef-hand [medicago truncatula]
  misc_feature (108)..(838): NCBI GI: 2388582 NCBI Desc: contains similarity to rattus o-glcnac transferase (gbu76557). [arabidopsis thaliana]
  misc_feature (702)..(829): NCBI GI: 16225446 NCBI Desc: o-glcnac-transferase-like protein [castanea sativa]
  misc_feature (266)..(510): NCBI GI: 72383519 NCBI Desc: tpr repeat [prochlorococcus marinus str. natl2a]
  misc_feature (244)..(522): NCBI GI: 23123830 NCBI Desc: cog0457: fog: tpr repeat [nostoc punctiforme pcc 73102]
  misc_feature: The plant flowers significantly late compared to wild-type.
  misc_feature: Useful for making plants with altered alkaloid content
  misc_feature: Useful for making plants with modulated flowering time
  misc_feature: GREAT-hit functional homolog of the protein sequence given in SEQ ID NO 13322
  misc_feature: GREAT-hit functional homolog of the protein sequence given in SEQ ID NO 13556
  misc_feature: Useful for making plants with altered alkaloid content
  misc_feature: Functional homolog of the protein sequence given in SEQ ID NO 13322
  misc_feature: Useful for making plants with modulated flowering time
  misc_feature: Functional homolog of the protein sequence given in SEQ ID NO 13556
MALSASAASAGRGSRAEKVRRIFERFDTNGDGGLDRNEMAALVVAVNPRVKFSEDQISAILDEVFRTYAEFILPDGRGLSLPGLLRTYDDGAGDVDRDFLALSLPVVDSDASSPEIAAGDAAALSSPPSGAAAAASLLDDHAKPLGAGGALPSVSSRAAAAAPAWATSPNHGIAFDSSWGLLDDLEILVKRLRSKQLRKGSVDGSGGAGNNNFDSFSEAGWSREISGAADSASTAAPWDETSRDYLTFVKELAVLRTRADASRSREEAFDNHMVIGRALSEHRLFRDALASFRRACELQPTDVRPHFRAGNCLYALGRYAEAKEEYLLALEAAEAGGSQSADILPQIHVNLGIAMEAEGMVLGACEHYREAAILCPSHARALKLLGSALFGVGEYRAAEKALEEAIFLKEDYADAHCDLGSALHAVGEDDRAIQEFQTAIDLKPGHVDALYNLGGLNMDAGRFVRAAEMYTRVLSIRPNHWRAQLNKAVALLGQGESEEAKKALKEAFKMTQRVEVYDAISHLKTLQKKKPKPSKGKDDGQGEQAYVVVEASKFKRVGRKTTLRQDLANALDIRAFERMTKLGHCDVELLRKEMNETDVPVSYSGTGIPEKSIRKAALEVILRRLLSFLKPDTFQGAIKAINERILSVLDAPGSGRVDLGMFFAIIAPVCSGPVDRRKRIVFDALLWRPASEGSNGQIRRSDALTYIKLLRAVYIPTHGASDMLEMHGESDPTMVSYTEFLEMFNDPDWGFGILSTLVKLEESDHIRHGRYTCSICRYPIIGSRFKETKHSFSLCNRCYSEGKVPSAYKLEEYRFKEYGNESEALIDKCMCFNLHSKKLESDA

SEQ ID NO: 10009 - DNA, 345 bp, Sorghum bicolor
  misc_feature: Ceres ANNOT ID no. 6108841
  misc_feature: Encodes the peptide sequence at SEQ ID NO 10010
atggcttacgtcgagagaggtgttgtgaaagacaagcggactatatggcgactgagcataatctcagacttctttcgggctattgtgaacttcatcagaatcttctttgacacactgttctcagtggacaaaactgacagctacaagaaaggatatggtgctggtaagaagtgggatggtggacccgggggtggtggtgggcggggcccatatggcggtggaggtggtggtggaggtggaggatttggcggcggaggaggtggttcacgcggtcctcgcactctatctgacatccaatccaatgaccacagttctctacctgcttgtggatcctgctgcggctaa

SEQ ID NO: 10010 - protein, 114 aa, Sorghum bicolor
  misc_feature: Ceres ANNOT ID no. 6108841
  misc_feature (1)..(114): NCBI GI: 24641445 NCBI Desc: cg1840-pa [drosophila melanogaster]
  misc_feature (1)..(112): NCBI GI: 49036484 NCBI Desc: glycine-rich selenoprotein (g-rich selenoprotein) (dselg)
  misc_feature (1)..(110): NCBI GI: 16767882 NCBI Desc: gh03581p [drosophila melanogaster]
  misc_feature (1)..(110): NCBI GI: 28571165 NCBI Desc: cg1844-pa [drosophila melanogaster]
  misc_feature (43)..(114): NCBI GI: 15222291 NCBI Desc: glycine-rich protein [arabidopsis thaliana]
MAYVERGVVKDKRTIWRLSIISDFFRAIVNFIRIFFDTLFSVDKTDSYKKGYGAGKKWDGGPGGGGGRGPYGGGGGGGGGGFGGGGGGSRGPRTLSDIQSNDHSSLPACGSCCG

SEQ ID NO: 10011 - DNA, 1671 bp, Sorghum bicolor
  misc_feature: Ceres ANNOT ID no. 6108845
  misc_feature: Encodes the peptide sequence at SEQ ID NO 10012
atggaagtgactatggacgacgtggccggggatgtcgagttctctggctgcagctccacgaccacctcgtcgtcgtcgccgtcgctggacgacggcatggggatgtacgcgtggaacgctctgtccccggtggccgactggggctcgctctgccctgacgacggcgcccaggacctgcacggcctcatcgaatccatgctctgcgacgacacgctcctcggctcggccgacctcaacccggccatgttcccggacgatgtgtactactgctccaatggctccgccccgagcagcaccaccacgacgaaccccggcacgcccgtgaacggcggcgacgcccagaagggcgactgccacgagaagggcctccgcctgctgcacctgctcatggcggcggccgaggcgctctccggccagcaaaagagccgggagctggcccgggtgatattggttcggctcaagcagatggtttcccacatcggcgacaacgccgccgtctccaacatggagcgcctcgccacgcacttcaccgacgcgctgcaggggctgctcgacggctcccaccccatcgggggagtcggcaggcaggccgccgcggccgcgtcccacggccacctcccgcacaccggcgacgtgctgacggcattccagatgctgcaggacatgtcgccgtacatgaagttcggccacttcaccgcgaaccaggccatcctcgaggcggtggcgggcgaccggcgcgtgcacgtcgtcgactacgacatcgccgagggcgtccagtgggcgtcgctgatgcaggccatgacctcgcgccccgacggcgtgccgccgccgcacctgcgcataaccgccgtctcccgaggaggcggtggcggcgcccgggcggtgcaggaggccgggcgtcgcctggccgccttcgcggcgtccatcgggcagcccttctcgtttgggcagtgccgtctcgactcggacgagcggttccgtccggcgacggtccggatggtcaagggggagaccctcgtcgccaattgcgtgctcaaccaagccgccgcgaccaccaccgtcaggcgccccaccggctcggtggcgtctttcttggccggcatggccacgctcggggccaaggtcgtgacggtggttgaggaggatcaaggggacgcggagaaggacgacgaggaggtgggcggcttcgtggcgcggttcatggaggagctgcaccggtactcggcggtgtgggactcgctggaggccgggttcccgacgcagagccgtgttcggggcctagtggagcgggccatccttgccccaaacatcgccggcgccgtgagccgagcgtaccgtgcctcggacggcgatggcgaggcgagggccgggtggggggagtggatgcgcggcaacgggttcagggccgtgccgctgagctgcttcaaccacagccaggccaggctgctgctcggcctgttcaacgacgggtacacgatggaggagacgtcgccgaacaagatcgtgctcggctggaaggcacggaggttgctgtcggcgtcagtgtgggcgccaccgcccgtgtccgtgccgtcgtcaccgacggagggggcgttccacggtggcgtgggccgcatggactttgactacatcgattcgttcctcgtcgagcccgcttatgcgctagtttaa

SEQ ID NO: 10012 - protein, 556 aa, Sorghum bicolor
  misc_feature: Ceres ANNOT ID no. 6108845
  misc_feature (99)..(426): Pfam Id: GRAS Pfam Desc: GRAS family transcription factor
  misc_feature (1)..(516): NCBI GI: 84570613 NCBI Desc: transcription initiator for nodulation [lotus corniculatus var. japonicus]
  misc_feature (5)..(516): NCBI GI: 56691732 NCBI Desc: gras family protein [medicago truncatula]
  misc_feature (100)..(516): NCBI GI: 56691734 NCBI Desc: gras family protein [pisum sativum]
  misc_feature (1)..(258): NCBI GI: 117518704 NCBI Desc: truncated nodulation signaling pathway 2 protein [lotus japonicus]
  misc_feature (108)..(518): NCBI GI: 115472849 NCBI Desc: os07g0567700 [oryza sativa (japonica cultivar-group)]
  misc_feature: The sequence is a functional homolog of SEQ ID NO 1327 in the 10/374,780US patent application
  misc_feature: Useful for making plants with modulated growth and phenotype characteristics
  misc_feature: The sequence is a functional homolog of SEQ ID NO 1327 in the 20060162006 US patent application
MEVTMDDVAGDVEFSGCSSTTTSSSSPSLDDGMGMYAWNALSPVADWGSLCPDDGAQDLHGLIESMLCDDTLLGSADLNPAMFPDDVYYCSNGSAPSSTTTTNPGTPVNGGDAQKGDCHEKGLRLLHLLMAAAEALSGQQKSRELARVILVRLKQMVSHIGDNAAVSNMERLATHFTDALQGLLDGSHPIGGVGRQAAAAASHGHLPHTGDVLTAFQMLQDMSPYMKFGHFTANQAILEAVAGDRRVHVVDYDIAEGVQWASLMQAMTSRPDGVPPPHLRITAVSRGGGGGARAVQEAGRRLAAFAASIGQPFSFGQCRLDSDERFRPATVRMVKGETLVANCVLNQAAATTTVRRPTGSVASFLAGMATLGAKVVTVVEEDQGDAEKDDEEVGGFVARFMEELHRYSAVWDSLEAGFPTQSRVRGLVERAILAPNIAGAVSRAYRASDGDGEARAGWGEWMRGNGFRAVPLSCFNHSQARLLLGLFNDGYTMEETSPNKIVLGWKARRLLSASVWAPPPVSVPSSPTEGAFHGGVGRMDFDYIDSFLVEPAYALV

SEQ ID NO: 10013 - DNA, 678 bp, Sorghum bicolor
  misc_feature: Ceres ANNOT ID no. 6108856
  misc_feature: Encodes the peptide sequence at SEQ ID NO 10014
atggccacctccagcgacggcgggggcgaccagcggcgcctcctctccatccccaaggaaggcgagcgcatcatcgcgcccacgcgccgccccgacggcacgctccgcaaggccatccgcatccgcgccggctacgtgccccaggaggaggtcgccatctaccagtccaagggcgccctaatgaggaagtcagggcccgacgtgccgccggggtacgacccggcactagtggccgatgccaaacccaagacgaaggcggccaagcggaacgagcgaaggaaggagaaacggcagcaggccagttcggcaaatgataaaggaaagagtacggatatagaggaaactgatgctggagaaactgacaaggctctttcttccaaagcggataagcagaaggattcagtggaaagtgtaacaaagcagataagtagcattgctatttctgagtcacatgcaacgccgtccacaaatagtacaaacaattcacaaccggaatcatctgctccagatatagataagaaaattcgtgcactgaagaagaagatacggttagctgaagcacaactacaaggtgaccctgaaaaattgaaatctgacacgctggaaaagatgaaaaagattgatggatggcgtatggagctgaagcttttggaggacaagagagcacctgaggcctag

SEQ ID NO: 10014 - protein, 225 aa, Sorghum bicolor
  misc_feature: Ceres ANNOT ID no. 6108856
  misc_feature (21)..(47): Pfam Id: Mago-bind Pfam Desc: Mago binding
  misc_feature (10)..(222): NCBI GI: 124360428 NCBI Desc: ensangp00000004563 , related [medicago truncatula]
  misc_feature (20)..(218): NCBI GI: 14150139 NCBI Desc: pym protein [homo sapiens]
  misc_feature (20)..(218): NCBI GI: 23477161 NCBI Desc: pym protein [homo sapiens]
  misc_feature (23)..(218): NCBI GI: 119617254 NCBI Desc: within bgcn homolog (drosophila), isoform cra_b [homo sapiens]
  misc_feature (20)..(218): NCBI GI: 24762413 NCBI Desc: cg30176-pa [drosophila melanogaster]
MATSSDGGGDQRRLLSIPKEGERIIAPTRRPDGTLRKAIRIRAGYVPQEEVAIYQSKGALMRKSGPDVPPGYDPALVADAKPKTKAAKRNERRKEKRQQASSANDKGKSTDIEETDAGETDKALSSKADKQKDSVESVTKQISSIAISESHATPSTNSTNNSQPESSAPDIDKKIRALKKKIRLAEAQLQGDPEKLKSDTLEKMKKIDGWRMELKLLEDKRAPEA

SEQ ID NO: 10015 - DNA, 3144 bp, Sorghum bicolor
  misc_feature: Ceres ANNOT ID no. 6108859
  misc_feature: Encodes the peptide sequence at SEQ ID NO 10016
atggcgcagtcgctggagctgctgctgatccagttcctgatgccggacaacgacgcgcgtcggcaggcggaggagcagatccggcggctggcccgcgacccgcaagtggtccccgcgctcgtccaccatctccgcacggccaagaccccaaacgtccgccagctcgccgccgtgctactccgcaaaaagatcacctcccactggcccaagcttcacccggactccaaggcatcacttaagcaagccctcatcgactcaatcacactcgaccacagtcatcctgtaaggcgagctagtgcaaatgtcgtgagcattatagctaagtatgctatccctgcaggagagtggccagagctgttacctttccttttccaatgcagccaaagtccacaagaagatcacagagaagtggctttgattcttttcagctcccttactgaaactattggagctacttttcagtctcatctgaacaatttgcaacctattttactgaaatgtctgcaagacgaaacaagctctcgagtcagaattgccgccctaaaggccgttggatcattcatagaatatgtcaatgatggaggtgacattgtaaaaatgtttcgggattttgttcccagtatcttgaatgtatcaaggcagtgtcttgctaatggagaagaagatgttgcttccattgcgtttgaaatttttgacgaactaattgaatctcctgcaccacttcttggagactctgtgaggtcaattgtgcaattctcgctggaagtttctgcaaaccaggatttggaaataaatataaggcagcaggctatccagataatttcatggctggtaaaatttaaagcatctttcttgaaaaagcacaagctggttgtacctatcctgcaagttatgtgcccattgcttacggaaacagctaatgaagatgaagattctgatttagcagcagatcgttctgctgccgaagtcattgatacaatggctatcaacttaccaaggcacgttcttgcaccagttcttgagtttgcttctgtgagctttcatcacattaatccgaagtatcgtgaggctgccgtgacatcactgggtgttatctcagagggttgttgtgagcatttgaaagataagttggaggattgtctaaaaattgttttggaagctttaaaggaccaagaacaaatggttagaggtgctgcatcttttgctcttggccagtttgctgaacacctgcaaccagaaattttatctcattatgcgagtgtacttccatgtattctaaatgctcttgaagacccatcagatgaagttaaggagaagtcatattatgctcttgcagcattctgtgaggacatgggtgaagatatcctaccatatctagagcccttgatatgcagattggttatgtctttgcagagcagtcctcggaacttgcaagagacatgcatgtctgcaattggttcggtggctgctgctgcagagcaggcttttaccccatacgccgaaaaagtccttgagatgatgaaaggttttatggtgcttattaatgacgaagatctgtgtgcacgtgctagggctactgaggttgttgggatagtagcaatggcagttggcaaagcaagaattgaagcaatattgcctccttttattgaggctgctatttctggttttggattggattacagtgaactcagagagtacactcatggtttttttagtaatgttgctgaaattttgggtgagagttttacacagtatcttcctcatgttgtccctctcgtattttcttcctgcaacttggatgatggttctgctgtggacattgatgatgccgatagtattgaaaatggatttggcggtgtttcatctgatgatgatgttaatgatgagccaagagttagaaatataagtgtgaggactggggtattagatgagaaagctgctgcaacacaggctattggttttttcgcactacacacaaagagtgcctatgctccgtatctggaggagtcactgaagattttgatcaggcacagtagttatttccatgaagatctcaggctgcaggcagtcatttctttgaaacatattctaactgctgttagggcaatacctcctacacatgctgatgtactagagaaacagaaggatgttcttgatactgttctgaacatttacatcaagactatgacagaggatgatgataaagaggtagttgcacaagcttgcatgagtgtagcagacattgtgaaggaatgtggttttgctgcaattgagccttacatgctaaggcttgctgaggtaacactggttcttttacgtcaagaatcaagctgtcagcaagtagagtcagatggtgaggatgatggtgacattgaccatgatgaagtcctcatggatgcagtttcagatcttttgcctgcttttgcaaaagtgatgggatcttattttgatcctatctttgcaaaattatttgatccattgatgaaatttgctaaatctccccatcccccccaagataagactatggttgtggcaaccttagctgaggttgctcaggaaatgggtgctccaatatctgcttatgttgataagataatgcctttggtgttgaaagagcttgcatcatctgatgctactaataggagaaatgctgctttctgtgttggcgagatatgcaagaatgggggtgcttcagcactgaaatactatggggatatacttcgttctctgcataatttgtttggtaactcagaatcagatgatgcagtaagagataatgctgctggtgctattgctaggatgataatggtgcagcctcagtcaattcctctcaaccaggttcttccagtttttatcaaagctttgccactaaaagaagatcatgaagaatcaatgactgtgtatggttgcatctgcagtttattattatcatcacatccccagatccttcctcttgtgcctgatgtcatacatgtctttgcccaagtggtggtatccccagatgagagcgatgaagtcaaaacaaatattggcaaggctgtttctcacttgatatctgtctatggccagcaaatgcagccaatactgagtgcccttccaccagctcatgcaagcgcgctggcttcatttgccagtagaagatga

SEQ ID NO: 10016 - protein, 1047 aa, Sorghum bicolor
  misc_feature: Ceres ANNOT ID no. 6108859
  misc_feature (154)..(191): Pfam Id: HEAT Pfam Desc: HEAT repeat
  misc_feature (374)..(410): Pfam Id: HEAT Pfam Desc: HEAT repeat
  misc_feature (416)..(451): Pfam Id: HEAT Pfam Desc: HEAT repeat
  misc_feature (859)..(895): Pfam Id: HEAT Pfam Desc: HEAT repeat
  misc_feature (23)..(89): Pfam Id: IBN_N Pfam Desc: Importin-beta N-terminal domain
  misc_feature (439)..(1040): NCBI GI: 18700635 NCBI Desc: importin 4 [homo sapiens]
  misc_feature (439)..(1040): NCBI GI: 62460637 NCBI Desc: importin 4 [homo sapiens]
  misc_feature (439)..(1040): NCBI GI: 62088532 NCBI Desc: importin 4 variant [homo sapiens]
  misc_feature (827)..(1047): NCBI GI: 115452045 NCBI Desc: os03g0261900 [oryza sativa (japonica cultivar-group)]
  misc_feature (403)..(1015): NCBI GI: 116132516 NCBI Desc: ensangp00000021619 [anopheles gambiae str. pest]
MAQSLELLLIQFLMPDNDARRQAEEQIRRLARDPQVVPALVHHLRTAKTPNVRQLAAVLLRKKITSHWPKLHPDSKASLKQALIDSITLDHSHPVRRASANVVSIIAKYAIPAGEWPELLPFLFQCSQSPQEDHREVALILFSSLTETIGATFQSHLNNLQPILLKCLQDETSSRVRIAALKAVGSFIEYVNDGGDIVKMFRDFVPSILNVSRQCLANGEEDVASIAFEIFDELIESPAPLLGDSVRSIVQFSLEVSANQDLEINIRQQAIQIISWLVKFKASFLKKHKLVVPILQVMCPLLTETANEDEDSDLAADRSAAEVIDTMAINLPRHVLAPVLEFASVSFHHINPKYREAAVTSLGVISEGCCEHLKDKLEDCLKIVLEALKDQEQMVRGAASFALGQFAEHLQPEILSHYASVLPCILNALEDPSDEVKEKSYYALAAFCEDMGEDILPYLEPLICRLVMSLQSSPRNLQETCMSAIGSVAAAAEQAFTPYAEKVLEMMKGFMVLINDEDLCARARATEVVGIVAMAVGKARIEAILPPFIEAAISGFGLDYSELREYTHGFFSNVAEILGESFTQYLPHVVPLVFSSCNLDDGSAVDIDDADSIENGFGGVSSDDDVNDEPRVRNISVRTGVLDEKAAATQAIGFFALHTKSAYAPYLEESLKILIRHSSYFHEDLRLQAVISLKHILTAVRAIPPTHADVLEKQKDVLDTVLNIYIKTMTEDDDKEVVAQACMSVADIVKECGFAAIEPYMLRLAEVTLVLLRQESSCQQVESDGEDDGDIDHDEVLMDAVSDLLPAFAKVMGSYFDPIFAKLFDPLMKFAKSPHPPQDKTMVVATLAEVAQEMGAPISAYVDKIMPLVLKELASSDATNRRNAAFCVGEICKNGGASALKYYGDILRSLHNLFGNSESDDAVRDNAAGAIARMIMVQPQSIPLNQVLPVFIKALPLKEDHEESMTVYGCICSLLLSSHPQILPLVPDVIHVFAQVVVSPDESDEVKTNIGKAVSHLISVYGQQMQPILSALPPAHASALASFASRR

SEQ ID NO: 10017 - DNA, 2154 bp, Sorghum bicolor
  misc_feature: Ceres ANNOT ID no. 6108873
  misc_feature: Encodes the peptide sequence at SEQ ID NO 10018
atggcctccgatctcccgctccctctcttcgtgctcctcttcctcgtcctcctaccgacgccgtgctcctcgtggcgaccggccgacgacgacgacgcgtcggtctcgaggtcggtcttccccatggacggtgacgtggcttgggtggtgcaggtcagcgacctgcatatcagcacctacaaccctgagcgtgccgccgaactggccctcctcggcaccgcgctgcgcgcaatccggcctcaccttctcctcgtcaccggtgacatcactgatgctaagaatcagcaaagaactacttcaaggcaggatgaatacgaatgggttacctacaagaaaactattgatgcaattgttggacaaggtggcattgataagagcaggatatttgatattagaggcaatcatgacacatatggagtgccctatagaggaggaaaattggacttcttttcaacgtacagtgttaactcacagtttaagcgattaagcaccgtcagtagtatattgcttcagggagatagaagctaccaatttctgggtattgatgatacaatgagtgttggcattcgttttcctgcaaatctttttggtcattcaactgataaaaggatagaagcagtaaatttagagcttcaatactggaccaatcgttccaatgttccagttacaaaagttgtatttggacatttcccaatgtcattcactgcatcatctgaaaaagggcagcgatacgaaagtgtatttgcaaggcagtctatttcagcatatctgtgtggtcatctccatgcaaaagttagtaagcagctttggaggtatcatgaaatcagaacagcagaagatcacaagtcaagcttttgggaatgggaacttggagactggaaggactccagattgataaggattttagcaatagatggtggtgcagtctcattcatagaccacacattgaaacaggcacttgaaacttccatcttggtcacatatccaacagattcaagaagtatgaatatattggattcagaaaagtggtcgatgagaaatgatataaatgttcttattttctctcatcaagttatccgtaatgtgagtgctagagtctttgactctcatagtgagtttaagattgttgaggagatacctctgcaacttgttgccagtactgttactcacagacctttgtaccatgccaaatggaatgctgaaaattacagaagttcatccgctactcgctactggttgcaggtgtttgttcttgattctcatggtttaaagatttcaagtgagcagagaccattttcagttgagggtaagatggcaattcccacgagcccatggaccaactatctgctctttgaagtccagtgggaagacatgtatcaagtccttctgtggagtaatttggccttcaccatcgtattgttgttcatccccaaactgttgtatcattttgttaggagaagttcatcatatcaaaggtgggctctgtcaattctgtcatcccctatccagcagagaaaagcttacttttggttggtttggtttttaatggagggcacaaggagtaaacctttctggttttctatggtaatatatgtgctctggctaattgaaatgccatggttttggggtcatgcaacgtctgaaaatggagaaattgctcaaatgtacttatctggatggagcgtgccagttcatgatgggggcttgatgggcaacaaactgagcaacccagatgtgcttgtcatcacactaccattcctatatctggtggttgtccctgtaatagtccttatatatggtctgtttgcagaaaattctattgtgtttttgcggcacagaagaagaatagtatcctctgctgactcagcaaatatgcatgctgagtcatcaatcatgctgccagttgctccaagggctttactaatgaaattcactgacaagatggtgtccatgatgatccagttttgtggtagctggacaaggagggctcttctactttcatgcttgatcactgcagcaatacatttgaagctctgttcaaagctaatgtcagcttatggaattgtaccaatagtcttgtcacctccattgacatggataccactgttgttattagttggtgctgcctattgtacagttctccatgtagattag

SEQ ID NO: 10018 - protein, 717 aa, Sorghum bicolor
  misc_feature: Ceres ANNOT ID no. 6108873
  misc_feature (47)..(264): Pfam Id: Metallophos Pfam Desc: Calcineurin-like phosphoesterase
  misc_feature (11)..(279): NCBI GI: 57899805 NCBI Desc: calcineurin-related phosphoesterase-like [oryza sativa (japonica cultivar-group)]
  misc_feature (11)..(279): NCBI GI: 21952835 NCBI Desc: p0696g06.7 [oryza sativa (japonica cultivar-group)]
  misc_feature (37)..(284): NCBI GI: 34395043 NCBI Desc: calcineurin-related phosphoesterase-like protein [oryza sativa (japonica cultivar-group)]
  misc_feature (48)..(275): NCBI GI: 144924121 NCBI Desc: metallophosphoesterase [medicago truncatula]
  misc_feature (48)..(279): NCBI GI: 116487833 NCBI Desc: mgc154928 protein [xenopus laevis]
MASDLPLPLFVLLFLVLLPTPCSSWRPADDDDASVSRSVFPMDGDVAWVVQVSDLHISTYNPERAAELALLGTALRAIRPHLLLVTGDITDAKNQQRTTSRQDEYEWVTYKKTIDAIVGQGGIDKSRIFDIRGNHDTYGVPYRGGKLDFFSTYSVNSQFKRLSTVSSILLQGDRSYQFLGIDDTMSVGIRFPANLFGHSTDKRIEAVNLELQYWTNRSNVPVTKVVFGHFPMSFTASSEKGQRYESVFARQSISAYLCGHLHAKVSKQLWRYHEIRTAEDHKSSFWEWELGDWKDSRLIRILAIDGGAVSFIDHTLKQALETSILVTYPTDSRSMNILDSEKWSMRNDINVLIFSHQVIRNVSARVFDSHSEFKIVEEIPLQLVASTVTHRPLYHAKWNAENYRSSSATRYWLQVFVLDSHGLKISSEQRPFSVEGKMAIPTSPWTNYLLFEVQWEDMYQVLLWSNLAFTIVLLFIPKLLYHFVRRSSSYQRWALSILSSPIQQRKAYFWLVWFLMEGTRSKPFWFSMVIYVLWLIEMPWFWGHATSENGEIAQMYLSGWSVPVHDGGLMGNKLSNPDVLVITLPFLYLVVVPVIVLIYGLFAENSIVFLRHRRRIVSSADSANMHAESSIMLPVAPRALLMKFTDKMVSMMIQFCGSWTRRALLLSCLITAAIHLKLCSKLMSAYGIVPIVLSPPLTWIPLLLLVGAAYCTVLHVD

SEQ ID NO: 10019 - DNA, 393 bp, Sorghum bicolor
  misc_feature: Ceres ANNOT ID no. 6108884
  misc_feature: Encodes the peptide sequence at SEQ ID NO 10020
atgcaggtcttcctgaagacggtgacggggaagaccgtcatcctcgaggtcgagagcagcgacaccatcgccgccgtcaaggcgaagatccaagacaaggaagggacgcaactggaggacggccgcaccctggtcgactacgacatccgtaaggagtccacgcttcacctggagcttggcctcctcggcggcgcgtacgtcgcctggtggatctcaccaaatctccgagccctcgcgtacaagtacaacgtcaacaagatgatatgccgcaagtgctatgctcgccttcctcttggggccaagaactgccgcaaaaagaagtgtggccacagcaaccagctaaggctaaagaaatgcagggacaggcacaggttttatcaatcaacttactaa

SEQ ID NO: 10020 - protein, 130 aa, Sorghum bicolor
  misc_feature: Ceres ANNOT ID no. 6108884
  misc_feature (70)..(121): Pfam Id: Ribosomal_L40e Pfam Desc: Ribosomal L40e family
  misc_feature (6)..(62): Pfam Id: ubiquitin Pfam Desc: Ubiquitin family
  misc_feature (1)..(118): NCBI GI: 485518 NCBI Desc: ubiquitin / ribosomal protein cep52 - rice
  misc_feature (1)..(118): NCBI GI: 19115310 NCBI Desc: ubiquitin family protein [schizosaccharomyces pombe]
  misc_feature (1)..(118): NCBI GI: 71040673 NCBI Desc: ubiquitin fusion protein [arachis hypogaea]
  misc_feature (1)..(118): NCBI GI: 5912365 NCBI Desc: uep1 [schizosaccharomyces pombe]
  misc_feature (1)..(118): NCBI GI: 115479831 NCBI Desc: os09g0483400 [oryza sativa (japonica cultivar-group)]
  misc_feature: Useful for making plants with modulated cold sensitivity
  misc_feature: Functional homolog of the protein sequence given in SEQ ID NO 13521
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Functional homolog of the protein sequence given in SEQ ID NO 13521
MQVFLKTVTGKTVILEVESSDTIAAVKAKIQDKEGTQLEDGRTLVDYDIRKESTLHLELGLLGGAYVAWWISPNLRALAYKYNVNKMICRKCYARLPLGAKNCRKKKCGHSNQLRLKKCRDRHRFYQSTY

SEQ ID NO: 10021 - DNA, 2046 bp, Sorghum bicolor
  misc_feature: Ceres ANNOT ID no. 6108885
  misc_feature: Encodes the peptide sequence at SEQ ID NO 10022
atggctcgcgtcctccaccgccgtctcctcctcctcgccgccgtcaccttcgccgtggccgcttctctccttcgcccagctgccgcagtgcgcccctttgttttggttctctccggtgaggatttcctcaaggattcggcaaccgcgcacccgtccctcccctctgccgactccgccgacgacgacgggtgggacgacttcgccgacgattcgccggccgccgacccgctcctctccccgtcatcctgggtccccctcctcgacccaaccagccctcccccctctggcgatgagacggactcgcctgccgacgggctcttcgtggcgggcgcccgcgcgatgctctccgcagcgtccgacggggacgacgcggcgttcgccacggccgccgcgcagatcgaggccgcggcagaggcggggcacccgggcgcgcagtccgcgctggcgttcctcaccggcgccgggatgacgcgcccggcatcccgatcgctcgcgttcctgctgcacaagttcgccgccgacgcgggagatctccagtcaaagatggccctcgcgtactcctatttccgccaggagatgtatgaagaagctgttatactatacgctgaacttgcagaagctgccctaacaagctccttgatatcaaaggagccaccagtgattgaaccaatccgtcttcacagtgggactgaagaaaataaagaggccttgaggaagtcacggggtgaggacgatgaagatttccaaatcacagagtaccaggcacagcgaggcaatgctgctgccatgtacaaattagggcttctgtattactatggactacgtgggctccgtcgtgattatggaaaagcatttcattggttttctaaggctgttgagaaaggcgagacacgagcatcggagcttctgggtgagatctatgctagaggtgctggagtggaaaggaactataccgaagcatacaagtggttggcatttgctgcaaagcagcaacattactcagcttacaatggattgggttatctttatgttaaaggctatggggtggagaagaaaaacttgacaaaagcaagggagctttttgaacttgcagctgagaataaggaagccgggggacattataaccttggtgtgttgtatcttaagggtattggcgtaaagagggatgtaattagagcatgcaatctcttgcttcatgcagttaatgctgggcaaccaaaagctatttatcaggtggcaaagctgttccagaaaggcattggtcttaagaggaatctccatatggcaacaatgctgtacaagtctgttgctgagaggggaccctggagttcactgtccagatgggctctggagtcttacttgaaaggtgatgttggaaaagcattgctcttgtattccagaatggcagatcttggatatgaggttgcacagagcaatgctgcctggattctggataggtatggtgatcaaagtatttgcatgggagaatctagttattgcacagatatggaaagacatcttcgtgcacatgctttgtggtggcaagcatccgagcagggtaatgagcatgctgctttgttgattggcgatgcctactactatggtcggggcgtagcaagggactacgaacgtgcagcagaggcatatatgcatgctcggtcacagtctaatgctcaggctatgtttaaccttgggtacatgcatgagcatggtcatggacttccccttgatttgcacttggcaaaaagatattatgatcaagctgttgaggtggattcagctgctaaactccctgtcatgcttgcactaacaagtttgtggctaaggaagaactatgcagacagttttttggttaattttatcgattcacttccagaaatataccctgttgttaaggaatgggtggaagatgttctcatggatgaagggaacgcaacaattttgactctctttgcttgccttgtaactgtcctctacttgcgggagcgtcaaaggcgtcaagttgcagcagccaacccccaacaacctgatgatgtggccatgtaa

SEQ ID NO: 10022 - protein, 681 aa, Sorghum bicolor
  misc_feature: Ceres ANNOT ID no. 6108885
  misc_feature (260)..(296): Pfam Id: Sel1 Pfam Desc: Sel1 repeat
  misc_feature (297)..(332): Pfam Id: Sel1 Pfam Desc: Sel1 repeat
  misc_feature (333)..(369): Pfam Id: Sel1 Pfam Desc: Sel1 repeat
  misc_feature (370)..(405): Pfam Id: Sel1 Pfam Desc: Sel1 repeat
  misc_feature (558)..(593): Pfam Id: Sel1 Pfam Desc: Sel1 repeat
  misc_feature (17)..(677): NCBI GI: 68131077 NCBI Desc: sel-1 [glycine max]
  misc_feature (8)..(677): NCBI GI: 8671775 NCBI Desc: t10o22.22 [arabidopsis thaliana]
  misc_feature (10)..(432): NCBI GI: 140069575 NCBI Desc: sel1-like repeat [medicago truncatula]
  misc_feature (425)..(681): NCBI GI: 140069578 NCBI Desc: sel1-like repeat [medicago truncatula]
  misc_feature (128)..(620): NCBI GI: 56203946 NCBI Desc: c20orf50 [homo sapiens]
MARVLHRRLLLLAAVTFAVAASLLRPAAAVRPFVLVLSGEDFLKDSATAHPSLPSADSADDDGWDDFADDSPAADPLLSPSSWVPLLDPTSPPPSGDETDSPADGLFVAGARAMLSAASDGDDAAFATAAAQIEAAAEAGHPGAQSALAFLTGAGMTRPASRSLAFLLHKFAADAGDLQSKMALAYSYFRQEMYEEAVILYAELAEAALTSSLISKEPPVIEPIRLHSGTEENKEALRKSRGEDDEDFQITEYQAQRGNAAAMYKLGLLYYYGLRGLRRDYGKAFHWFSKAVEKGETRASELLGEIYARGAGVERNYTEAYKWLAFAAKQQHYSAYNGLGYLYVKGYGVEKKNLTKARELFELAAENKEAGGHYNLGVLYLKGIGVKRDVIRACNLLLHAVNAGQPKAIYQVAKLFQKGIGLKRNLHMATMLYKSVAERGPWSSLSRWALESYLKGDVGKALLLYSRMADLGYEVAQSNAAWILDRYGDQSICMGESSYCTDMERHLRAHALWWQASEQGNEHAALLIGDAYYYGRGVARDYERAAEAYMHARSQSNAQAMFNLGYMHEHGHGLPLDLHLAKRYYDQAVEVDSAAKLPVMLALTSLWLRKNYADSFLVNFIDSLPEIYPVVKEWVEDVLMDEGNATILTLFACLVTVLYLRERQRRQVAAANPQQPDDVAM

SEQ ID NO: 10023 - DNA, 765 bp, Sorghum bicolor
  misc_feature: Ceres ANNOT ID no. 6108890
  misc_feature: Encodes the peptide sequence at SEQ ID NO 10024
atggctgttggaaagaacaagaggatctcgaagggaaagaagggtgggaagaagaagaccgtcgaccccttctctaagaaggattggtatgacatcaaggccccatctgtgttcagcgtgcgcaacattggcaagactagtgtccaggacacagggtgctactctattagcaactttattcagaacattgcttctgagggtctgaagcacagagtctttgaggtttgcctagctgatcttcaaggcgacgaggatcaggcttacaggaaaatcaggctccgtgctgaagatgtgcaaggcaggaatgtgctcacaaacttttggggcatgagttttactaccgataaactcagatccctagtgaagaagtggcagacattaattgaagcccatgttgatgtcaagacaactgacaactacatgctgcgcttgttctgcattggcttcaccaagaggcgcccaaaccagatccgccgcaagatggtggacattatggtgaaccaggcctcttcctgtgatcttaaggagctggtttcaaagtttataccagaagtgattggcaaagagattgagaaagctacctccagcatcttcccgcttcagaatgttttcatccgcaaggtgaagatcctgaaggccccaaagtttgaccttgggaagcttatggaggttcatggtgactataaagaggatgttggcgtgaagcttgagaggcccgttgagggagatgaggctggacaggaggttgcggctactgcagagtag

SEQ ID NO: 10024 - protein, 254 aa, Sorghum bicolor
  misc_feature: Ceres ANNOT ID no. 6108890
  misc_feature (11)..(215): Pfam Id: Ribosomal_S3Ae Pfam Desc: Ribosomal S3Ae family
  misc_feature (1)..(251): NCBI GI: 4079800 NCBI Desc: s-phase-specific ribosomal protein [oryza sativa]
  misc_feature (1)..(251): NCBI GI: 483431 NCBI Desc: cyc07 [oryza sativa]
  misc_feature (1)..(241): NCBI GI: 117671302 NCBI Desc: rps3 [cymbidium hybrid cultivar]
  misc_feature (1)..(241): NCBI GI: 6714564 NCBI Desc: cyc07 [daucus carota]
  misc_feature (1)..(241): NCBI GI: 140061726 NCBI Desc: ribosomal protein s3ae [medicago truncatula]
MAVGKNKRISKGKKGGKKKTVDPFSKKDWYDIKAPSVFSVRNIGKTSVQDTGCYSISNFIQNIASEGLKHRVFEVCLADLQGDEDQAYRKIRLRAEDVQGRNVLTNFWGMSFTTDKLRSLVKKWQTLIEAHVDVKTTDNYMLRLFCIGFTKRRPNQIRRKMVDIMVNQASSCDLKELVSKFIPEVIGKEIEKATSSIFPLQNVFIRKVKILKAPKFDLGKLMEVHGDYKEDVGVKLERPVEGDEAGQEVAATAE

SEQ ID NO: 10025 - DNA, 1119 bp, Sorghum bicolor
  misc_feature: Ceres ANNOT ID no. 6108892
  misc_feature: Encodes the peptide sequence at SEQ ID NO 10026
atgaggaggaggaggatgggggcactgcacgtcgtcggtgagcccagggtcgtcagcttccagcagcagcctgcagccgtcgtcgccaagaacggccacggccccgtcgtcgaggagatccacggcctgatccgcgtctacaaggacggacacgtcgagcgcctcccggcgatcccgaccgtgccctgcacgtggggcggcaccggagcggacgcgcctggtggcgtcgtcgcgagggacgtggtggtcgaccccgccacgggggtgtgggcgcgtctgtacgcgccgatgacgacgacgacgtccgcgggaggcggaaccggaggcagcaggccccccgtcgtggtgtacttccacggcggcgggttctgcgtcgggtccgcggcctggagctgctaccacgagttcctcgcgcagctctccgcgcgcgcgggctgcgccgtgatgtccgtggactaccgcctggcgcccgagcaccgcctgcccgccgcgttcgacgacggtctggccgccgtgcggtggctgcggcaccaggccagccgcgccgcggcgtgcgacgacctctcgtggtggcgggcccgctgcggctttgaccgcgtgttcctcatgggcgacagcgcgggcgccagcatcgccttccacgtcgccgcgaggctcgggcagggccacctcggcgcgctgtcccccttgaccgtcaggggcgccgtcctgatacagcctttcttcggcggcgaggcgcgcaccgtgtccgagaagagcatggcgcagccgccacggtcggcgctgacgctcgccacctccgactgctactggcggctggcgctgccggccggagccagcagccgcgaccacccctggtgcaacccgctgtcccgcgccgcgccgcgcctggagaccgtcccgctgccgccggtcctggtgtgcgtctcggagacggacatcctgcgggaccgcaacctggagctgtgcagggcgatgcgcaaggcgggcaagtgcgtggagcaggccatgtacggcggcgtcgggcacgcgttccaggtgctacacaactgccacctgtcccagccgcggacgcaggagatgctcgcgcacatcaaggccttcgtcagcgccaggtag

SEQ ID NO: 10026 - protein, 372 aa, Sorghum bicolor
  misc_feature: Ceres ANNOT ID no. 6108892
  misc_feature (115)..(347): Pfam Id: Abhydrolase_3 Pfam Desc: alpha/beta hydrolase fold
  misc_feature (72)..(357): NCBI GI: 82697961 NCBI Desc: cxe carboxylesterase [actinidia deliciosa]
  misc_feature (24)..(369): NCBI GI: 115470703 NCBI Desc: os07g0162700 [oryza sativa (japonica cultivar-group)]
  misc_feature (81)..(311): NCBI GI: 50261891 NCBI Desc: at1g68620 [arabidopsis lyrata subsp. petraea]
  misc_feature (38)..(370): NCBI GI: 82697949 NCBI Desc: cxe carboxylesterase [malus pumila]
  misc_feature (15)..(371): NCBI GI: 115487222 NCBI Desc: os12g0135800 [oryza sativa (japonica cultivar-group)]
MRRRRMGALHVVGEPRVVSFQQQPAAVVAKNGHGPVVEEIHGLIRVYKDGHVERLPAIPTVPCTWGGTGADAPGGVVARDVVVDPATGVWARLYAPMTTTTSAGGGTGGSRPPVVVYFHGGGFCVGSAAWSCYHEFLAQLSARAGCAVMSVDYRLAPEHRLPAAFDDGLAAVRWLRHQASRAAACDDLSWWRARCGFDRVFLMGDSAGASIAFHVAARLGQGHLGALSPLTVRGAVLIQPFFGGEARTVSEKSMAQPPRSALTLATSDCYWRLALPAGASSRDHPWCNPLSRAAPRLETVPLPPVLVCVSETDILRDRNLELCRAMRKAGKCVEQAMYGGVGHAFQVLHNCHLSQPRTQEMLAHIKAFVSAR

SEQ ID NO: 10027 - DNA, 1722 bp, Sorghum bicolor
  misc_feature: Ceres ANNOT ID no. 6108906
  misc_feature: Encodes the peptide sequence at SEQ ID NO 10028
atggctaaagtcgccgccatcctcaccgtcccctgctccgcgggccgccgcccgaagcagagcagccagcgccgcggatgcggctccagctccggttccctctccgtccgtgcgtcctccgatgcaaacacggtgacgctgctggactacggcgcggggaacgtgcgcagcgtgcgcaacgccatccgccacctcggcttcggcatccgcgacgtgcagagcccggaggacatcctcgcagcggaacggctcgtctttcccggtgtcggcgccttcggctccgccatggacgtcctcaacagcacgggcatggccgacgcactccgtgagtacatccaaagggatcgccccttcctaggcatctgcctcggtctccagctgctcttcgactccagcgaggagaacggcccggtgagcggccttggtgtgataccgggcgtggtcaggcgattcaactcctcaaatggcctcatagttccacatattggctggaacgctctccagatcaccaaggacacgccactgctgcagggagctgatggccaacatgtgtactttgttcactcctaccacatactgccttcagatgctaatagagactggatttcctcgatatgcaattatggtgacagctttatatcctccatctcgatgggcaacgttcaggctgttcaatttcacccagaaaagagcggagctaccgggctttctattctaaaaaattttctcagtcctaactcttctgggaccaaggtccctgcacgtaggaaagcatcaaaacttgcaaagagagtgatagcatgccttgatgttcggtcaaatgataaaggagatcttgtggtaacaaaaggtgatcagtatgatgtaagagatcatacgagcagcaaagaggtaagaaaccttggcaagccagtcgatttagcaagtcagtactacatagatggtgctgatgaggtcagcttcttgaatataactggtttccgtgactttccattgggtgatttgccaatgctagaggtactgcggtgtgcctctgaaaatgtttttgtgccacttacagttggtgggggcatacgagacttcacagatgcaaatggaagatactactcaagcttggaagtggcatcagaatatttcaggtctggtgctgacaaaatttcaattggaagtgatgctgtttatgctgctgaagcctttttacaaactggtgtaaagacggggaaaagcagcttggagcaaatctctagagtatatggcaatcaggctgtagttgtcagtattgatcctcggcgggtatatgtcaaaagtcaagaagatgtgccatttaaaactgtaaaggtgtccactaaaggtccatcaggagaagaatatgcatggtaccagtgtacagtgaatggtggacgtgatagccgacctataggagcatatgaactagcgaaagctgttgaagaattgggcgcaggagaaatacttcttaactgcattgattgtgatggccaaggctgtggatttgacatagatttggttaaaatggtttctgatgctgtgacaatccctgtcattgcgagcagtggtgctggtgctgttcaacatttttctgaagtctttgagaaaacaaatgcttctgctgcccttgctgctggcattttccaccggaaagaggttcccatactagcagtgaaagagcatctggtcaatgctggtgtggaggtcagggtgtag

SEQ ID NO: 10028 - protein, 573 aa, Sorghum bicolor
  misc_feature: Ceres ANNOT ID no. 6108906
  misc_feature (264)..(556): Pfam Id: His_biosynth Pfam Desc: Histidine biosynthesis protein
  misc_feature (46)..(245): Pfam Id: GATase Pfam Desc: Glutamine amidotransferase class-I
  misc_feature (75)..(191): Pfam Id: GATase_3 Pfam Desc: CobB/CobQ-like glutamine amidotransferase domain
  misc_feature (30)..(573): NCBI GI: 7269543 NCBI Desc: glutamine amidotransferase/cyclase [arabidopsis thaliana]
  misc_feature (30)..(573): NCBI GI: 3219164 NCBI Desc: glutamine amidotransferase/cyclase [arabidopsis thaliana]
  misc_feature (45)..(572): NCBI GI: 51246019 NCBI Desc: related to bifunctional histidine biosynthesis protein (hishf) [desulfotalea psychrophila lsv54]
  misc_feature (30)..(415): NCBI GI: 3413534 NCBI Desc: glutamine amidotransferase/cyclase [arabidopsis thaliana]
  misc_feature (44)..(572): NCBI GI: 119480439 NCBI Desc: glutamine amidotransferase:cyclase [neosartorya fischeri nrrl 181]
MAKVAAILTVPCSAGRRPKQSSQRRGCGSSSGSLSVRASSDANTVTLLDYGAGNVRSVRNAIRHLGFGIRDVQSPEDILAAERLVFPGVGAFGSAMDVLNSTGMADALREYIQRDRPFLGICLGLQLLFDSSEENGPVSGLGVIPGVVRRFNSSNGLIVPHIGWNALQITKDTPLLQGADGQHVYFVHSYHILPSDANRDWISSICNYGDSFISSISMGNVQAVQFHPEKSGATGLSILKNFLSPNSSGTKVPARRKASKLAKRVIACLDVRSNDKGDLVVTKGDQYDVRDHTSSKEVRNLGKPVDLASQYYIDGADEVSFLNITGFRDFPLGDLPMLEVLRCASENVFVPLTVGGGIRDFTDANGRYYSSLEVASEYFRSGADKISIGSDAVYAAEAFLQTGVKTGKSSLEQISRVYGNQAVVVSIDPRRVYVKSQEDVPFKTVKVSTKGPSGEEYAWYQCTVNGGRDSRPIGAYELAKAVEELGAGEILLNCIDCDGQGCGFDIDLVKMVSDAVTIPVIASSGAGAVQHFSEVFEKTNASAALAAGIFHRKEVPILAVKEHLVNAGVEVRV

SEQ ID NO: 10029 - DNA, 2604 bp, Sorghum bicolor
  misc_feature: Ceres ANNOT ID no. 6108917
  misc_feature: Encodes the peptide sequence at SEQ ID NO 10030
  misc_feature: Down-regulated in root tissues in response to methyl jasmonate treatment
  misc_feature: Down-regulated in shoot tissues in response to methyl jasmonate treatment
atggcggccaccgcgcggcttcttcctgccttcgccgatgctgctgcggcggcggcggcgctgctggtggtggtgctctgcctcgcgggcggcgcgcgggcgaccaacgtgacgtacgaccaccgcgcgctggtcatcgacggcgtgcggcgcgtgctcgtctccggctccatccactacccacggagcacgcccgacatgtggccggggatcatccagaaggccaaggacggcggcctggacgtcatcgagacctacgtcttctgggacatccacgagcccgtcaggggacaggcacgtttaccgacatggcagtacgacttcgagggccgcaaggacctggccgcgttcgtcaagaccgtcgccgacgccggcctctacgtgcacctccgcatcggtccctacgtctgcgccgagtggaactacggaggcttcccgctgtggctgcacttcatccccggcatcaagttccgcaccgacaacgagcctttcaagacggagatgcagcgcttcaccgccaaggtggtggacaccatgaagggggcggggctgtacgcgtcgcagggcgggcccatcatcctgtcccagatcgaaaacgagtacggcaacatcgactcggcgtacggggcggccgggaaggcgtacatgcggtgggcggccggcatggccatctcgctcgacaccggcgtgccctgggtcatgtgccagcagaccgacgcgccggacccactcatcaacacctgcaacggcttctactgcgaccagttcacgcccaactccgccgccaagcccaagatgtggaccgagaactggagcggctggttcctctcattcggcggcgccgtcccctaccgccccgtcgaggacctggccttcgccgtcgccaggttctaccagcgcggcggcaccttccagaactactacatgtatcatggagggaccaacctcgaccgcagctcagggggacccttcatcgctacgagctacgactacgatgcccccatcgacgagtacggactagtcagggaaccaaagtggggccacttaagggatgtgcacaaagccatcaagctctgcgaaccagcgctcatagcaactgatccatcatacacttctctaggtcaaaatgctgaggcagcggtatacaagactggttcagtttgcgcagcattccttgccaacatagatggtcaatctgataaaaccgtcaccttcaatgggagaatgtacaggctccctgcgtggtctgtcagcatccttcctgactgcaagaatgtggtgcttaacacagcacagatcaattctcaagtgacgagttcagaaatgagatacttggaatcgagcaacatggcatcagatggctcattcatcacgccagaactggcagtatctggctggagctatgccatagagcctgtaggtattacaaaggacaatgcactaacaaaggctggactgatggagcagataaacaccacagcagatgccagtgatttcctctggtactcaacaagcatcacagttaaaggtgatgaaccctatctaaatggcagccagtccaatctggttgtcaactcacttggacatgttcttcaggtctacatcaatggtaaaattgcaggaagcgcacaaggtagtgcgagcagctcactcatctcatggcagaaaccaattgaacttgtacctgggaagaacaaaatagatcttctaagtgcaacagttgggctgtcgaattatggtgcattcttcgacctggtaggtgctggaattactgggccagtaaagctgagtggaacaaatggtgcactcgatctgtcttctgcagaatggacataccagattggactcagaggagaagatctgcacctatatgatccttcagaagcctcaccagaatgggtctcagccaatgcttatccaatcaatcaaccactgatttggtacaagaccaagttcacgcctcctgctggtgatgatcctgttgcaattgacttcacgggaatgggtaaaggcgaagcatgggtgaacggacagagcattggtcgatactggccaacaaatctggctccacagagtggctgtgtcaactcgtgcaactacagaggaagctacaattcaaacaaatgcctgaagaagtgtggccagccatcacagactttgtaccatgttccccgttcgtttcttcaaccaggcagcaatgatatagtccttttcgagcaatttggtggtgacccaagcaagatatcctttgtgataaggcagacaggaagtgtgtgcgcacaagtatcagaggaacatccagcccaaattgatagttggaattcttctcaacagacaatgcaaagatatggacctgaacttcgcctggaatgcccaaaagatggccaggtcatcagcagcatcaagtttgcaagctttgggacaccgagcggcacgtgtggaagctacagccacggcgaatgcagcagcactcaggctctctcagttgttcaggaggcttgcattggagtgagcagctgcagcgtgccagtgtcgtcgaattactttggaaatccatgcacaggggtcacaaaaagccttgcggttgaagctgcatgttcgtga

SEQ ID NO: 10030 - protein, 867 aa, Sorghum bicolor
  misc_feature: Ceres ANNOT ID no. 6108917
  misc_feature (43)..(356): Pfam Id: Glyco_hydro_35 Pfam Desc: Glycosyl hydrolases family 35
  misc_feature (789)..(866): Pfam Id: Gal_Lectin Pfam Desc: Galactose binding lectin domain
  misc_feature (45)..(867): NCBI GI: 61614851 NCBI Desc: beta-galactosidase [sandersonia aurantiaca]
  misc_feature (18)..(867): NCBI GI: 140053716 NCBI Desc: rhodopsin-like gpcr superfamily; d-galactoside/l-rhamnose binding suel lectin; galactose-binding like [medicago truncatula]
  misc_feature (21)..(866): NCBI GI: 14970841 NCBI Desc: beta-galactosidase [fragaria x ananassa]
  misc_feature (20)..(867): NCBI GI: 56201401 NCBI Desc: beta-galactosidase [raphanus sativus]
  misc_feature (21)..(866): NCBI GI: 61162203 NCBI Desc: beta-d-galactosidase [pyrus pyrifolia]
  misc_feature (19)..(867): SWISSPROT Homolog: EC 3.2.1.23 Beta-galactosidase precursor
  misc_feature: Useful for making plants with altered cell wall content and/or composition
  misc_feature: GREAT-hit functional homolog of the protein sequence encoded by LOCUS at2g28470
  misc_feature: Useful for making plants with altered cell wall content and/or composition
  misc_feature: Functional homolog of the protein sequence given in SEQ ID NO 13587
  misc_feature: The sequence is a functional homolog of SEQ ID NO 2 in US patent 7084321
  misc_feature: Useful for making plants with altered carbohydrate content
  misc_feature: Functional homolog of the protein sequence given in SEQ ID NO 13588
  misc_feature: Down-regulated in root tissues in response to methyl jasmonate treatment
  misc_feature: Down-regulated in shoot tissues in response to methyl jasmonate treatment
MAATARLLPAFADAAAAAAALLVVVLCLAGGARATNVTYDHRALVIDGVRRVLVSGSIHYPRSTPDMWPGIIQKAKDGGLDVIETYVFWDIHEPVRGQARLPTWQYDFEGRKDLAAFVKTVADAGLYVHLRIGPYVCAEWNYGGFPLWLHFIPGIKFRTDNEPFKTEMQRFTAKVVDTMKGAGLYASQGGPIILSQIENEYGNIDSAYGAAGKAYMRWAAGMAISLDTGVPWVMCQQTDAPDPLINTCNGFYCDQFTPNSAAKPKMWTENWSGWFLSFGGAVPYRPVEDLAFAVARFYQRGGTFQNYYMYHGGTNLDRSSGGPFIATSYDYDAPIDEYGLVREPKWGHLRDVHKAIKLCEPALIATDPSYTSLGQNAEAAVYKTGSVCAAFLANIDGQSDKTVTFNGRMYRLPAWSVSILPDCKNVVLNTAQINSQVTSSEMRYLESSNMASDGSFITPELAVSGWSYAIEPVGITKDNALTKAGLMEQINTTADASDFLWYSTSITVKGDEPYLNGSQSNLVVNSLGHVLQVYINGKIAGSAQGSASSSLISWQKPIELVPGKNKIDLLSATVGLSNYGAFFDLVGAGITGPVKLSGTNGALDLSSAEWTYQIGLRGEDLHLYDPSEASPEWVSANAYPINQPLIWYKTKFTPPAGDDPVAIDFTGMGKGEAWVNGQSIGRYWPTNLAPQSGCVNSCNYRGSYNSNKCLKKCGQPSQTLYHVPRSFLQPGSNDIVLFEQFGGDPSKISFVIRQTGSVCAQVSEEHPAQIDSWNSSQQTMQRYGPELRLECPKDGQVISSIKFASFGTPSGTCGSYSHGECSSTQALSVVQEACIGVSSCSVPVSSNYFGNPCTGVTKSLAVEAACS

SEQ ID NO: 10031 - DNA, 1176 bp, Sorghum bicolor
  misc_feature: Ceres ANNOT ID no. 6108920
  misc_feature: Encodes the peptide sequence at SEQ ID NO 10032
atggcgacatccaagaaggatcccccaaatcctagcagaggcaggatgtcacccaacctcaggccatccagcagtgagtcctctgggtatggatacggtgctaggcgggcgcggtctgtcccaagctcccccgaccgcaaattcagctcatcatcgtcatctgtgactgcctctagctccaaggatgtgcagcgtccatcattgtccagcgctggtcggtccatctcatcgcggaccatgggctcatccatccatggcaccaaggcccaaccattcccaggtgcagcctcacctacactagcgagggcgaaatccgacaaggtcagcaccacctcgcaacggcctccggtgcttgctgtgccaccgagcaactcttttaaggacatgaccaagacagcaactaaggcacctccaactccaaccacctcgctgaggagtaagccatctccaaggcctactgctgatagttgcaaggcagcagcatcacctaaacctagcaaccagaaggtcttgttgccaggtgcttctcgaggagacaaagttcagccattgtctaccacacactcacctggtgtagccgcaagaaagagattggatactgttactggtgctactactagctctcagaaggcaatgggggcatctgcaaccaggaaggagaaacataaggacccatcgatgcaaattaagggaacaaagtgcataaacaccaccctatccacagaagagcacttgcacaaggagctcactgatccagttgatttgaaatccatggagatgaccgtacctgatcagcatgagccatcttccaatcaaccagaacaagtattcaaagatgatgaggaatccaagaggcatttctctgaagggaaagtagatgccggaactaatgggatccataatggagggcaagatatcaatggtggcgtcaagactatatatgaatgtgggattgttgagaaggaggaggctgatctctcaaaaaagaaggaggaggctgaccgaagtgcagataaggtagtgccgaggactgaagtggctcaggtgtggaggaaggatgatccaaggggcaacgacgtgattgaggaaaccaaaagcaaacttctggaggagaggaagagccgggtgaaggccttggtgggggccttcgaaactgtattgtcattcaaggaatag

SEQ ID NO: 10032 - protein, 391 aa, Sorghum bicolor
  misc_feature: Ceres ANNOT ID no. 6108920
  misc_feature (288)..(388): Pfam Id: CaM_binding Pfam Desc: Plant calmodulin-binding domain
  misc_feature (1)..(391): NCBI GI: 116309140 NCBI Desc: osigba0145c02.7 [oryza sativa (indica cultivar-group)]
  misc_feature (1)..(391): NCBI GI: 115457550 NCBI Desc: os04g0284900 [oryza sativa (japonica cultivar-group)]
  misc_feature (1)..(379): NCBI GI: 38346436 NCBI Desc: osjnba0019j05.21 [oryza sativa (japonica cultivar-group)]
  misc_feature (9)..(188): NCBI GI: 119584581 NCBI Desc: hcg2042888, isoform cra_a [homo sapiens]
  misc_feature (9)..(188): NCBI GI: 109658562 NCBI Desc: tprxl protein [homo sapiens]
MATSKKDPPNPSRGRMSPNLRPSSSESSGYGYGARRARSVPSSPDRKFSSSSSSVTASSSKDVQRPSLSSAGRSISSRTMGSSIHGTKAQPFPGAASPTLARAKSDKVSTTSQRPPVLAVPPSNSFKDMTKTATKAPPTPTTSLRSKPSPRPTADSCKAAASPKPSNQKVLLPGASRGDKVQPLSTTHSPGVAARKRLDTVTGATTSSQKAMGASATRKEKHKDPSMQIKGTKCINTTLSTEEHLHKELTDPVDLKSMEMTVPDQHEPSSNQPEQVFKDDEESKRHFSEGKVDAGTNGIHNGGQDINGGVKTIYECGIVEKEEADLSKKKEEADRSADKVVPRTEVAQVWRKDDPRGNDVIEETKSKLLEERKSRVKALVGAFETVLSFKE

SEQ ID NO: 10033 - DNA, 1323 bp, Sorghum bicolor
  misc_feature: Ceres ANNOT ID no. 6108922
  misc_feature: Encodes the peptide sequence at SEQ ID NO 10034
atggccgcgcccgtgtcgcagccgccggtggccgccagggcgtccacgcggttcctcccgcgcgggataggcgcgctcccggagtccgcccccgcgtcgctccgcttctccgtcggccgccgccgccgcgccgctcgcctagaggtgaaggcatcgggaaatgtgttcgggaactacttccaggttgcaacctatggcgaatcccatggagggggtgttggttgtgttatcagtggctgcccacccagaattcctctctctgaggcagacatgcaagtagaactcgatagaagacgtccgggtcaaagtagaataacaaccccaagaaaggagactgatacatgcaaaattctatcagggacacatgatgggatgactactggcacaccaattcacgtctttgtcccgaacacagatcaaagaggcggtgattacagtgaaatggctaaggcgtacagaccatcccatgcagatgcaacctatgacttcaagtatggtgtcagagctgtgcagggaggcggaaggtcatcggccagagaaaccattggcagggtggctgcaggagctcttgcaaagaaaattctgaagctcaaatcaggagtggagatcttggcatttgtttctaaagtgcatcaagtcgtacttccagaagatgcagttgattatgagactgtagccttggaacagatagagagcaacattgttagatgtcctgatccagaatatgcagagaagatgattgctgccattgataaagtacgagttagaggagactcaattggtggggttgtcacatgcattgcaagaaatgttcctcgtggtcttggctctcctgtttttgataaacttgaagctgaactggcaaaagcaatgctttctcttcctgcaagcaaggggtttgagattggcagtgggtttgctggtacggactttactggaagtgagcataatgatgagttctatatggatgaggctggaaatgtgaggacacgaactaatcgctcaggcggtgttcagggagggatatcgaatggtgaaattatttacttcaaagtggcttttaagccaacagcaactatcggaaagaaacaaaatactgtgtcaagggagcatgaggatgtggaacttttggcaagggggcgccatgacccgtgtgttgtccctcgagctgttcctatggtggaatccatggctgcgctggtccttatggaccagctcatggcgcatattgctcagtgtgagatgtttccgctgaaccttgccctacaagagcccattggctctgctagcagtgcatctgaactggaaccaaacctatcataa

SEQ ID NO: 10034 - protein, 440 aa, Sorghum bicolor
  misc_feature: Ceres ANNOT ID no. 6108922
  misc_feature (60)..(410): Pfam Id: Chorismate_synt Pfam Desc: Chorismate synthase
  misc_feature (26)..(435): NCBI GI: 410482 NCBI Desc: chorismate synthase 1 [lycopersicon esculentum]
  misc_feature (22)..(433): NCBI GI: 410484 NCBI Desc: chorismate synthase 2 [lycopersicon esculentum]
  misc_feature (1)..(436): NCBI GI: 18256 NCBI Desc: chorismate synthase [corydalis sempervirens]
  misc_feature (1)..(426): NCBI GI: 77547031 NCBI Desc: chorismate synthase [glycine max]
  misc_feature (29)..(362): NCBI GI: 79319526 NCBI Desc: emb1144; chorismate synthase [arabidopsis thaliana]
  misc_feature (26)..(435): SWISSPROT Homolog: EC 4.2.3.5 Chorismate synthase 1, chloroplast precursor
MAAPVSQPPVAARASTRFLPRGIGALPESAPASLRFSVGRRRRAARLEVKASGNVFGNYFQVATYGESHGGGVGCVISGCPPRIPLSEADMQVELDRRRPGQSRITTPRKETDTCKILSGTHDGMTTGTPIHVFVPNTDQRGGDYSEMAKAYRPSHADATYDFKYGVRAVQGGGRSSARETIGRVAAGALAKKILKLKSGVEILAFVSKVHQVVLPEDAVDYETVALEQIESNIVRCPDPEYAEKMIAAIDKVRVRGDSIGGVVTCIARNVPRGLGSPVFDKLEAELAKAMLSLPASKGFEIGSGFAGTDFTGSEHNDEFYMDEAGNVRTRTNRSGGVQGGISNGEIIYFKVAFKPTATIGKKQNTVSREHEDVELLARGRHDPCVVPRAVPMVESMAALVLMDQLMAHIAQCEMFPLNLALQEPIGSASSASELEPNLS

SEQ ID NO: 10035 - DNA, 1383 bp, Sorghum bicolor
  misc_feature: Ceres ANNOT ID no. 6108924
  misc_feature: Encodes the peptide sequence at SEQ ID NO 10036
atggacgacgcggaggagatgcaggtggagaggctgcaagaggaggccgacgcggggggtgccgacacggacaagctcagctacgagatattctccatcctcgagagcaagttcctgttcggctacaccgacccgcaccagctctggctgcccaagccgccgacgccgcaggcgtcggccgcggcgccgggtaagccatcggcggcggcgcagcgggggaaggtctgcgtgctctgcgtggacggcggtggcggcggcctgcgcgcgctgctggcgggacgcgcgctggcgcacctggaggccgcgctccgtcgcgcgtcgggggaccccgacgcccgcgtcgccgactacttcgacctcgctgcaggcaccggcgccggcggcgtgttcgccgcgatgctcttctccacgcactcgcgtggtgcgccgctgttccacgccgacgacacgtggcggctcgtggcggaccacgcgccgcggatgttccgcaggcccgggtcctcctcgtccacgtccctgttctgccgcggcaagaagcggcccctggccgcgcccacggcggcgctggaggcggcgatgaagtccgcgttcggcgaggagctcaccctgcgggacaccatcaagcccgtgctcatctcctgctacgacctcaagacgtccgcgccgctggtgttctcgcgcgccgacgccctggagaacgagagctacgacttccgcctgtgcgaggtcgggcgcgccgcgtggtctgaggccggccgcttcgagcccgccgaggtggcctcggtcgacggcgccacgtcctgcgccgctgtagacggcgggcccaccatgggtagcccggcggccgccgccatcacgcacgtgctccacaacaagcacgagttcccgttcgtgcgcggggtcgaggacctcctcgtgctctccatcggcggctgctctggcggaggctccggcgccgctggcgaggcggaactccggcgcatgcgtcggtggggtcccaaggaatgggcgcgccccatcgcccgtatcgctgccgacggcgccgccgacctggtcgaccacgccgtggcgcgcgccttcgggcaatgccgctcatccaactacctgcgcatccaggcgaagcgggagagcatgccgccgtgcggtccggacggggagtacgatccgagcccagggaacgtgcgcgcgcttctcgcggcggcggacgagatgctcaagcagcggaacgtggagtcggtgctgttcgaggggaggcgagtcggggagcagacgaacgcggagaagctggactggttcgcggccgagctcgtcgcggagcaccgctgcagaggctcccggatcgcacccaccgttgcgttcaagcaggcgccgcagaagccgtag

SEQ ID NO: 10036 - protein, 460 aa, Sorghum bicolor
  misc_feature: Ceres ANNOT ID no. 6108924
  misc_feature (83)..(285): Pfam Id: Patatin Pfam Desc: Patatin-like phospholipase
  misc_feature (17)..(452): NCBI GI: 115470565 NCBI Desc: os07g0144500 [oryza sativa (japonica cultivar-group)]
  misc_feature (72)..(452): NCBI GI: 23495752 NCBI Desc: lipid acyl hydrolase-like protein [oryza sativa (japonica cultivar-group)]
  misc_feature (74)..(373): NCBI GI: 24111291 NCBI Desc: at3g63200/f16m2_50 [arabidopsis thaliana]
  misc_feature (190)..(454): NCBI GI: 115469510 NCBI Desc: os06g0677000 [oryza sativa (japonica cultivar-group)]
  misc_feature (56)..(332): NCBI GI: 115455741 NCBI Desc: os03g0784100 [oryza sativa (japonica cultivar-group)]
MDDAEEMQVERLQEEADAGGADTDKLSYEIFSILESKFLFGYTDPHQLWLPKPPTPQASAAAPGKPSAAAQRGKVCVLCVDGGGGGLRALLAGRALAHLEAALRRASGDPDARVADYFDLAAGTGAGGVFAAMLFSTHSRGAPLFHADDTWRLVADHAPRMFRRPGSSSSTSLFCRGKKRPLAAPTAALEAAMKSAFGEELTLRDTIKPVLISCYDLKTSAPLVFSRADALENESYDFRLCEVGRAAWSEAGRFEPAEVASVDGATSCAAVDGGPTMGSPAAAAITHVLHNKHEFPFVRGVEDLLVLSIGGCSGGGSGAAGEAELRRMRRWGPKEWARPIARIAADGAADLVDHAVARAFGQCRSSNYLRIQAKRESMPPCGPDGEYDPSPGNVRALLAAADEMLKQRNVESVLFEGRRVGEQTNAEKLDWFAAELVAEHRCRGSRIAPTVAFKQAPQKP

SEQ ID NO: 10037 - DNA, 1539 bp, Sorghum bicolor
  misc_feature: Ceres ANNOT ID no. 6108944
  misc_feature: Encodes the peptide sequence at SEQ ID NO 10038
atggaagtggtggcgtcggcgccggggaaggtgctcatcgcgggaggatacctcgtgctggagcgccccaacgccggcctggtcctcagcaccaccgcccgcttctacgccgtcgtccgccccatccgcgacagcctccccgccgactcctgggcctgggcgtggacggatgtgaaagtgacttcccctcagctctcccgggaggccacatacaagttgtctctaacgaaatcgacactgcaattgacgtctgcaagggaatctacaaacccttttgttgagcaggccatacagttctccgtagcagctgctaaatcgatcatcactgataaggacaagaaggatgctatagataagctgctgttgcaaggtctgaacattacaattcttggttgcaatgatttctattcttatagaaagcagatcgaagcacgtggtcttcctcttactacggaggtattgctttcattgcctccattctcttcaattacatttaactcagaggttgctaatggaacaacgactggagagaaatgtaaacctgaagtagccaaaactggacttgggtcatcagctgccatgaccacatcagttgttgcagctcttcttcactaccttggtgctgttaacctttcatgtccgggacaaccttccggtgataatgcaactggacgaggtcttgacttggttcacgctattgcccaaagtgcacattgtatagcacaagggaaaattggaagtggttttgatgttagtgctgctgtctatgggagtcaacgctatgtaaggttttctccagaaatactctcctcggctcaggctacaggtgggactttcttgccagatgtagtatccgatattgttacacaaaggtgggatcatgagaataaacagttttcattaccccctctgatgacccttctccttggggaacctggaaccggaggatcatctactccatcaatggttggatctgtgaaacggtggcagaagtctgaccctgagaaatccaaagatacatggagtaaactggccattgccaattcagcgctggagaaccaactgagaatcttaaaaggactttctgaaaatcaccgggaggcatatgagtctgtagtgcggtcctgtagtcatctcacatatgggaagtggacagaggtggctactaaccaagatcaagaattaattgttagatcattgttggctgcaagggatgcttcccttgagataaggcttcacatgcgagagatgggtatagcagccggtgttccaattgagccagattcacaaacacagctactagatgccactatgaatatggagggtgttttactggctggagttcctggagctggtggtttcgatgcagtattctcagtgactttgggggatgcaaataatgctgtagcaaatgcttggagctcagctggcgttctgccacttcttgtacgagaagactgccgtggtgtttcattggaagatgctgacccaagaacaagggaggtctcagcagctgtatcgtccattcagattaattga

SEQ ID NO: 10038 - protein, 512 aa, Sorghum bicolor
  misc_feature: Ceres ANNOT ID no. 6108944
  misc_feature (162)..(258): Pfam Id: GHMP_kinases_N Pfam Desc: GHMP kinases N terminal domain
  misc_feature (1)..(511): NCBI GI: 16417948 NCBI Desc: phosphomevalonate kinase [hevea brasiliensis]
  misc_feature (121)..(493): NCBI GI: 71744568 NCBI Desc: phosphomevalonate kinase protein [trypanosoma brucei]
  misc_feature (183)..(493): NCBI GI: 68125515 NCBI Desc: phosphomevalonate kinase-like protein [leishmania major]
  misc_feature (183)..(490): NCBI GI: 134060613 NCBI Desc: phosphomevalonate kinase-like protein [leishmania braziliensis]
  misc_feature (183)..(493): NCBI GI: 146082207 NCBI Desc: phosphomevalonate kinase-like protein [leishmania infantum jpcm5]
MEVVASAPGKVLIAGGYLVLERPNAGLVLSTTARFYAVVRPIRDSLPADSWAWAWTDVKVTSPQLSREATYKLSLTKSTLQLTSARESTNPFVEQAIQFSVAAAKSIITDKDKKDAIDKLLLQGLNITILGCNDFYSYRKQIEARGLPLTTEVLLSLPPFSSITFNSEVANGTTTGEKCKPEVAKTGLGSSAAMTTSVVAALLHYLGAVNLSCPGQPSGDNATGRGLDLVHAIAQSAHCIAQGKIGSGFDVSAAVYGSQRYVRFSPEILSSAQATGGTFLPDVVSDIVTQRWDHENKQFSLPPLMTLLLGEPGTGGSSTPSMVGSVKRWQKSDPEKSKDTWSKLAIANSALENQLRILKGLSENHREAYESVVRSCSHLTYGKWTEVATNQDQELIVRSLLAARDASLEIRLHMREMGIAAGVPIEPDSQTQLLDATMNMEGVLLAGVPGAGGFDAVFSVTLGDANNAVANAWSSAGVLPLLVREDCRGVSLEDADPRTREVSAAVSSIQIN

SEQ ID NO: 10039 - DNA, 276 bp, Sorghum bicolor
  misc_feature: Ceres ANNOT ID no. 6108946
  misc_feature: Encodes the peptide sequence at SEQ ID NO 10040
atgtcttggagcgacagtgagaacgcggtgttcgagcgcgcgctggccacgtacgaccgggacacgcccaggcggtgggagctcgtggccgccgcggtgggcggcgggaagaccgccgaggacgcgaggcgccactacgcccacctcgtcaatgacgtcggcgacatcgagtccggcggctacggcaacgaccccaaccccaaccccaacgccgccgcccgcaacggcaacaacgggaacaacaacaggggcagagccaacaggccccagagatga

SEQ ID NO: 10040 - protein, 91 aa, Sorghum bicolor
  misc_feature: Ceres ANNOT ID no. 6108946
  misc_feature (2)..(78): NCBI GI: 38566494 NCBI Desc: at4g36570 [arabidopsis thaliana]
  misc_feature (2)..(74): NCBI GI: 115468102 NCBI Desc: os06g0480700 [oryza sativa (japonica cultivar-group)]
  misc_feature (2)..(73): NCBI GI: 51090773 NCBI Desc: myb-related protein-like [oryza sativa (japonica cultivar-group)]
  misc_feature (2)..(87): NCBI GI: 112292446 NCBI Desc: atrl1 [arabidopsis thaliana]
  misc_feature (2)..(87): NCBI GI: 145356202 NCBI Desc: dna binding / transcription factor [arabidopsis thaliana]
  misc_feature: Useful for making plants with altered Lignin content
  misc_feature: Useful for making plants with modulated low light sensitivity
  misc_feature: Functional homolog of the protein sequence given in SEQ ID NO 12938
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 510 in the 10/666,642 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1897 in the 11/479,226 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: The sequence is a functional homolog of SEQ ID NO. 535 in the 11/188,298 US application
MSWSDSENAVFERALATYDRDTPRRWELVAAAVGGGKTAEDARRHYAHLVNDVGDIESGGYGNDPNPNPNAAARNGNNGNNNRGRANRPQR

SEQ ID NO: 10041 - DNA, 1458 bp, Sorghum bicolor
  misc_feature: Ceres ANNOT ID no. 6108947
  misc_feature: Encodes the peptide sequence at SEQ ID NO 10042
atggacatggcattgcccgttgtgaatgccacagcggcagtgctcgcccgtgtctcggctgcattcaatgccccccttgcccgtgcagtcgtctttggggtccatattgatgggcacttggtcgtagaaggactgcttattgcagtcatagtgtttcagctctccaggaagagctacaaaccaccaaagaaaccactcactgaaaaggagattgatgagctatgtgatgagtgggagccagagccgctatgccctccaatcaaggagggggccagaatagatactccaatgttggaaagtgccgctggaccacatacgattgttgatggtaaagaagttgtgaactttgcatcagcaaactaccttggtttaattggcaacgaaaagattattgattcttgcattggttcactggagaaatatggtgttgggtcttgtggtccacgtggcttctatggaacaattgatgtccatcttgactgtgagtcaaaaatagctaatttcctggggactccagactccattctgtattcatatgggatttctacaatattcagtgtgatacctgccttctgtaagaaaggagatatcatagtcgctgatgagggtgttcactgggcagtgcaaaatggtctccatctatcaagaagcactgtggtgtacttcaagcacaatgatatggcttcacttgcaagcactttggaaaaacttactcatggaaataaacgtgctgaaaagattagacgctacattgttgtagaatccatttaccagaattctggccaaattgcccccttggatgagattgtcaggttgaaggagaaatatcgtttccgtgttattctggaggagagccattcttttggggtgcttggcaagtctgggcgtggccttgctgaacattatggagttcctattgaaaaaattgatatcatcactgctggaatgggaaatgcattagctactgatggtggtttttgtacaggaagtgtcagagttgttgatcatcagcgtctaagcagctctgggtatgttttctctgcatctctgccaccttatcttgccagcgctgctgtttctgctgtcaactacctggaggagaatccctcagttcttgcaaacctaaggagcaatattgctcttttgcataaagaactatcagatactccagggcttgaaatttccagccatgttctgtcacctatcgtcttccttaagctgaagaaatcaactggctctcctaccactgatctagatcttcttgaaactattgctgacaaggtcttgaaggaagattcagttttcattgtgacatcaaagaagtcaaatctggataggtgcaaacttccccttggaatccgcctgtttgtatcagctggacatactgaatcagacatctccaggctttcctcatccttgaagagggtttctgcatcagttctttcagactacttttga

SEQ ID NO: 10042 - protein, 485 aa, Sorghum bicolor
  misc_feature: Ceres ANNOT ID no. 6108947
  misc_feature (111)..(473): Pfam Id: Aminotran_1_2 Pfam Desc: Aminotransferase class I and II
  misc_feature (1)..(481): NCBI GI: 115449375 NCBI Desc: os02g0806900 [oryza sativa (japonica cultivar-group)]
  misc_feature (3)..(481): NCBI GI: 23197846 NCBI Desc: serine c-palmitoyltransferase like protein [arabidopsis thaliana]
  misc_feature (3)..(481): NCBI GI: 4006914 NCBI Desc: serine c-palmitoyltransferase like protein [arabidopsis thaliana]
  misc_feature (3)..(305): NCBI GI: 92873172 NCBI Desc: serine c-palmitoyltransferase like protein [imported] - arabidopsis thaliana-related [medicago truncatula]
  misc_feature (39)..(481): NCBI GI: 119583208 NCBI Desc: serine palmitoyltransferase, long chain base subunit 1, isoform cra_a [homo sapiens]
  misc_feature: Useful for making plants with modulated nitrogen use efficiency
  misc_feature: GREAT-hit functional homolog of the protein sequence encoded by LOCUS at4g36480
  misc_feature: Useful for making plants with modulated nitrogen use efficiency
  misc_feature: Functional homolog of the protein sequence given in SEQ ID NO 13586
MDMALPVVNATAAVLARVSAAFNAPLARAVVFGVHIDGHLVVEGLLIAVIVFQLSRKSYKPPKKPLTEKEIDELCDEWEPEPLCPPIKEGARIDTPMLESAAGPHTIVDGKEVVNFASANYLGLIGNEKIIDSCIGSLEKYGVGSCGPRGFYGTIDVHLDCESKIANFLGTPDSILYSYGISTIFSVIPAFCKKGDIIVADEGVHWAVQNGLHLSRSTVVYFKHNDMASLASTLEKLTHGNKRAEKIRRYIVVESIYQNSGQIAPLDEIVRLKEKYRFRVILEESHSFGVLGKSGRGLAEHYGVPIEKIDIITAGMGNALATDGGFCTGSVRVVDHQRLSSSGYVFSASLPPYLASAAVSAVNYLEENPSVLANLRSNIALLHKELSDTPGLEISSHVLSPIVFLKLKKSTGSPTTDLDLLETIADKVLKEDSVFIVTSKKSNLDRCKLPLGIRLFVSAGHTESDISRLSSSLKRVSASVLSDYF

SEQ ID NO: 10043 - DNA, 996 bp, Sorghum bicolor
  misc_feature: Ceres ANNOT ID no. 6108950
  misc_feature: Encodes the peptide sequence at SEQ ID NO 10044
atggacccgtataagtacctcaagatccggttcaacccggacggctcgctctgccgctacggggaggcgccgctcctcccggcagcgccggccggggagcccgtgacggtcgaggacgaccagggggcgcgccgcattgcggtccactccaacgacgtcccgctcaacgacgccaccggcacgggcctccgcctcttcgtgccgtccgtgtccggcggccaccacgaccggctgccgctgatcgtctacttccacggcggcgggtacgtcctcttccgcgcggcctccgagccgttccacaacacctgcacggcgctcgccgccgcgggccccgcggtcgtcgcgtccgtggactaccgcctggcccccgagcaccgcctccccgcggcgttcgaggacgccgccgacgccgtcctgtgggcgcgcccgcacgccgccgccgggaggcccgtgttcgtgatgggaagccacaacggggccagcatcgcgttccgcgccgcgctggcggcggcggacgccggcgtggagctgcgcggggtgatcctgaaccagccgcacctcggcggcgccgagaggtcgcccgcggaggcggcgtccgtggacgaccgcgtgctgccgctggccgcgaaccacctgctctgggagctcgcgctgcccgtgggcgcggaccgggaccacgagtactgcaacccggaggccatgctcgcccgtgtgggcgccgcgcggctgcggaggctcccgccctgcctggtgctcggccggcgcaaggacccgccgagggaccggacaaggacgctcgtcaacgctctgcgcaaggccggggtggccgtggaggcgaggctcgacggcgctgggtaccacgcgatggagctgttcaaggccaactgcgccgcggagttcaccgcgcaggtggccgacttcgttcgccgccactcctctgccgacaccggcgccagcgccagcgccggcgacgtggttggtatgagcaagctgtga

SEQ ID NO: 10044 - protein, 331 aa, Sorghum bicolor
  misc_feature: Ceres ANNOT ID no. 6108950
  misc_feature (81)..(291): Pfam Id: Abhydrolase_3 Pfam Desc: alpha/beta hydrolase fold
  misc_feature (1)..(308): NCBI GI: 82697939 NCBI Desc: cxe carboxylesterase [malus pumila]
  misc_feature (5)..(290): NCBI GI: 82697959 NCBI Desc: cxe carboxylesterase [actinidia arguta]
  misc_feature (5)..(308): NCBI GI: 82697957 NCBI Desc: cxe carboxylesterase [actinidia eriantha]
  misc_feature (1)..(231): NCBI GI: 140066193 NCBI Desc: esterase/lipase/thioesterase [medicago truncatula]
  misc_feature (1)..(308): NCBI GI: 140066194 NCBI Desc: esterase/lipase/thioesterase [medicago truncatula]
MDPYKYLKIRFNPDGSLCRYGEAPLLPAAPAGEPVTVEDDQGARRIAVHSNDVPLNDATGTGLRLFVPSVSGGHHDRLPLIVYFHGGGYVLFRAASEPFHNTCTALAAAGPAVVASVDYRLAPEHRLPAAFEDAADAVLWARPHAAAGRPVFVMGSHNGASIAFRAALAAADAGVELRGVILNQPHLGGAERSPAEAASVDDRVLPLAANHLLWELALPVGADRDHEYCNPEAMLARVGAARLRRLPPCLVLGRRKDPPRDRTRTLVNALRKAGVAVEARLDGAGYHAMELFKANCAAEFTAQVADFVRRHSSADTGASASAGDVVGMSKL

SEQ ID NO: 10045 - DNA, 1617 bp, Sorghum bicolor
  misc_feature: Ceres ANNOT ID no. 6108952
  misc_feature: Encodes the peptide sequence at SEQ ID NO 10046
atgggcggcggcataggcaggcctcgcgccaccacggcgagcctcgcgcccgccgacctggtcctgaaggcggcgtgcgagcgttgcggtgccgcgtcggagctctacctgacgtcgtgccggcacaccaccctctgctccgactgcggcaagaccttggcgcgcgcccgcgggcgctgcaccgtgtgcaacgcccccgttaccaggctcatccgggagttcgatgtccgggtggatacctccgcggagaaggagaagacccactccatcggcaggttcaccaccggcttgccgcccttctccaaagagaggagcacagaaaacaggtggactcttcgcaaggatgttccccaaggacggcagcttactgggaatatgcgggacagacactacagcaagagaccgtggattttggaggatgagacgggcgaacatcagtatcagggccaaactgaggatccgcctgccacatactattcactgacactgaaaggcaatgacatgattgctgttcaagttggtccctggtataacttcagtaaaattgcacagtacaaacagctgaccttggaagaagctgaagagaaaatgaatagaaggagaagtagtgcatctgggtatgaacggtggatgatgaaggcagctacaaatggagctgctgcctttagttcaggtgtgaacaggcttgatgtaaatagaggggcaacaaatggtgttcaccccaagaaaggagataggaatgagaatggaagtcaatctgacaaagttgacgacgaagaagggggcgctgcaaggaaaaacaggcttgggcttacaatgaagggcatggacgaggatgacgaggaaggtggaaaggacatagactttgatttggatgatgaaattgagaaaggtgacgattgggagcacgaagagaccttcactgatgatgatgaggctgtggatgttgatatagaggaaagacctgatttagctgatcctgaggctcctcctcctgaaattaaacaggatgacaacgagaatgaactaggcggcagtgacaacttgagcaagtctggtcaggagctaaaaaagctgcttcgccgagctgctggggaaaatgagtctgacgttgacgacaaaagcacagatgaagatgacctaccatcgccagaacttgctccgaaacaacttgtacccaaaagtgaaccagtggatagcaaccctgctaaaccaacaccatcagtgcacactcagagcgccacacctacatccaaatccactcaaaagaggaaatcagggggtggtgatgcaaatacttctaatggggccacctccaaaaagataaagatagagcctgaaaccagaacattggttgtcaaggatgagaagctgtcttctttggaaccaatatcaaaatcatctctttcagaaagaagagaatcctcacccattacagaggaggaagtcagggcagtacttcttgcaattcaacccaccacatgccaagatctggtgtcgaggttcaagcctcgtctaataactcgagaggacaagaaaacatttacagacattgtgaggaaaatatctcacaaggattgctttggctatgtcgttcttcggaaggaacaaaagtga

SEQ ID NO: 10046 - protein, 538 aa, Sorghum bicolor
  misc_feature: Ceres ANNOT ID no. 6108952
  misc_feature (33)..(535): Pfam Id: TFIIF_alpha Pfam Desc: Transcription initiation factor IIF, alpha subunit (TFIIF-alpha)
  misc_feature (19)..(523): NCBI GI: 87241158 NCBI Desc: transcription initiation factor iif, alpha subunit [medicago truncatula]
  misc_feature (20)..(538): NCBI GI: 39545900 NCBI Desc: mutant tfiif-alpha [arabidopsis thaliana]
  misc_feature (20)..(538): NCBI GI: 42566724 NCBI Desc: transcription initiation factor iif alpha subunit (tfiif-alpha) family protein [arabidopsis thaliana]
  misc_feature (19)..(510): NCBI GI: 87241154 NCBI Desc: transcription factor iif, rap30/rap74, interaction [medicago truncatula]
  misc_feature (134)..(523): NCBI GI: 59857797 NCBI Desc: general transcription factor iif, polypeptide 1, 74kda [bos taurus]
MGGGIGRPRATTASLAPADLVLKAACERCGAASELYLTSCRHTTLCSDCGKTLARARGRCTVCNAPVTRLIREFDVRVDTSAEKEKTHSIGRFTTGLPPFSKERSTENRWTLRKDVPQGRQLTGNMRDRHYSKRPWILEDETGEHQYQGQTEDPPATYYSLTLKGNDMIAVQVGPWYNFSKIAQYKQLTLEEAEEKMNRRRSSASGYERWMMKAATNGAAAFSSGVNRLDVNRGATNGVHPKKGDRNENGSQSDKVDDEEGGAARKNRLGLTMKGMDEDDEEGGKDIDFDLDDEIEKGDDWEHEETFTDDDEAVDVDIEERPDLADPEAPPPEIKQDDNENELGGSDNLSKSGQELKKLLRRAAGENESDVDDKSTDEDDLPSPELAPKQLVPKSEPVDSNPAKPTPSVHTQSATPTSKSTQKRKSGGGDANTSNGATSKKIKIEPETRTLVVKDEKLSSLEPISKSSLSERRESSPITEEEVRAVLLAIQPTTCQDLVSRFKPRLITREDKKTFTDIVRKISHKDCFGYVVLRKEQK

SEQ ID NO: 10047 - DNA, 1536 bp, Sorghum bicolor
  misc_feature: Ceres ANNOT ID no. 6108954
  misc_feature: Encodes the peptide sequence at SEQ ID NO 10048
atggggttcatatcgggagtcataatggggatgatcgtcggcgtcgccctgatcgcgggctgggcgcgcgccatggctcgccgcgccgccaaacgcagcaacaaggctgcggatgtcagtgcactaggatctctcaaccgtgaagacgtgaagaaaatatgtggagaaaatgttccccaatggatatcatttccagaatatgagcaggtcaaatggctcaacaaacaattgagcaagctttggccctttgtggaagaggcagcaaccatggtcatcagggattctgtcgaacctatactggatgattatcgaccaccagggatatcctcactgaagttcagcagactctcccttgggactgttccaccgaaaatagaaggcattcggattcagagttttaagaaagggcagattacaatggacatggacttccggtggggtggggatccaaatattattcttgcagtcgaaacacttgttgcttcgcttcccattcagtttaagaaccttcaagtgtacaccatcatccgtgttgtcttccaattgtcggacgagataccatgcatatctgctgttgtcgttgctcttatggcagagccaaaaccgagaatcgactacatactcaaagccgtgggaggaagcctgaccgcagtgcctggcctttcagacatgattgacgatacagtggcgtcagtgatcactgacatgctccaatggccacacagaatcgttgttccactgggtggagtcgacgttgacgtcagtgatcttgagctgaagccacacgggaagctcacggtcactgtggtccgcgcggaatccctcaagaacaaggaactcatcggcaaatccgacccctacgtggtcctgttcatacgcccaatgttcaaggagaagaccagcgtcattgacgacaacctcaaccctcattggaacgaaacgttccatctgatcgcggaggacaaggagacgcagtccctagttcttgaggtgttcgatgaggacaacatgaagcaagacaagaggcttggcatcgcaaagctgccccttagcgacctggagatggagaccgtgcaggaggtgaacctgcagctgctgtcgtcgctggacacgaccaaggtcaaggacaagaaggacaggggcatgctcagcatcaaggtggtgtaccaccagttcaccaacgcagaggcgcgggaggccctggagctggagaagcagaccgtggaggagcggcggaaggtgaagagcgagacggcggccgtcagcggcgccgcggacggggcaagcagcggcacggcgtccacggtcacccacgtggccggcacgggcgtcgcggcggccggcacgggtgactcccgtgccggctccagcggtgggatgggcatcggcgctgtgggctccggcattggcgcgttcggcagtggactccataaggccggcaagtcagccggcaagttcgtcggccggactgtcacgggacccttcagcagcgctaggcgcagcgccagcaacgtccccaacgtcgttgacgagtga

SEQ ID NO: 10048 - protein, 511 aa, Sorghum bicolor
  misc_feature: Ceres ANNOT ID no. 6108954
  misc_feature (265)..(347): Pfam Id: C2 Pfam Desc: C2 domain
  misc_feature (18)..(511): NCBI GI: 1769895 NCBI Desc: calb protein [arabidopsis thaliana]
  misc_feature (1)..(511): NCBI GI: 2789434 NCBI Desc: clb1 [lycopersicon esculentum]
  misc_feature (1)..(396): NCBI GI: 38344897 NCBI Desc: osjnba0033g05.21 [oryza sativa (japonica cultivar-group)]
  misc_feature (1)..(389): NCBI GI: 117557355 NCBI Desc: ntermtm-c2type2.2 protein [arabidopsis thaliana]
  misc_feature (1)..(385): NCBI GI: 9795162 NCBI Desc: clb1-like protein [arabidopsis thaliana]
MGFISGVIMGMIVGVALIAGWARAMARRAAKRSNKAADVSALGSLNREDVKKICGENVPQWISFPEYEQVKWLNKQLSKLWPFVEEAATMVIRDSVEPILDDYRPPGISSLKFSRLSLGTVPPKIEGIRIQSFKKGQITMDMDFRWGGDPNIILAVETLVASLPIQFKNLQVYTIIRVVFQLSDEIPCISAVVVALMAEPKPRIDYILKAVGGSLTAVPGLSDMIDDTVASVITDMLQWPHRIVVPLGGVDVDVSDLELKPHGKLTVTVVRAESLKNKELIGKSDPYVVLFIRPMFKEKTSVIDDNLNPHWNETFHLIAEDKETQSLVLEVFDEDNMKQDKRLGIAKLPLSDLEMETVQEVNLQLLSSLDTTKVKDKKDRGMLSIKVVYHQFTNAEAREALELEKQTVEERRKVKSETAAVSGAADGASSGTASTVTHVAGTGVAAAGTGDSRAGSSGGMGIGAVGSGIGAFGSGLHKAGKSAGKFVGRTVTGPFSSARRSASNVPNVVDE

SEQ ID NO: 10049 - DNA, 2469 bp, Sorghum bicolor
  misc_feature: Ceres ANNOT ID no. 6108955
  misc_feature: Encodes the peptide sequence at SEQ ID NO 10050
atggcgcgtggtggcggaggcggctgctgcccgcagatggatctgatgcggtcggaggcgatgcagctggtgcaggtcatcatacctgctgagtccgcgcatctcaccgtctcctacctcggcgacctcggcctcctccagttcaaagaccttaatgcagagaagagcccatttcaacgaacatatgctgcccagatcaaaaggtgtagcgaaatggctcgtaaattgaggttttttaaggagcagatgtcaaaagctgacataacaacctctcctacacaactaaatgaaactcatctggattttgatgacttggagataaagcttggagaactggaagctgagctaactgaagttaatgcaaacaatgagaagttgcagaggacctacaatgagctattagagtaccatactgttctccaaaaggctggtgattttttctattcagctcaaagaactgctgcagcacaacaaagggaaatggaggcaaaccaatctggtcaaacttcactggagagccctctgttggaacaggagatgtcaaatgatccatcaaaacaagtgaagcttggctcattgagtggccttgttccaaaggaaaaggcaatggcttttgaaaggatcttattccgtgccacaaggggtaatattttccttaggcaagagcctgttgatgagcccgtcactgatccagtttctggggagaaggtaacgaagaatgcatttgttatattctactctggagagagggcaaaaaccaaaattctgaagatatgtgatgccttcaatgcaaaccgttacccgtttccagaagatgttagcaaacaactccatgctgttcaggaggtatctgggaagatctcagagttgaaggcaacaattgacatgggtttagctcatcgtgacagtatactaaaaaatattgcttctgattttgaacagtggaaccatctggcgaagaaggaaaaagcaatttatcacaccttgaacatgctgagcgttgatgttacgaagaaatgcctagttgctgagggctggagtccagtttttgcaagcgttcagattcaagatgctcttcagcgtgctactgttgatagcaaatcccaagttggatcaatatttcaagttctcaacacaaaagaatctcctccaacatatttccagacaaataaatttactacagcgttccaggaaattgttgatgcgtatggtgtggccaaatatcaagaagcaaatcctggagtatttaccattgtgactttccctttcttatttgctgtcatgtttggtgattggggccatggaatttgcctgttacttgcaacactttatctgataatccgggagaagaaactagcttcacagaaacttggagacataatggagatgatgtttggtgggcgttatgtaattatgatgatggcagttttttcaatctacacaggattaatatacaatgaatttttctctgttccatttgagctttttggtaaatctgcctatgaatgccgtgatccttcttgtagtgatgctactactgatggactaattaaggtcagagatgcatacccttttggtgtggaccctgtctggcatggtagccgcagcgagctgccgtttctcaattcactgaagatgaagatgtcaattcttcttggagttgcacaaatgaaccttgggattgtgattagttacttcaatgcaaaatttttcaggaacagtcttaatgtgtggtaccagttcattccccagctgatcttcttgaacagcttatttggttacctgtccttgctcattattattaagtggtgcacggggtcaaaagcagatctataccatgttatgatctacatgttccttagcccaacagatgagcttggtgagaaccagttgtttagtggccagaagacagtgcagcttgttctacttctgcttgctttggtgtctgtaccttggatgttgattccaaaacctcttctattgaagaagcaacatcagcaaaggcatcaaggtcaccagtacgctatgcttcagggcactgatgaatcagtgggagcagagttgggggaacatcatgaggacgcacatgaccatgaggagtttgagttcagtgaagtttttgttcaccaactgattcacacgatcgaatttgttcttggtgcagtctccaacacagcttcataccttcgtctttgggctcttagtcttgcacactccgagttgtccactgtattctatgataaagtactactaacggcattggggcttaacaatatttttgcccttattatcggtggcattgtctttgtctttgccacggttggtgtcttgcttgttatggagaccctgagtgcattccttcacgcgctgaggcttcactgggtggagttccagaacaagttctatgaaggtgatggttacaagttcgccccattctccttcgcactgattcgtgaggaggaagattga

SEQ ID NO: 10050 - protein, 822 aa, Sorghum bicolor
  misc_feature: Ceres ANNOT ID no. 6108955
  misc_feature (37)..(815): Pfam Id: V_ATPase_I Pfam Desc: V-type ATPase 116kDa subunit family
  misc_feature (2)..(822): NCBI GI: 21700881 NCBI Desc: at2g21410/f3k23.17 [arabidopsis thaliana]
  misc_feature (6)..(822): NCBI GI: 92886517 NCBI Desc: v-type atpase, 116 kda subunit [medicago truncatula]
  misc_feature (6)..(822): NCBI GI: 33945876 NCBI Desc: vacuolar proton-atpase subunit-like protein [lotus corniculatus var. japonicus]
  misc_feature (4)..(822): NCBI GI: 115440877 NCBI Desc: os01g0834200 [oryza sativa (japonica cultivar-group)]
  misc_feature (81)..(822): NCBI GI: 92873071 NCBI Desc: v-type atpase, 116 kda subunit [medicago truncatula]
MARGGGGGCCPQMDLMRSEAMQLVQVIIPAESAHLTVSYLGDLGLLQFKDLNAEKSPFQRTYAAQIKRCSEMARKLRFFKEQMSKADITTSPTQLNETHLDFDDLEIKLGELEAELTEVNANNEKLQRTYNELLEYHTVLQKAGDFFYSAQRTAAAQQREMEANQSGQTSLESPLLEQEMSNDPSKQVKLGSLSGLVPKEKAMAFERILFRATRGNIFLRQEPVDEPVTDPVSGEKVTKNAFVIFYSGERAKTKILKICDAFNANRYPFPEDVSKQLHAVQEVSGKISELKATIDMGLAHRDSILKNIASDFEQWNHLAKKEKAIYHTLNMLSVDVTKKCLVAEGWSPVFASVQIQDALQRATVDSKSQVGSIFQVLNTKESPPTYFQTNKFTTAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFELFGKSAYECRDPSCSDATTDGLIKVRDAYPFGVDPVWHGSRSELPFLNSLKMKMSILLGVAQMNLGIVISYFNAKFFRNSLNVWYQFIPQLIFLNSLFGYLSLLIIIKWCTGSKADLYHVMIYMFLSPTDELGENQLFSGQKTVQLVLLLLALVSVPWMLIPKPLLLKKQHQQRHQGHQYAMLQGTDESVGAELGEHHEDAHDHEEFEFSEVFVHQLIHTIEFVLGAVSNTASYLRLWALSLAHSELSTVFYDKVLLTALGLNNIFALIIGGIVFVFATVGVLLVMETLSAFLHALRLHWVEFQNKFYEGDGYKFAPFSFALIREEED

SEQ ID NO: 10051 - DNA, 1005 bp, Sorghum bicolor
  misc_feature: Ceres ANNOT ID no. 6108958
  misc_feature: Encodes the peptide sequence at SEQ ID NO 10052
atgatgggcgggttcctctccagggtcctcctgttggcttttggctatgcctatcctgcctatgaatgctacaagactgttgaactgaacaaaccagagattgagcagctcatattttggtgtcagtattggattttagttgccctgttgacagttttggagagatttggagattttacaatatcatggctaccgttttactcggaagcaaagctgatgttctttgtatacttgtggtaccctaagacaaagggaactacatatgtttatgggactttctttaagccatatatttctcagcatgagaatgaaatcgaccggaatctccttgagctgagagctcgagccaccgatatggttgtcatttatttccagaaggctgcttcggtaggacaaaatactttctttgacgttttaaaatatgttgctgcccagtcaccttctcagaaatcaaggcagcgccctcagcaggaatcacagcaaccacaacagcagcaaccacaggtgcaggtgcaggtgcagctgcagcagccgcaacctcaaaaacaagcagcacctgttatgcgcagagcagcatctattgctgctcggcaagcagcaatggcacagcaatctcaggagactaaacccgttccttcatcgcccaagatcaagcgtcaaacatcagggaaatctggttcagtggcatccacaaagcctgcagcagctgcatccacaccaaaacctgccggtagcccaaagaaaggtgaggtcaaacctgctgctgatccagttcaaactccagccacaagtgccaattcaccgaagtccgagcctaatgccccaccactccctgaagccgaaggagtagacaaaatggccattgatgaggtcagtggtgatgctgcagagggcgcagaagagcttgaccctgcgctcgaggagacgccaatggaggagacgatccgtgtgacgcgcgccaagctaaggaggcgcacagccactgaggatcctgctgggaattaa

SEQ ID NO: 10052 - protein, 334 aa, Sorghum bicolor
  misc_feature: Ceres ANNOT ID no. 6108958
  misc_feature (2)..(98): Pfam Id: TB2_DP1_HVA22 Pfam Desc: TB2/DP1, HVA22 family
  misc_feature (1)..(157): NCBI GI: 115451931 NCBI Desc: os03g0250200 [oryza sativa (japonica cultivar-group)]
  misc_feature (1)..(309): NCBI GI: 24111285 NCBI Desc: at1g19950/t20h2_25 [arabidopsis thaliana]
  misc_feature (1)..(275): NCBI GI: 18422223 NCBI Desc: abscisic acid-responsive hva22 family protein [arabidopsis thaliana]
  misc_feature (1)..(309): NCBI GI: 21553483 NCBI Desc: pathogenicity protein path531-like protein [arabidopsis thaliana]
  misc_feature (12)..(309): NCBI GI: 8779002 NCBI Desc: contains similarity to magnaporthe grisea pathogenicity protein (path531) from pyricularia grisea gbaf019630. [arabidopsis thaliana]
MMGGFLSRVLLLAFGYAYPAYECYKTVELNKPEIEQLIFWCQYWILVALLTVLERFGDFTISWLPFYSEAKLMFFVYLWYPKTKGTTYVYGTFFKPYISQHENEIDRNLLELRARATDMVVIYFQKAASVGQNTFFDVLKYVAAQSPSQKSRQRPQQESQQPQQQQPQVQVQVQLQQPQPQKQAAPVMRRAASIAARQAAMAQQSQETKPVPSSPKIKRQTSGKSGSVASTKPAAAASTPKPAGSPKKGEVKPAADPVQTPATSANSPKSEPNAPPLPEAEGVDKMAIDEVSGDAAEGAEELDPALEETPMEETIRVTRAKLRRRTATEDPAGN

SEQ ID NO: 10053 - DNA, 381 bp, Sorghum bicolor
  misc_feature: Ceres ANNOT ID no. 6108965
  misc_feature: Encodes the peptide sequence at SEQ ID NO 10054
atggcgtcggcggcagtttatggcggcctcaaggggaagcttggcgtagaggatgcccccgagctgcagctcaaccgcatccgcatcacactctcatccaagaacgtcaagaacttggagaaagtttgtgcggatttggtgaagggagccaaggacaagcaactgagggttaagggacctgtcaggattcctactaaggttctccacatcaccacccgcaagtccccttgcggtgaaggaacaaacacatgggatcggtttgagttccgcatccacaagagggtgattgacctaatcagttcccctgatgtggtgaagcagatcacctccatcaccatcgagcccggcgttgaggtcgaggtgaccattgcagacgtgtaa

SEQ ID NO: 10054 - protein, 126 aa, Sorghum bicolor
  misc_feature: Ceres ANNOT ID no. 6108965
  misc_feature (26)..(121): Pfam Id: Ribosomal_S10 Pfam Desc: Ribosomal protein S10p/S20e
  misc_feature (1)..(126): NCBI GI: 54208698 NCBI Desc: ribosomal protein s10p/s20e [zea mays]
  misc_feature (7)..(125): NCBI GI: 124360667 NCBI Desc: ribosomal protein s10, eukaryotic and archaeal form [medicago truncatula]
  misc_feature (1)..(125): NCBI GI: 109940157 NCBI Desc: 40s ribosomal protein s20
  misc_feature (12)..(125): NCBI GI: 391875 NCBI Desc: 40s subunit ribosomal protein [oryza sativa (japonica cultivar-group)]
  misc_feature (12)..(125): NCBI GI: 23198348 NCBI Desc: 40s ribosomal protein s20 [arabidopsis thaliana]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated phosphate use efficiency
  misc_feature: GREAT-hit functional homolog of the protein sequence given in SEQ ID NO 12983
  misc_feature: GREAT-hit functional homolog of the protein sequence given in SEQ ID NO 13007
  misc_feature: Useful for making plants with modulated biomass
  misc_feature: Useful for making plants with modulated flowering time
  misc_feature: Functional homolog of the protein sequence given in SEQ ID NO 13007
  misc_feature: Useful for making plants with modulated phosphate use efficiency
  misc_feature: Functional homolog of the protein sequence given in SEQ ID NO 12983
MASAAVYGGLKGKLGVEDAPELQLNRIRITLSSKNVKNLEKVCADLVKGAKDKQLRVKGPVRIPTKVLHITTRKSPCGEGTNTWDRFEFRIHKRVIDLISSPDVVKQITSITIEPGVEVEVTIADV

SEQ ID NO: 10055 - DNA, 696 bp, Sorghum bicolor
  misc_feature: Ceres ANNOT ID no. 6108967
  misc_feature: Encodes the peptide sequence at SEQ ID NO 10056
atggctccaggactgcagctcttcactgacattgccgacgacggcacgccccgtctcaacgccgcctccggcgaggagctggtccgcgtggaccgcgccgtcgctgtcgcccttggcccccgctcaccggagtccccggggactctgttcatcaccaccaggaggatgatttggcttagcgaggcggagaagggcaagggctacgcggtgggcttcctcgacatcacgcttcacgccgtgtcgcgcgacctggaggcgtatccctcgccctgcatctacacacagattgaggcagcagaaggtacagatgaggaggctggtgaatcaaatcctgaagcaaatgaactagagctatctaaagtatctgaaatgcggctcatactagcagaccacagtcaatcttcagtggatgcactttttgatgtcttctgtcattgtgctgaactgaatcctgatcctaatgctgagcgcgacgaggagaatggttggttccatggtgaagatatgtctgatggtggctgggttcatgatgatgaggacatggttgatgaaaatgccccccagtttttcagtgccaatccgataggtcaaaatggtggatatgacctcactcgttcagtacttgagcttcaaatcgacgaccagcgttttgaggatgcagaggaggaacaggagagccatgaaaatggacattag

SEQ ID NO: 10056 - protein, 231 aa, Sorghum bicolor
  misc_feature: Ceres ANNOT ID no. 6108967
  misc_feature (44)..(120): Pfam Id: ICln_channel Pfam Desc: Nucleotide-sensitive chloride conductance regulator (ICln)
  misc_feature (25)..(168): NCBI GI: 47124891 NCBI Desc: mgc81186 protein [xenopus laevis]
  misc_feature (24)..(168): NCBI GI: 82524831 NCBI Desc: loc496644 [xenopus tropicalis]
  misc_feature (47)..(168): NCBI GI: 50979100 NCBI Desc: chloride channel [canis familiaris]
  misc_feature (47)..(168): NCBI GI: 71042566 NCBI Desc: chain a, solution structure of icln, a multifunctional protein involved in regulatory mechanisms as different as cell volume regulation and rna splicing
  misc_feature (29)..(160): NCBI GI: 1708394 NCBI Desc: methylosome subunit picln (chloride conductance regulatory protein icln) (i(cln))
MAPGLQLFTDIADDGTPRLNAASGEELVRVDRAVAVALGPRSPESPGTLFITTRRMIWLSEAEKGKGYAVGFLDITLHAVSRDLEAYPSPCIYTQIEAAEGTDEEAGESNPEANELELSKVSEMRLILADHSQSSVDALFDVFCHCAELNPDPNAERDEENGWFHGEDMSDGGWVHDDEDMVDENAPQFFSANPIGQNGGYDLTRSVLELQIDDQRFEDAEEEQESHENGH

SEQ ID NO: 10057 - DNA, 684 bp, Sorghum bicolor
  misc_feature: Ceres ANNOT ID no. 6108969
  misc_feature: Encodes the peptide sequence at SEQ ID NO 10058
atggcgaccgccatgcggggcggcagcctcctgcggtttggtttccgccacgtttcttccatccttttccagccccctccatgccctgccccgagcctgggcctgaacctggccgttggccggaccgggctggtacgcctccagtgctcggcggccggggccggcgacgacgggggcaagaaggtgtcggctaggctggctctgacgcagcaggtgctgcgggacgccgaggagcgcgccgcgtcggcgggctccgaccctgcccccaagatcaccctggatcatgttactgttaattttgcaagaagtggtggtcctggtggtcagaatgttaataaagttaacacaaaggttgacatgcgattcaatgttaaggaagctcactggcttggggagagaatcaaggaacgaatattgcaagcggagaagaataggataaataaagatggagagcttgttatatcttctacaaaaactagaacacagaagggcaacattgaagatgcattgcagaaaatacaggcaatcattgatgctgcatcatatgttcctccacccccaacagaagaccaaaagaaaaagattgaaaaaattgctgctgccgctgaaaggaagagacttcagaataagaaggtggtttcacagaagaaggaatttagacgtaacagaactagctgggattga

SEQ ID NO: 10058 - protein, 227 aa, Sorghum bicolor
  misc_feature: Ceres ANNOT ID no. 6108969
  misc_feature (82)..(192): Pfam Id: RF-1 Pfam Desc: Peptidyl-tRNA hydrolase domain
  misc_feature (94)..(162): NCBI GI: 6630453 NCBI Desc: f23n19.20 [arabidopsis thaliana]
  misc_feature (44)..(227): NCBI GI: 116806624 NCBI Desc: cg6094 [drosophila melanogaster]
  misc_feature (44)..(227): NCBI GI: 116806636 NCBI Desc: cg6094 [drosophila melanogaster]
  misc_feature (44)..(227): NCBI GI: 19921098 NCBI Desc: cg6094-pa [drosophila melanogaster]
  misc_feature (44)..(227): NCBI GI: 116806620 NCBI Desc: cg6094 [drosophila melanogaster]
MATAMRGGSLLRFGFRHVSSILFQPPPCPAPSLGLNLAVGRTGLVRLQCSAAGAGDDGGKKVSARLALTQQVLRDAEERAASAGSDPAPKITLDHVTVNFARSGGPGGQNVNKVNTKVDMRFNVKEAHWLGERIKERILQAEKNRINKDGELVISSTKTRTQKGNIEDALQKIQAIIDAASYVPPPPTEDQKKKIEKIAAAAERKRLQNKKVVSQKKEFRRNRTSWD

SEQ ID NO: 10059 - DNA, 2667 bp, Sorghum bicolor
  misc_feature: Ceres ANNOT ID no. 6108975
  misc_feature: Encodes the peptide sequence at SEQ ID NO 10060
atgatgtccttcctttcgaaggacacacatgcacaaacaagacttaactggccatggagaagccaatcgccgttatcagcgcagctgcttgttgatatcccacctgaaatagagttatctgattaccggagattgccaagttctggaagtgagagcccatctggacttctccatggcgaaggcatcaaggaagaacatatccctgatttggacattttctttgaaaggctttacgaatatttctgtgcaaaagggctcaggtgtatcattaccaaatggataatagaggtccttaatgtactttttatggtatgctgtatcgggttctttttcttatttgttgattgggatactcttattcatttgaaatgcggtgtggaggcactagaatctggggagaaaccatgtgatctgatgaaggtcattaagcatgacccattagtccccttcacactgccaaaaatgataactgttggatcaatggtcataatgacagcttatgggcttaccaacttcctcaagttctttgtacagttaagaagtacactcaatgttcgtcagttttattatgacagacttaaggtgaatgatcttgagattcagactatatcatggcccaaaataattgagaaggttgtcctactccagaaatctcaaaaactttgtgttgttagggatctctcagagcatgatattatcatgagaatcatgaggaaagaaaattatttgatagggatggtcaataaaggcattctttcatttccaattcattcttgtgtccctggggctggcacacctgttggatcacatgagcatggcagaagaaactatctgatacttccgaaggccctcgaatggaccttaaattggtgcatctttcaaagtatgtttgatagtaaattttgtgtaaggaaagagtttttgacaagcccagatgtgttgaaaaagcggcttatatttgttggcattgcaatggttatcctatcaccctgccttgtgatatttccattggtttacgtcattctaaggcatgctgaagaaatttataatcaccccagtacagcatcatctagacgatggtcaaacttatcaaggtggatctttagggagtataacgaggttgatcacttcttcagacacagaatgaacaacagtgctgttcattctttaaattacttgaagcaatttccaaccccactggtttccatcatggctaaatttgtatcttttgtttctggtggcttggctggtgctctaataatcattggatttgtgggtgaatctattcttgaaggacatatttttggaagaaatcttctctggtacactattgtttttggaacaatagcagctataagtcggaaagtagtggctgatgagcttcaagttattgacccagaaggggccatgtgcctcgctgttcaccaaacacattacatgccaaagcggtggcgtggtaaagagaacagcgaacttgtccgaagagaatttgagacattatttcagtacactataattatgctacttgaagagatggcctccattttcatcactccttacttgcttatttttgaggtaccaaagcgtgttgatgacattctgcgcttcatctcagacttcacaatttatgtagacggagtgggagatgtatgcagtctaagcatgtttgacttcaaaagacatggaaatagaaactatgggtcgccgttcaatggtcttaaaggtctcaggagctcccaagggaagatggagaaatcattcttaagttttcagagtgtctatccatcatgggagccaaatgctgatggcaaacagttcttatctaacctccaaaagttcaaagaaaagcaaatacgtcaacaagcgcttgcacaataccaagcaatggaagcttcaggctttgtggcaggcactagaggtcaaagggatgataccttccaacaactcaatagtgatattcatggccatgctgagaccactttgcctcctgtttataacttgagccccttgggattgctcgacacggaccaaagaactcatccatatatcctggactggtattacgtgtgtcatccaccacaccaagatagagctgaggccccccaatttgaacaagcattccctgagactggtgtgatcacaagtccaccagcaagggaaacgtctgaaattgaagaagttggggactgggactacgagttgtacgaaagggttcaaagtcatctgggggcatccacatcaagtgctttgttccggaacactccagtgaagcaccatggtacagaagataagacaaacagcaattggtgggcacatgcccctgcatatccttctggtccccagggcagcttcatcgagcctccggaatttggaaatcgatacatgacagatcctcattccagtaatcacagtggcgatacatcagagggaagcatggaggatctagagcagagcaatcgcagaagcagcagcgtgtggaggagcccgcaagctttgtccaagacaagatatatggacgactctgacattgaggaagggctaagcctgcattttgctgatgtccatcagaaggatgaagatgatagacacctggtcatggatcatcaagatcccgcgccagctggtcttccagtaagaataatacctagaagcagtgaccctgtgtaa

SEQ ID NO: 10060 - protein, 888 aa, Sorghum bicolor
  misc_feature: Ceres ANNOT ID no. 6108975
  misc_feature (197)..(580): Pfam Id: APG9 Pfam Desc: Autophagy protein Apg9
  misc_feature (1)..(888): NCBI GI: 74831799 NCBI Desc: autophagy protein 9 [sorghum bicolor]
  misc_feature (1)..(888): NCBI GI: 74831819 NCBI Desc: autophagy protein 9 [zea mays]
  misc_feature (1)..(888): NCBI GI: 74831802 NCBI Desc: autophagy protein 9 [saccharum officinarum]
  misc_feature (1)..(888): NCBI GI: 74831778 NCBI Desc: autophagy protein 9 [hordeum vulgare]
  misc_feature (1)..(888): NCBI GI: 74831808 NCBI Desc: autophagy protein 9 [triticum aestivum]
MMSFLSKDTHAQTRLNWPWRSQSPLSAQLLVDIPPEIELSDYRRLPSSGSESPSGLLHGEGIKEEHIPDLDIFFERLYEYFCAKGLRCIITKWIIEVLNVLFMVCCIGFFFLFVDWDTLIHLKCGVEALESGEKPCDLMKVIKHDPLVPFTLPKMITVGSMVIMTAYGLTNFLKFFVQLRSTLNVRQFYYDRLKVNDLEIQTISWPKIIEKVVLLQKSQKLCVVRDLSEHDIIMRIMRKENYLIGMVNKGILSFPIHSCVPGAGTPVGSHEHGRRNYLILPKALEWTLNWCIFQSMFDSKFCVRKEFLTSPDVLKKRLIFVGIAMVILSPCLVIFPLVYVILRHAEEIYNHPSTASSRRWSNLSRWIFREYNEVDHFFRHRMNNSAVHSLNYLKQFPTPLVSIMAKFVSFVSGGLAGALIIIGFVGESILEGHIFGRNLLWYTIVFGTIAAISRKVVADELQVIDPEGAMCLAVHQTHYMPKRWRGKENSELVRREFETLFQYTIIMLLEEMASIFITPYLLIFEVPKRVDDILRFISDFTIYVDGVGDVCSLSMFDFKRHGNRNYGSPFNGLKGLRSSQGKMEKSFLSFQSVYPSWEPNADGKQFLSNLQKFKEKQIRQQALAQYQAMEASGFVAGTRGQRDDTFQQLNSDIHGHAETTLPPVYNLSPLGLLDTDQRTHPYILDWYYVCHPPHQDRAEAPQFEQAFPETGVITSPPARETSEIEEVGDWDYELYERVQSHLGASTSSALFRNTPVKHHGTEDKTNSNWWAHAPAYPSGPQGSFIEPPEFGNRYMTDPHSSNHSGDTSEGSMEDLEQSNRRSSSVWRSPQALSKTRYMDDSDIEEGLSLHFADVHQKDEDDRHLVMDHQDPAPAGLPVRIIPRSSDPV

SEQ ID NO: 10061 - DNA, 5385 bp, Sorghum bicolor
  misc_feature: Ceres ANNOT ID no. 6108981
  misc_feature: Encodes the peptide sequence at SEQ ID NO 10062
atggcctccgcggtcgcggcgccgccgccgtccccgccggagtccgacccgcgcctcgtcgaggtcttcacgcccttcctcgagaagctcataaaaaatgcctcgtggcgcaacaaggcgcactccaagctctcgcacaccgccaagtccatcctcgaccgcctccagaagcccccgccgccgcccgcagccgaggcgcaggcgccgtccacgccgacctccgccccctcgacgccgacctcctcgtccgcgcagcctggtccgttgcgcagtctgtcgctcgcggactcggagctgctcctcgcccctgtgacctccgcactcggctcgggcagcgccaagctcgccgaggccgcgctggagctccttcacaggctgatcgcacactcctacatccatggcgaggccgacccgtctgcggacccctcagcgcagcttgttgcctcactcctggatgccgcctgcaatgcgcttggcctcgatgacgagcacattgagctccttctcctcaagactctcctctcggcggtcacctctacgtctgtacgcctccacggtgactgccttctgcgcgcagtgcgcgcgtgctatgatatgtacctcgggagccgcagtgccgtcaatcaggccactgccaaggcttcgcttgtgcagatgctggtgattgtgttccgccgaatggaagctgactcgtcgaccgtgcctgtacaacccatagtcgtggctgacgtgattgagctacctgaagctggtccgggctcgccaactgctgaccccaatgctgtacagggattcatttcgaagatcattggcgactttgatggtgcactcacacctctggcacgaacaacttcatcagcaggggcaggagccactgttgcccatgatggtgcgtttgagacaacagcagcggcagaggaaggggcaaacccagcagatttgctcgattcaacagataaggacatgcttgatgccaagtactgggagatcagcatgtacaaaacagctattgagggtcgtaaggacgagcttggcgtcgagggggcagtggtaggcaccttggacgatgatgctgatgtgagaattgggaataagttgcggagggatgctttcttagttttccgggctttgtgtaagctttccatgaagacaccacccaaggatgcaccagcagatcccatagtgatgcggggaaagatccttgctcttgagcttctcaagatcttgcttgagaatgctggggctgtgttccggaccagtgagaggtttctcggtgctatcaagcagtatctatgcctgtcacttttaaagaactgtgcctcatcacacatgattgtttttcagctatcttgttctatttttattagtttagtggcaagattcagaccaggattgaaggcagagattggtgtattctttcccatgatcattttgagagtgttggaaaatattgctcaaccaaattatcaggcaaagatgattgttctccgttttttggagaagctctgtggtgattctcaaatcctagttgatattttccttaattacgattgtgatgtccactcatcaaacatatttgagaggatggtgaatggtctactaaagactgctcaaggacctcctgctggtgtccctaccacattggtaccacctcaggataccacaatgaaaagtgaagcaatgaaatgcttagttgctattctgaggtccatgggagattggatgaataagcagctacggattccagatcctgcttctcctaatgtagaatcagagaagaatgacaatgatggtggcaatgagcttccccaggcagataacaatggggatgagtctagtgaagcatctgattcacattctgagctatcaaatggaatttcagaggctgcatctttggagcaacgtcgagcttacaagatagagcttcaggagggtatctctttgtttaaccggaagccaaagaaggggattgagttcctcgttaatgcaagcaaggtgggggagtcaccagaggagatagccgcattcctaaaaagtgcttctggcttgaacaagactatgataggtgattatttaggtgaaagggaagatttatcgctgaaagtcatgcatgcatatgtggactcgtttgattttcaaggactggagtttgatgaagcaattagagctttccttcaaggcttcaggttgcctggagaagctcaaaagattgatcggattatggaaaagtttgcagagcgttactgtaaatgtaatccaaaggccttttccagtgcagatacagcttatgtcctggcttattcagtcataatgcttaacactgatgcacataacccaatggtcaaaaataagatgtcaccagaagatttcattagaaacaatcgtggtatcgatgatgggaaagacctacctgaagaatttatgagatccttgtatgaaaggatttggaaaaaggagatcaagatgaaagaagatgaatttgttccacagcagcaacaatcaacaagttctaacaaaattcttgggttggataacattcttaacattgtcgtacgcaagcgaggttcatctatggagacaagtgatgacctcattaagcatatgcaggagcaatttaaagaaaaggcccgcatgtccgagtctatattttatccagccacagatgtagttgttttgaagttcatggttgaggtttgctgggctcctatgcttgcagcattcagtgttccacttgatcagagtgatgatgaaattgttgtatcccagtgccttgaaggatttcgctctgcaatccatgttactgcagccatgtcaatgaagactcaaagagatgcatttatcacttcacttgccaagtttacatcacttcactctgctgctgatattaagcagaaaaatgttgaagccattaaggcaattctattaattgcagatgaagatggaaattacttgcaagaagcatgggagcatatattgacatgtgtttctcgtttcgaaaatctacatcttgttggagagggagcacctccagatgccactttctttgcgctgcagcagccggaccttgataaatcaaaacaggctaagtcatcgattcttcctgttctgaaaaagaaggcccccaatgctacttcagcttctaaaagaggctcctatgacagtgctggtgtcggtggcaaagcttctggtgtggatcaaatgaataatgaggtgacaagcctcttggagcaagttgggatggctgaaatgaaccgtgtatttgtaagaagtcaaaaactcaacagcgagggtataattgattttgtgaaggctctctgtaaggtttcaatggaggaattacggtctgcttctgatccacgagtttttagtctgacaaagatagtcgagatagcgcattacaatatgaaccgcatcaggcttgtctggtcaagtatatggcatgtgttgtctgatttttttgtcactattggctgctcagaaaatctttccatcgcaatatttgctatggactccttgcgacagttatctatgaagttcttggagcgtgaggagctcgctaactacaatttccaaaatgaatttatgaagccttttgttgttgtaatgaggaagagccgagctgttgagatcagagaacttatcatcaggtgtgtatctcaaatggtattggcccgtgttagtcatgtgaagtcagggtggaagagtatgtttatggtctttgcgacagcgtcatacgatgatcacaaaaatattgtactgttggcctttgaaattatagaaaagattttgcgggagtactttccgtacattactgagactgagtcaacgacattcaatgattgtgtgaactgtcttattgcgtttactaacagcaggtttaacaaggatataagtcttaatgcaattggatttcttcgattctgcgcggcaaagttggccgaaggtgatattggatcctcaagattgaaggacaatccttcaaacagtaatccaccctcgcctcatttgactaatgatggaaagcaggaaggcacagtacttgttgacaaggaagaccatatacacttttggtttcctttactagcgggattatctgaacttacctttgacttaagaccggaaatcaggaaaagtgctttgcaagtgttatttgacacattaagaaaccatggccatcttttctctctgcctttatgggagaaggtgttcgattcagtgctttttccaatatttgattatgtgcgtcatgctattgatccatctggtagttctccacaaggacaaaatgtgggaaatgatcctgcagaacttgatcaagatgcttggttatacgagacatgcactttggcacttcagttggttgtagatctctttgttaagttctatgatacagttaatcctcttctaaagaaggttctgctgctcttgacaagtttcataaagcgtcctcatcagagtcttgctggtattggtattgctgcatttgttcgtttgatgagcagtgctggatctatgtttgttgatgaaaaatggctagaggttgtattgtcattgaaagaagctgccactgagacacttcctgatttcacttatgtttcatctggagcgtacctggaaaatgcaccaacagaaaatggagtctctgccgataatagagaggacgaatctcaaccactagcggatgacaatgaagaatcctctagatcaaggaatctatactttgcaattggtgatgccaaatgtcgagctgctgtacaactcctattgattcaggctgtgatggaggtatataacatgtacagagcacagttatcagcacagaacacagtaatactcttcgaagccttgcacactgttgccgcacatgctcacaaaataaacagtgatagtgatctgcgttccaagttgcaagagttgggctcgatgacgcaaatgcaggacccgccattgttgcgccttgagaacgagtcataccagctgtgcctcagtatccttcagaacatatttctggacatctctcctgatcatggaagcacagaggtggtggagagtcaccttattggcttgtgcaaggaggtccttgaggtatacttgagcacagcaaaaccttctcagctttccagtggcacacagccgctaggccattggcttatccctgttggttcatcgaagcgaagggaacttgcggcaagagcacctcttgttgtatcaaccctgcaagctattagcggactaggtgactcagctttcgagaagaaccttggccagttcttccccctcctctctgggctcataagctgcgagcatggctctagtgaagtacaggtggccctgagtgatatgttcagcacttgggttggcccactcgtgctccagtcctgctga

SEQ ID NO: 10062 - protein, 1794 aa, Sorghum bicolor
  misc_feature: Ceres ANNOT ID no. 6108981
  misc_feature (635)..(820): Pfam Id: Sec7 Pfam Desc: Sec7 domain
  misc_feature (1)..(1794): NCBI GI: 19879878 NCBI Desc: guanine nucleotide-exchange protein gep2 [oryza sativa]
  misc_feature (14)..(1671): NCBI GI: 7329696 NCBI Desc: guanine nucleotide exchange factor-like protein [arabidopsis thaliana]
  misc_feature (14)..(1554): NCBI GI: 8570447 NCBI Desc: contains similarity to a guanine nucleotide exchange factor from homo sapiens gbaf111162 and contains a sec7 pf01369 domain. [arabidopsis thaliana]
  misc_feature (359)..(1790): NCBI GI: 15233734 NCBI Desc: guanine nucleotide exchange family protein [arabidopsis thaliana]
  misc_feature (355)..(1668): NCBI GI: 42567412 NCBI Desc: guanine nucleotide exchange family protein [arabidopsis thaliana]
MASAVAAPPPSPPESDPRLVEVFTPFLEKLIKNASWRNKAHSKLSHTAKSILDRLQKPPPPPAAEAQAPSTPTSAPSTPTSSSAQPGPLRSLSLADSELLLAPVTSALGSGSAKLAEAALELLHRLIAHSYIHGEADPSADPSAQLVASLLDAACNALGLDDEHIELLLLKTLLSAVTSTSVRLHGDCLLRAVRACYDMYLGSRSAVNQATAKASLVQMLVIVFRRMEADSSTVPVQPIVVADVIELPEAGPGSPTADPNAVQGFISKIIGDFDGALTPLARTTSSAGAGATVAHDGAFETTAAAEEGANPADLLDSTDKDMLDAKYWEISMYKTAIEGRKDELGVEGAVVGTLDDDADVRIGNKLRRDAFLVFRALCKLSMKTPPKDAPADPIVMRGKILALELLKILLENAGAVFRTSERFLGAIKQYLCLSLLKNCASSHMIVFQLSCSIFISLVARFRPGLKAEIGVFFPMIILRVLENIAQPNYQAKMIVLRFLEKLCGDSQILVDIFLNYDCDVHSSNIFERMVNGLLKTAQGPPAGVPTTLVPPQDTTMKSEAMKCLVAILRSMGDWMNKQLRIPDPASPNVESEKNDNDGGNELPQADNNGDESSEASDSHSELSNGISEAASLEQRRAYKIELQEGISLFNRKPKKGIEFLVNASKVGESPEEIAAFLKSASGLNKTMIGDYLGEREDLSLKVMHAYVDSFDFQGLEFDEAIRAFLQGFRLPGEAQKIDRIMEKFAERYCKCNPKAFSSADTAYVLAYSVIMLNTDAHNPMVKNKMSPEDFIRNNRGIDDGKDLPEEFMRSLYERIWKKEIKMKEDEFVPQQQQSTSSNKILGLDNILNIVVRKRGSSMETSDDLIKHMQEQFKEKARMSESIFYPATDVVVLKFMVEVCWAPMLAAFSVPLDQSDDEIVVSQCLEGFRSAIHVTAAMSMKTQRDAFITSLAKFTSLHSAADIKQKNVEAIKAILLIADEDGNYLQEAWEHILTCVSRFENLHLVGEGAPPDATFFALQQPDLDKSKQAKSSILPVLKKKAPNATSASKRGSYDSAGVGGKASGVDQMNNEVTSLLEQVGMAEMNRVFVRSQKLNSEGIIDFVKALCKVSMEELRSASDPRVFSLTKIVEIAHYNMNRIRLVWSSIWHVLSDFFVTIGCSENLSIAIFAMDSLRQLSMKFLEREELANYNFQNEFMKPFVVVMRKSRAVEIRELIIRCVSQMVLARVSHVKSGWKSMFMVFATASYDDHKNIVLLAFEIIEKILREYFPYITETESTTFNDCVNCLIAFTNSRFNKDISLNAIGFLRFCAAKLAEGDIGSSRLKDNPSNSNPPSPHLTNDGKQEGTVLVDKEDHIHFWFPLLAGLSELTFDLRPEIRKSALQVLFDTLRNHGHLFSLPLWEKVFDSVLFPIFDYVRHAIDPSGSSPQGQNVGNDPAELDQDAWLYETCTLALQLVVDLFVKFYDTVNPLLKKVLLLLTSFIKRPHQSLAGIGIAAFVRLMSSAGSMFVDEKWLEVVLSLKEAATETLPDFTYVSSGAYLENAPTENGVSADNREDESQPLADDNEESSRSRNLYFAIGDAKCRAAVQLLLIQAVMEVYNMYRAQLSAQNTVILFEALHTVAAHAHKINSDSDLRSKLQELGSMTQMQDPPLLRLENESYQLCLSILQNIFLDISPDHGSTEVVESHLIGLCKEVLEVYLSTAKPSQLSSGTQPLGHWLIPVGSSKRRELAARAPLVVSTLQAISGLGDSAFEKNLGQFFPLLSGLISCEHGSSEVQVALSDMFSTWVGPLVLQSC

SEQ ID NO: 10063 - DNA, 1758 bp, Sorghum bicolor
  misc_feature: Ceres ANNOT ID no. 6108985
  misc_feature: Encodes the peptide sequence at SEQ ID NO 10064
atggcgcccccgtctccacctctgtccatgaagcccccgacgctgcccttctctcctcccaagaagccaccgccgatgccggtgtacaaggacctgcacttcaaccgcgacctctccgccaccaagaagctccaggccggagtggacctggtggcgcggttgctgggggtcaccctggggcccaaggggaggaacgtcgtgcttggcaacaagtatggccctcccaagattgtcaatgatggggagaccgtccttaaggagatcgaattggaagatccattagaaaatcttggagtgaagctggtccgacaggctggagcaaggaccaatgatattgcaggagatggttgtaccacatccataatccttgctcaaggcctcattgctgaaggaatgaaggttcttgcagctggaatcaacccagttcaggttgcacgtggcattgagaagactgctgctgctttggtgtctgaactcagactgatgtcgcgagagattgaagaccatgaaattgcacatgtggctgcaattagtgcgggaaatgattatgctgttggaaatatgatttatgatgcttttcaaagagtaggtagaaaaggaatggtgagaattgaaaatggaagaggcaccgagaacagtctggaggttgtggaaggaatgcaatttgaacgcggttacctctctccttactttgttaccaatcgtggtaacatgacggtggagttcactgactgtctgatactattggttgacaagaaaattagtgatgctagtgagattataaggatacttgacagtgctgttaaagaaaattatccgttgttaataattgctgaggatgtggaagaacaagcaatggctgatttgataaaaaacaagctgaaagggacaattaaggttgcagcagttaaggccttctcttttggggaacaaaagactcagtgcttggatgacattgcaataatgacaggaggtacactagtgagggatgacatgggacatgaactagagatggcaggaaaagaggttcttggttttgcttctaaggttgtaataacgaaagattcaacgctaattgttaccgatggaagcaatcgtcaagcagttgaggaaagggttactatgataaaaggacaaattgagaactctaaggaaaggtacaacaagaagatattgggtgagaggatagcaaggttatgtggtgcaattgcaatcatccaggttggtgctcaaacaatcattgagatgaaagataagaagctgaggattgaagatgcactcaacgcaacaagggcagctattgaggaaggtgttgtagttggtggtggatgtagcctattaagactgtcagagaagattgacgcaatcaaggaatcatcattggataatatagagcaggaggttggtgctgacatcttcaaacaagccttgagttaccctacctctctaatagcaaacaatgcaggggtgaatggcgactttgtcattaaaaaggtgttactgaatgataatgcaaattatggttacaatgctgccaagaactgctatgaggacttgatggctgctggaatactggacgcatcaaaggttgtgaggtgttgcattgagcatgctgctgtggttgctaagtcctttctcacctccgatgtggtgattgttgaggcaaaagaaggcaaacctattcgaataagacccccaatgcctcctaggaacttaattcccccaatgcccccttcaatttcaggtattcgagtgtag

SEQ ID NO: 10064 - protein, 585 aa, Sorghum bicolor
  misc_feature: Ceres ANNOT ID no. 6108985
  misc_feature (51)..(556): Pfam Id: Cpn60_TCP1 Pfam Desc: TCP-1/cpn60 chaperonin family
  misc_feature (30)..(568): NCBI GI: 62320622 NCBI Desc: chaperonin precursor [arabidopsis thaliana]
  misc_feature (30)..(567): NCBI GI: 806808 NCBI Desc: chaperonin precursor [pisum sativum]
  misc_feature (30)..(567): NCBI GI: 4204266 NCBI Desc: rubisco subunit binding-protein beta subunit [arabidopsis thaliana]
  misc_feature (30)..(567): NCBI GI: 81601 NCBI Desc: chaperonin 60 beta precursor - arabidopsis thaliana
  misc_feature (30)..(561): NCBI GI: 134104 NCBI Desc: rubisco subunit binding-protein beta subunit, chloroplast precursor (60 kda chaperonin beta subunit) (cpn-60 beta)
MAPPSPPLSMKPPTLPFSPPKKPPPMPVYKDLHFNRDLSATKKLQAGVDLVARLLGVTLGPKGRNVVLGNKYGPPKIVNDGETVLKEIELEDPLENLGVKLVRQAGARTNDIAGDGCTTSIILAQGLIAEGMKVLAAGINPVQVARGIEKTAAALVSELRLMSREIEDHEIAHVAAISAGNDYAVGNMIYDAFQRVGRKGMVRIENGRGTENSLEVVEGMQFERGYLSPYFVTNRGNMTVEFTDCLILLVDKKISDASEIIRILDSAVKENYPLLIIAEDVEEQAMADLIKNKLKGTIKVAAVKAFSFGEQKTQCLDDIAIMTGGTLVRDDMGHELEMAGKEVLGFASKVVITKDSTLIVTDGSNRQAVEERVTMIKGQIENSKERYNKKILGERIARLCGAIAIIQVGAQTIIEMKDKKLRIEDALNATRAAIEEGVVVGGGCSLLRLSEKIDAIKESSLDNIEQEVGADIFKQALSYPTSLIANNAGVNGDFVIKKVLLNDNANYGYNAAKNCYEDLMAAGILDASKVVRCCIEHAAVVAKSFLTSDVVIVEAKEGKPIRIRPPMPPRNLIPPMPPSISGIRV

SEQ ID NO: 10065 - DNA, 1650 bp, Sorghum bicolor
  misc_feature: Ceres ANNOT ID no. 6108988
  misc_feature: Encodes the peptide sequence at SEQ ID NO 10066
atggaggctgcgcccgcggcggtcatggagcgggagcgcctcacggccgagatggccttccgcggcgccgacgaagctctgcgggacggcggcggcgagccggcgcccagcatcgtcatcaagatccgccgccggctcccggacttcgcgcgcaacatcaagctcaagtacgtcaagctcgggatccgccacggcggcagccccacgtctgtgctgcccatgctctgcgtccccgcgatcgccgccgccgcctactcgttcgtccgcctcgacgtcatctactactccatcgacctgctcacctgcgtcgcctggctcggcaccgcgctgctgctgctcaccgtctactacttcaagcggccccgccccgtgtacctcgtcgagttcgcgtgctacaagcccgaggagcagctcaagatctccaagtcggccttcctggagatgaccgagagcacggggtccttcaatgaggcggcgctggatttccagaccaagatcaccaaccgctccgcgctcggcgacgagacgtacctgcccccgggcgtccaggcccgcccgcccaggctcaacatggcggaggcgcggatggaggccgaggccgtcatgttcgggtgcctggacgcgctgttcgcgtccacggggatcgacccgcgccgcgacgtgcgcatcctcatcgtcaactgcagcctcttcaacccgacgccgtcgctggcgtccatgatcatcaaccactacaggatgcgcgaggacgtcaagtcgttcaacctcggtggcatgggttgcagcgccggcctcatcgccatcgacctcgccaaggacatgctccaggcgaacccgaactcgtacgccgtcgtgctcagcaccgagaacatcaccctcaactggtacttcggcaacgaccgctccatgctcctctccaactgcatcttccgcatgggcggcgcggcggcgctgctgtccaacaagcgcgcggacgccgggcgcgccaagtaccggctgctccacacggtgcgcacccacaagggcgccaccgacgagtgcttcaactgcgtgtaccagcgcgaggacgaggtgggcaaggtgggcgtgtcgctggcgcgggagctcatggcggtggccggcgacgcgctcaagaccaacatcaccacgctggggcccctggtgctgcccctgagcgagcagctcaagttcctcaagtccctcatgatgcgccgcgtgttccgcgtcaagggcgtgcgcccctacatcccggacttccgccgcgcgttcgagcacttctgcgtgcacgccggcggccgggcggtgctggaggaggtgcagcgcagcctgagcctgcaggacacggacatggagcccagcaagtgctccctccaccggttcggcaacaccagcagcagctcgctgtggtacgagctggcgtacgccgaggccaagggccgggtgcggcgcggcaaccgcgtgtggcagatcggcttcggctccgggttcaagtgcaacagcgccgtgtggcgcgcgctccaagacgtgccggcgctgtcgtcgtcgtcgtcgaccggagccgcagcagcggggaagggcgcgcagagcaagagctgctgcaacccctgggtggacgacgtggacaggtaccctcccaaggcgtacgtctga

SEQ ID NO: 10066 - protein, 549 aa, Sorghum bicolor
  misc_feature: Ceres ANNOT ID no. 6108988
  misc_feature (116)..(406): Pfam Id: FAE1_CUT1_RppA Pfam Desc: FAE1/Type III polyketide synthase-like protein
  misc_feature (419)..(505): Pfam Id: ACP_syn_III_C Pfam Desc: 3-Oxoacyl-[acyl-carrier-protein (ACP)] synthase III C terminal
  misc_feature (363)..(507): Pfam Id: Chal_sti_synt_C Pfam Desc: Chalcone and stilbene synthases, C-terminal domain
  misc_feature (3)..(519): NCBI GI: 115481206 NCBI Desc: os10g0158100 [oryza sativa (japonica cultivar-group)]
  misc_feature (9)..(546): NCBI GI: 3551960 NCBI Desc: senescence-associated protein 15 [hemerocallis hybrid cultivar]
  misc_feature (9)..(524): NCBI GI: 4091810 NCBI Desc: fatty acid elongase 3-ketoacyl-coa synthase 1 [arabidopsis thaliana]
  misc_feature (9)..(544): NCBI GI: 87240844 NCBI Desc: chalcone and stilbene synthases, n-terminal [medicago truncatula]
  misc_feature (1)..(524): NCBI GI: 49355348 NCBI Desc: fatty acid elongase 3-ketoacyl-coa synthase [brassica napus]
  misc_feature (1)..(524): SWISSPROT Homolog: EC 2.3.1.119 3-ketoacyl-CoA synthase 1 (EC 2.3.1.-)
  misc_feature: The sequence is a functional homolog of SEQ ID NO 2 in US patent 7038112
MEAAPAAVMERERLTAEMAFRGADEALRDGGGEPAPSIVIKIRRRLPDFARNIKLKYVKLGIRHGGSPTSVLPMLCVPAIAAAAYSFVRLDVIYYSIDLLTCVAWLGTALLLLTVYYFKRPRPVYLVEFACYKPEEQLKISKSAFLEMTESTGSFNEAALDFQTKITNRSALGDETYLPPGVQARPPRLNMAEARMEAEAVMFGCLDALFASTGIDPRRDVRILIVNCSLFNPTPSLASMIINHYRMREDVKSFNLGGMGCSAGLIAIDLAKDMLQANPNSYAVVLSTENITLNWYFGNDRSMLLSNCIFRMGGAAALLSNKRADAGRAKYRLLHTVRTHKGATDECFNCVYQREDEVGKVGVSLARELMAVAGDALKTNITTLGPLVLPLSEQLKFLKSLMMRRVFRVKGVRPYIPDFRRAFEHFCVHAGGRAVLEEVQRSLSLQDTDMEPSKCSLHRFGNTSSSSLWYELAYAEAKGRVRRGNRVWQIGFGSGFKCNSAVWRALQDVPALSSSSSTGAAAAGKGAQSKSCCNPWVDDVDRYPPKAYV

SEQ ID NO: 10067 - DNA, 1473 bp, Sorghum bicolor
  misc_feature: Ceres ANNOT ID no. 6108993
  misc_feature: Encodes the peptide sequence at SEQ ID NO 10068
atggcgtcgttgtgtatcgccggacttctcctgctgctcgccgcgcactcccacgccgccgtcgtcgggctcgccacgcctgtggagtacgagtaccacagttatgcggtaactcctctgtctccgcacgcatatagcgccccggcggctgccgacgacgacgctcaggcgcaggaggacgtcgctgcgtcatcgtccactctgcacattcgcctgctccaccgcgacaggttcgcagcgaacgccaccccagcccagctcctggcgcgccgcctgcagcgggacgtgctgagggcagcgtggatcatctcgaaagctgctgcgaacggtacgccgccgccggtcgctgggctctccagcgcacgcgggttcgtggcgccggtggtgtccagggcgccgacgagcggggagtacatcgccaagattgcggtgggcacgccgggcgtcgaggcgctgctggcgctggacacggccagcgacctcacgtggctgcagtgccagccatgcaggcgttgctacccgcagtccggacccgtgttcgacccgcggcactcgacgtcataccgcgaaatgagtttcaatgcggcagattgccaagcgttgggacgatccggcggcggcgacgcgaagcgcgggacgtgcgtctacaccgtgggctacggggacggctctacgacggtgggagacttcatcgaggagacgctgaccttcgcgggcggtgtccggctaccgcgcatatcgatcggctgcggccatgacaacaagggcctattcggggcgccggcggcggggatcctgggcctcggccgtggcctcatgtcgttcccgaaccagatcgaccacaacgggaccttctcctactgcctggtcgacttcctctccggcccaggctccctctcctccaccctcacctttggtgccggcgccgtggacacctccccgccagtgtccttcacccccacagtcctcaacctgaacatgcccacgttctactacgtgcggctcaccggcatcagcgtgggcggcgtgcgcgtgccgggcgtcaccgagcgcgacctccagctagacccgtacaccggccgcggcggtgtcattgtggactccggcaccgccgtgacgcggcttgcccgccccgcgtacacggcgttccgtgatgccttccgtgccgtggcagtggacctcggccaggtctccattggcggcccctccggcttcttcgatacgtgctacaccgtgggtggccggggcatgaagaaggtgcccaccgtgtcaatgcacttcgccggcagcgtcgaggtgaagctccagcccaagaactacctcatccccgtggactccatgggcaccgtgtgctttgcgtttgctgccaccggtgaccatagcgtttccatcatcggcaacatccagcagcaggggttccgcatcgtgtacgacatcggtggccgtgttggatttgcgcccaatagctgctga

SEQ ID NO: 10068 - protein, 490 aa, Sorghum bicolor
  misc_feature: Ceres ANNOT ID no. 6108993
  misc_feature (137)..(488): Pfam Id: Asp Pfam Desc: Eukaryotic aspartyl protease
  misc_feature (4)..(490): NCBI GI: 15290061 NCBI Desc: nucleoid dna-binding protein cnd41-like [oryza sativa (japonica cultivar-group)]
  misc_feature (48)..(490): NCBI GI: 47777372 NCBI Desc: unknow protein [oryza sativa (japonica cultivar-group)]
  misc_feature (67)..(490): NCBI GI: 18461217 NCBI Desc: p0690b02.2 [oryza sativa (japonica cultivar-group)]
  misc_feature (9)..(305): NCBI GI: 38344196 NCBI Desc: osjnba0064g10.12 [oryza sativa (japonica cultivar-group)]
  misc_feature (43)..(490): NCBI GI: 61214233 NCBI Desc: aspartic proteinase nepenthesin-1 precursor (nepenthesin-i)
MASLCIAGLLLLLAAHSHAAVVGLATPVEYEYHSYAVTPLSPHAYSAPAAADDDAQAQEDVAASSSTLHIRLLHRDRFAANATPAQLLARRLQRDVLRAAWIISKAAANGTPPPVAGLSSARGFVAPVVSRAPTSGEYIAKIAVGTPGVEALLALDTASDLTWLQCQPCRRCYPQSGPVFDPRHSTSYREMSFNAADCQALGRSGGGDAKRGTCVYTVGYGDGSTTVGDFIEETLTFAGGVRLPRISIGCGHDNKGLFGAPAAGILGLGRGLMSFPNQIDHNGTFSYCLVDFLSGPGSLSSTLTFGAGAVDTSPPVSFTPTVLNLNMPTFYYVRLTGISVGGVRVPGVTERDLQLDPYTGRGGVIVDSGTAVTRLARPAYTAFRDAFRAVAVDLGQVSIGGPSGFFDTCYTVGGRGMKKVPTVSMHFAGSVEVKLQPKNYLIPVDSMGTVCFAFAATGDHSVSIIGNIQQQGFRIVYDIGGRVGFAPNSC

SEQ ID NO: 10069 - DNA, 981 bp, Sorghum bicolor
  misc_feature: Ceres ANNOT ID no. 6108996
  misc_feature: Encodes the peptide sequence at SEQ ID NO 10070
atgctctcgttgcggccaccccctaccactttctcgcgccccttgaggtggccgagacggggtcgcctcggcggagccgccgcggcgcaatatgttagcgccgcggcaccgtcggccgctctggagtcagctgcacctccggagagcgtctccttcccgattctggtgaatggctgcactggtaaaatggggttatctgtcgctgaggctgctgctctgaggggccttcacctagtccctgtttcattcagtagtagagagaaggttgaaaaaacaatacaagttggacaaacagacattcggatatatggtccttctgcaagagaagatattctttcatctgtggctgatgaattcccagatgtcattattgtggactacacagcacctgattctgtgaactctaatgctgagctctattgcaagcttggcttgccatttgtgatgggcacaactggtgggaacaggcatttgctctacaagtcagtgcaagattcaaaaagttatgcactagtatctccacagatgggtaaacaggtggttgcatttgttgctgcaatgaaaatcatggctgagcagtttccaggggccttttcaggctatcatttagaggttttagaatcccatcaagctggcaagctggacacatctggtacagctaaagacgtgattgcttgttttgagaaactaggtgtgtcatatgacatgaaccggatggtcaagattagagatcctgaacagcagcttgagatggtgggtgtccctgaagaacacattcaagggcatgcattccatctgtatcatcttacttctcctgatgacagtgtttcatttgagttccagcacaatgtttgtggtcgttcaatctacgctgaaggaactattgatgcggcaatatttctgcataggaaggtacaatcaaaggactctaagagaatatataatatggatgatgtcctgagagaaggatatatgcgataa

SEQ ID NO: 10070 - protein, 326 aa, Sorghum bicolor
  misc_feature: Ceres ANNOT ID no. 6108996
  misc_feature (179)..(320): Pfam Id: DapB_C Pfam Desc: Dihydrodipicolinate reductase, C-terminus
  misc_feature (52)..(176): Pfam Id: DapB_N Pfam Desc: Dihydrodipicolinate reductase, N-terminus
  misc_feature (2)..(326): NCBI GI: 115451871 NCBI Desc: os03g0245100 [oryza sativa (japonica cultivar-group)]
  misc_feature (32)..(326): NCBI GI: 51535668 NCBI Desc: dihydrodipicolinate reductase-like [oryza sativa (japonica cultivar-group)]
  misc_feature (43)..(326): NCBI GI: 42572737 NCBI Desc: dihydrodipicolinate reductase family protein [arabidopsis thaliana]
  misc_feature (53)..(323): NCBI GI: 121542607 NCBI Desc: dihydrodipicolinate reductase family protein [candidatus desulfococcus oleovorans hxd3]
  misc_feature (51)..(320): NCBI GI: 113477105 NCBI Desc: dihydrodipicolinate reductase [trichodesmium erythraeum ims101]
MLSLRPPPTTFSRPLRWPRRGRLGGAAAAQYVSAAAPSAALESAAPPESVSFPILVNGCTGKMGLSVAEAAALRGLHLVPVSFSSREKVEKTIQVGQTDIRIYGPSAREDILSSVADEFPDVIIVDYTAPDSVNSNAELYCKLGLPFVMGTTGGNRHLLYKSVQDSKSYALVSPQMGKQVVAFVAAMKIMAEQFPGAFSGYHLEVLESHQAGKLDTSGTAKDVIACFEKLGVSYDMNRMVKIRDPEQQLEMVGVPEEHIQGHAFHLYHLTSPDDSVSFEFQHNVCGRSIYAEGTIDAAIFLHRKVQSKDSKRIYNMDDVLREGYMR

SEQ ID NO: 10071 - DNA, 1572 bp, Sorghum bicolor
  misc_feature: Ceres ANNOT ID no. 6108999
  misc_feature: Encodes the peptide sequence at SEQ ID NO 10072
atggcctcggaggccaatgggggcgtcgtcgccaacgagaagggagcggagacggtcggcgtcgggcggtacgtggaaatggagcaggaccaggagtccaacaccgtcaagtcgcggctctccggcctgctctggcacggcggctccgcctacgacgcttggttcagctgcgcctccaaccaggtggctcaggtgctgctgaccctgccctactcgttctcgcaactggggatgctgagcggcatcctgttccagctcttctacggcctgatgggcagctggacggcgtacctcatcagcatcctctacgtggagtaccggaccaggaaggagagggagaaggccgacttcaggaaccatgtcatccagtggttcgaggtgctggacgggctgctcgggaggcactggaggaacgtcggcctggccttcaactgcacgttcctgctcttcggctctgtcatccagctcatcgcttgcgcaagcaacatctactacatcaacgacaagctggacaagcggacgtggacgtacatcttcggcgcctgctgcgccacgacggtgttcatcccgtcgttccacaactaccggatctggtcgttcctgggcctcgtcatgaccacctacaccgcgtggtacctcgccgtcgcctccctcatccacggccaggttgatggcgtgaagcactccgggccgaccaagatggtgctctacttcaccggggccacaaacattctctacaccttcggagggcacgctgttactgtggagatcatgcacgcgatgtggcggccgcagaagttcaaggcgatctacctgatggcgacgctgtacgtgctgacgctgacgctgccgtcggcggcgagcgtgtactgggcgttcggggaccagctgctgacgcactccaacgcgctggcgctgctcccgcggacgcccttccgcgacgccgccgtcgtgctcatgctcgtccaccagttcatcaccttcggcttcgcctgcacgccgctctacttcgtctgggagaagctcatcggcctccacgactgccgcagcctctgcaagcgcgccgccgccaggctccccgtcgtcgtgcccatctggttcctcgccatcatcttccctttctttgggcccatcaactccgccgtggggtcgctcctcgtcagcttcaccgtctacatcatcccggcgctcgcgcacatgatcaccttccgatccgcaaccgcccgtgagaacgcggtggagccgccgccgcggctggtggggcgttggacgggcacgtacatgatcaacgcgttcgtggtggcgtgggtgctggtggtcggcttcggcttcggcggctgggcaagcatgaccaacttcgtccgccagatcgacaccttcggcctcttcaccaagtgctaccagtgcccgccgccgcctctcccgccgggcgccgccctcttgccgttccccggcggcctcgccaacatcaccatgccattcaacgggaccgctgagctccctccggcaccggctccttcgccggcgcatttcttccgccaccaccaccgacatcacagccaccggctctga

SEQ ID NO: 10072 - protein, 523 aa, Sorghum bicolor
  misc_feature: Ceres ANNOT ID no. 6108999
  misc_feature (46)..(440): Pfam Id: Aa_trans Pfam Desc: Transmembrane amino acid transporter protein
  misc_feature (1)..(484): NCBI GI: 6689614 NCBI Desc: aux1 protein [zea mays]
  misc_feature (10)..(493): NCBI GI: 21586474 NCBI Desc: auxin influx carrier protein [medicago truncatula]
  misc_feature (10)..(471): NCBI GI: 126217796 NCBI Desc: auxin influx transport protein [casuarina glauca]
  misc_feature (10)..(471): NCBI GI: 126217798 NCBI Desc: auxin influx transport protein [casuarina glauca]
  misc_feature (10)..(470): NCBI GI: 89511764 NCBI Desc: auxin influx carrier [lupinus albus]
MASEANGGVVANEKGAETVGVGRYVEMEQDQESNTVKSRLSGLLWHGGSAYDAWFSCASNQVAQVLLTLPYSFSQLGMLSGILFQLFYGLMGSWTAYLISILYVEYRTRKEREKADFRNHVIQWFEVLDGLLGRHWRNVGLAFNCTFLLFGSVIQLIACASNIYYINDKLDKRTWTYIFGACCATTVFIPSFHNYRIWSFLGLVMTTYTAWYLAVASLIHGQVDGVKHSGPTKMVLYFTGATNILYTFGGHAVTVEIMHAMWRPQKFKAIYLMATLYVLTLTLPSAASVYWAFGDQLLTHSNALALLPRTPFRDAAVVLMLVHQFITFGFACTPLYFVWEKLIGLHDCRSLCKRAAARLPVVVPIWFLAIIFPFFGPINSAVGSLLVSFTVYIIPALAHMITFRSATARENAVEPPPRLVGRWTGTYMINAFVVAWVLVVGFGFGGWASMTNFVRQIDTFGLFTKCYQCPPPPLPPGAALLPFPGGLANITMPFNGTAELPPAPAPSPAHFFRHHHRHHSHRL

SEQ ID NO: 10073 - DNA, 1020 bp, Sorghum bicolor
  misc_feature: Ceres ANNOT ID no. 6109012
  misc_feature: Encodes the peptide sequence at SEQ ID NO 10074
atgttttggaaggatagcggcagccggagcagcagcggcagcggccgggatcagaacggcgtcggccccttcggccaagtgcgcgtcctcatcgtcggcgattcaggtgttgggaaatcttcattgctgcatctcattttaaaaagttctgctattgctcgaccagctcaaacagtaggatgcactgtgggtgttaaacatgttacttatggaagtgcgggcggttcatctaataacatcagtgatgctgaaaggaacttctttgttgagcttttggatgtctcaggacatgaacgatacaaggcatgccggtcgattttctatacacaaatcaatggtgtcatatttgtttatgatctctctcagaggaagaccaagaccaatttgaataaatgggcagttgaagttgctgaaactggcacattttcagctccattgggatctggtggaccaggaggacttccggtgccttatctggtaattgctaataaagtggatatcgttccaagagatgggacaagagcaagcaggggaaatcttgttgatcttgctcgccaatgggctgagaagcagggccttcttcgatgcagtgaagaacttccgctcacagagagctttcctgggaactccggtcttgtgtcggctgctaaacaagcaagatatgacaaagaagctgtgatcaagtttttccgcttgctgatcagaagaagatacttttcaaacgaacctcctgccccaagtccctggtcccttactccaagagaagataccatccttcctgtggagagtcttggaggtggcgtcgatagcttccaaaggaaaagccttagtggtgacggatttctgtacaacggagtagttccactcccagcgcagaggaacctcacaccgccaccaactctgaatccgcagcagcctgtgtcgtccttggacaactacagatatcatcgattctcctcctcgtcgcttccggacgtgagcagcaatagaacaagccgagaagacattattgatgtatga

SEQ ID NO: 10074 - protein, 339 aa, Sorghum bicolor
  misc_feature: Ceres ANNOT ID no. 6109012
  misc_feature (28)..(202): Pfam Id: Ras Pfam Desc: Ras family
  misc_feature (28)..(166): Pfam Id: Miro Pfam Desc: Miro-like protein
  misc_feature (27)..(166): Pfam Id: MMR_HSR1 Pfam Desc: GTPase of unknown function
  misc_feature (1)..(336): NCBI GI: 92885180 NCBI Desc: sigma-54 factor, interaction region; ras small gtpase, rab type [medicago truncatula]
  misc_feature (2)..(336): NCBI GI: 145357836 NCBI Desc: atp binding / gtp binding / transcription factor binding [arabidopsis thaliana]
  misc_feature (26)..(136): NCBI GI: 116127026 NCBI Desc: ensangp00000013042 [anopheles gambiae str. pest]
  misc_feature (24)..(136): NCBI GI: 76154903 NCBI Desc: sjchgc04399 protein [schistosoma japonicum]
  misc_feature (26)..(242): NCBI GI: 18088572 NCBI Desc: rab, member of ras oncogene family-like 3 [homo sapiens]
  misc_feature: The sequence is a functional homolog of SEQ ID NO. 400 in the 11/188,298 US application
MFWKDSGSRSSSGSGRDQNGVGPFGQVRVLIVGDSGVGKSSLLHLILKSSAIARPAQTVGCTVGVKHVTYGSAGGSSNNISDAERNFFVELLDVSGHERYKACRSIFYTQINGVIFVYDLSQRKTKTNLNKWAVEVAETGTFSAPLGSGGPGGLPVPYLVIANKVDIVPRDGTRASRGNLVDLARQWAEKQGLLRCSEELPLTESFPGNSGLVSAAKQARYDKEAVIKFFRLLIRRRYFSNEPPAPSPWSLTPREDTILPVESLGGGVDSFQRKSLSGDGFLYNGVVPLPAQRNLTPPPTLNPQQPVSSLDNYRYHRFSSSSLPDVSSNRTSREDIIDV

SEQ ID NO: 10075 - DNA, 387 bp, Sorghum bicolor
  misc_feature: Ceres ANNOT ID no. 6109022
  misc_feature: Encodes the peptide sequence at SEQ ID NO 10076
atggagtccgtggtgaacccgaaggcgtacccgctggctgatgcgcagctgacgatgggtatcctcgatatcatccagcaggccgccaactacaagcagctcaagaagggagctaacgaagcgacgaagaccctgaacagggggatatcggagttcgtagtgatggcggcggatacggagcctctcgagatcctgctccacctccccttgctagctgaggataagaacgtgccatatgtatttgttccatcgaaacaagctcttggccgtgcttgtggtgtgacaagaccggtcattgcttgctcagtgaccagcaatgagggtagccagctgaaactacagatacagggcctcaaggtacttatattctgtcatattagttgttga

SEQ ID NO: 10076 - protein, 128 aa, Sorghum bicolor
  misc_feature: Ceres ANNOT ID no. 6109022
  misc_feature (19)..(113): Pfam Id: Ribosomal_L7Ae Pfam Desc: Ribosomal protein L7Ae/L30e/S12e/Gadd45 family
  misc_feature (2)..(122): NCBI GI: 47027071 NCBI Desc: ribosomal protein l7 [hyacinthus orientalis]
  misc_feature (5)..(119): NCBI GI: 21592866 NCBI Desc: ribosomal protein l7ae-like [arabidopsis thaliana]
  misc_feature (4)..(119): NCBI GI: 21592608 NCBI Desc: ribosomal protein l7ae-like [arabidopsis thaliana]
  misc_feature (4)..(119): NCBI GI: 21554922 NCBI Desc: ribosomal protein l7ae-like [arabidopsis thaliana]
  misc_feature (5)..(119): NCBI GI: 119720778 NCBI Desc: ribosomal protein l7ae-like [brassica rapa]
MESVVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKLQIQGLKVLIFCHISC

SEQ ID NO: 10077 - DNA, 1365 bp, Sorghum bicolor
  misc_feature: Ceres ANNOT ID no. 6109028
  misc_feature: Encodes the peptide sequence at SEQ ID NO 10078
atggctctgctggtgcggagggcacgcagggcggcgaccaaggccgcggtgtcgctcggcggcggcggcggcagcggcagcagcagcgtggagctcgcgatcccggcgcactaccggtgcccgatctcgctggatctcatgcgggaccccgtcacggcgccgacggggatcacgtacgaccgcgagagcatcgaggcgtggctggacacgggccgcgccacctgccccgtcacccacgcgccgctccgccacgaggacctcgtccccaaccacgccatccgccgcgtcatccaggactggtgcgtcgccaaccgctcccgcggcgtcgagcgcatccccacgcccaagatccccgtcacccccgtccaggcctccgagctcctcttcgacctcgcggggtgcgcgcgccgccgcgacgccgccgcgcccgcgcggtgcgccgaggtggtcgccaagatcaaggccctcgccagggacagcgagcggaacaggcgctgcttcgcgtccatcggcacgggccgcgtgctcgccgccgcgttcgagtcgctcgcttctgctgctgctgctgacgctgcgccggcggggcgcgtccttgaggacatcctcgcggcattggtctgcatgatgccgttggacgaggaggccgccaggacgctgggcttgccgagctcgctggggtctctggtcgccattgctgagaacgggaccttggcgggaaggctgaacgccgtgctggcgatcaaagaggtcgtctcatgcgacggagcgttcactgatctgagcggaaaggtcgacgagatcgtagacgcgctggcaaagatcatcaagtctccgatctgcccacaggcaaccaaggccggcatggtcgccacctatcacctggcgctatacgacgagcgcgtcgcggcgcgccttgccgccgccgggctcgtccccgtgctcatcgaggccctcgtagacgccgacaagagcatgtccgagaaggcactggctgtgctcgacgcggtgctcgcctcggaggaaggccgcgcaagcgcgcgggcgcacgcgctcgccgtgcccatgctcgtcaagaagatgttccgcgtgtccgacctggcgacccaactcgcggtgtcggcgatgtggcgccttggaaaggcgcacagcgacggcgaggaggaggagaatgcggtgacgcggtgccttgtcgaggcgctgcgggttggggcgttccagaaactgctcctgctcttgcaggtcggctgcagggacgcaaccaaggagaaggccaccgagctgctcaagttgctcaacaagtacaagagcgtaggcgaatgcgtcgacgctgtggatttcagagggctgaacaagctgtcatcttaa

SEQ ID NO: 10078 - protein, 454 aa, Sorghum bicolor
  misc_feature: Ceres ANNOT ID no. 6109028
  misc_feature (33)..(107): Pfam Id: U-box Pfam Desc: U-box domain
  misc_feature (28)..(451): NCBI GI: 14582202 NCBI Desc: immediate-early fungal elicitor protein cmpg1 [petroselinum crispum]
  misc_feature (28)..(451): NCBI GI: 30013683 NCBI Desc: avr9/cf-9 rapidly elicited protein 74 [nicotiana tabacum]
  misc_feature (28)..(451): NCBI GI: 71980110 NCBI Desc: avr9/cf-9 rapidly elicited protein [lycopersicon esculentum]
  misc_feature (30)..(385): NCBI GI: 19911585 NCBI Desc: syringolide-induced protein 13-1-1 [glycine max]
  misc_feature (31)..(451): NCBI GI: 56381895 NCBI Desc: at5g37490 [arabidopsis thaliana]
  misc_feature: The sequence is a functional homolog of SEQ ID NO. 308 in the 11/188,298 US application
  misc_feature: The sequence is a functional homolog of SEQ ID NO. 528 in the 11/188,298 US application
  misc_feature: The sequence is a functional homolog of SEQ ID NO. 309 in the 11/188,298 US application
MALLVRRARRAATKAAVSLGGGGGSGSSSVELAIPAHYRCPISLDLMRDPVTAPTGITYDRESIEAWLDTGRATCPVTHAPLRHEDLVPNHAIRRVIQDWCVANRSRGVERIPTPKIPVTPVQASELLFDLAGCARRRDAAAPARCAEVVAKIKALARDSERNRRCFASIGTGRVLAAAFESLASAAAADAAPAGRVLEDILAALVCMMPLDEEAARTLGLPSSLGSLVAIAENGTLAGRLNAVLAIKEVVSCDGAFTDLSGKVDEIVDALAKIIKSPICPQATKAGMVATYHLALYDERVAARLAAAGLVPVLIEALVDADKSMSEKALAVLDAVLASEEGRASARAHALAVPMLVKKMFRVSDLATQLAVSAMWRLGKAHSDGEEEENAVTRCLVEALRVGAFQKLLLLLQVGCRDATKEKATELLKLLNKYKSVGECVDAVDFRGLNKLSS

SEQ ID NO: 10079 - DNA, 981 bp, Sorghum bicolor
  misc_feature: Ceres ANNOT ID no. 6109029
  misc_feature: Encodes the peptide sequence at SEQ ID NO 10080
atggcgtcgccgataccgcgcgaatgggccggtctgcagcagtttccggcggccacccagaccaagctgcacgagctcctcggcaaactcaaggaggaggatgtgagcacattaacaattctggtgatggggaaaggtggagtggggaagtcatccactgttaactccatcgtcggggagagggtcaccactgtcagcgctttccagtctgagggtctgagaccaacgatgtgctcgcgcacaagggcagggttcaccttgaacattatcgacactcctgggctcattgaaggtggatacattaatgagcaggctgttgacatcattaagagatttcttctaggcaagactatcgatgttctcctgtacgtggatcgcttggatgcgtatagaatggatacactggatgaacaggtcataagagccatcaccaattcatttggaaaagatatttggcgaagatcattggttgtgttgacccatgctcaactctcaccacctgatggaatcgactataatgatttctttacaagaagatcagaggcacttttgcgatacatccgctcgggggcaggaatcaacaaacgagaatatggggatttccccctgccaatagcattagtggagaacagtggaaggtgcaaggctaatgaacatggggagaagatacttccagatggaactccgtgggttccaaacctgatgaaagaaattactgttgtcatctcaaacgggagcaagtccattcatgttgatcagaagttaattgatggtccaaaccctaacaatcgctggaagatgttcataccacttatccttgctgtggagtacttcttggtagtaaaaggaatccggagggcgatccatgcagatatcgcaaacgggaaggtggatgactgggagcagcgttaccgggacttggtgggaagcagggaccccgtagagcagaaaggttctacctcccggaaccgcaaagcctaa

SEQ ID NO: 10080 - protein, 326 aa, Sorghum bicolor
  misc_feature: Ceres ANNOT ID no. 6109029
  misc_feature (38)..(228): Pfam Id: AIG1 Pfam Desc: AIG1 family
  misc_feature (38)..(163): Pfam Id: MMR_HSR1 Pfam Desc: GTPase of unknown function
  misc_feature (1)..(326): NCBI GI: 7259224 NCBI Desc: toc34-2 protein [zea mays]
  misc_feature (1)..(326): NCBI GI: 6689637 NCBI Desc: toc34-1 protein [zea mays]
  misc_feature (7)..(311): NCBI GI: 10178039 NCBI Desc: gtp-binding protein [arabidopsis thaliana]
  misc_feature (7)..(311): NCBI GI: 1151244 NCBI Desc: gtp-binding protein [arabidopsis thaliana]
  misc_feature (7)..(311): NCBI GI: 21594231 NCBI Desc: gtp-binding protein [arabidopsis thaliana]
MASPIPREWAGLQQFPAATQTKLHELLGKLKEEDVSTLTILVMGKGGVGKSSTVNSIVGERVTTVSAFQSEGLRPTMCSRTRAGFTLNIIDTPGLIEGGYINEQAVDIIKRFLLGKTIDVLLYVDRLDAYRMDTLDEQVIRAITNSFGKDIWRRSLVVLTHAQLSPPDGIDYNDFFTRRSEALLRYIRSGAGINKREYGDFPLPIALVENSGRCKANEHGEKILPDGTPWVPNLMKEITVVISNGSKSIHVDQKLIDGPNPNNRWKMFIPLILAVEYFLVVKGIRRAIHADIANGKVDDWEQRYRDLVGSRDPVEQKGSTSRNRKA

SEQ ID NO: 10081 - DNA, 1149 bp, Sorghum bicolor
  misc_feature: Ceres ANNOT ID no. 6109033
  misc_feature: Encodes the peptide sequence at SEQ ID NO 10082
atgggaaagggagatgtggctactaggtccaaatctcaaaaatcgtcagcaatacagaatgagcagagtacacctactaacccccccacagcatatcctgattggtctcagttccaggcatactataatgctcctgggacagctcccgtgaccccaccggctttttttcattcatctgtagctccaagccctcagggacacccatatatgtggggtccacagatgatgcctccttatgggacaccaccaccatatgcagcaatgtatgcacaaggcacaccatatcagcaggcaccgatgccaccgggttcacacccatacagcccttatcctatgcagtcaccaaatgggacagttcaaactccaacatctggtgctggcggtacagagacaaataaatcgaataaaaataagcggaagactcccctgaaaagatcaaaaggaagcttaggtagtctggatgttgttgcagtaaaaaacaacaagtcaccggcaaagcctcaagcttcttcctccaatgaaggttcttcacaaagtgagagtggaagcgggagttcttctgaaggaagcagtacaaattcaaaaagtagttcaagggcgaaggatggttctgagcaaggtcagggtaatgatgctaggagtaaaggtactcaaagctctgcagttgagcccacacaaccatcttctgggcctgttgtgcttaaccctatgatgccattttggcctgttccccctcctatggctggcccagcaactactctgaatatgggagtggattactggggtactcctgcttctgtacccatgcatggtaaagttattgcagcaccgacatcagctccttcatcaaattcacgtgatattgttctcagtgatccggctatacaggatgagagagaaatgaagagacaaaaacggaagcaatcaaatagggaatcagctcggcgctcaagattgcgcaagcaggctgaatgggaggaagtagccaatcgtgcagatttgctaaagcaggaaaatagttcgcttaaagaagaattgaaacaacttcaggagaagtgtgatagcttgacctcagaaaatacatctctacacgagaagcttaaagtgcttgaggatgagaaatcaaatggaaattggtgcaaggattaa

SEQ ID NO: 10082 - protein, 382 aa, Sorghum bicolor
  misc_feature: Ceres ANNOT ID no. 6109033
  misc_feature (1)..(198): Pfam Id: MFMR Pfam Desc: G-box binding protein MFMR
  misc_feature (298)..(361): Pfam Id: bZIP_1 Pfam Desc: bZIP transcription factor
  misc_feature (298)..(352): Pfam Id: bZIP_2 Pfam Desc: Basic region leucine zipper
  misc_feature (1)..(378): NCBI GI: 497895 NCBI Desc: transcription factor hbp-1a(c14) [triticum aestivum]
  misc_feature (8)..(369): NCBI GI: 42570366 NCBI Desc: bzip transcription factor family protein [arabidopsis thaliana]
  misc_feature (1)..(378): NCBI GI: 13775109 NCBI Desc: bzip transcription factor 3 [phaseolus vulgaris]
  misc_feature (1)..(367): NCBI GI: 5381313 NCBI Desc: g-box binding protein 2 [catharanthus roseus]
  misc_feature (1)..(378): NCBI GI: 13775107 NCBI Desc: bzip transcription factor 2 [phaseolus vulgaris]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 1477 in the 11/479,226US patent application
  misc_feature: The sequence is a functional homolog of SEQ ID NO 1762 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 708 in the 10/412,699US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 922 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 708 in the 20040045049 US patent application
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MGKGDVATRSKSQKSSAIQNEQSTPTNPPTAYPDWSQFQAYYNAPGTAPVTPPAFFHSSVAPSPQGHPYMWGPQMMPPYGTPPPYAAMYAQGTPYQQAPMPPGSHPYSPYPMQSPNGTVQTPTSGAGGTETNKSNKNKRKTPLKRSKGSLGSLDVVAVKNNKSPAKPQASSSNEGSSQSESGSGSSSEGSSTNSKSSSRAKDGSEQGQGNDARSKGTQSSAVEPTQPSSGPVVLNPMMPFWPVPPPMAGPATTLNMGVDYWGTPASVPMHGKVIAAPTSAPSSNSRDIVLSDPAIQDEREMKRQKRKQSNRESARRSRLRKQAEWEEVANRADLLKQENSSLKEELKQLQEKCDSLTSENTSLHEKLKVLEDEKSNGNWCKD

SEQ ID NO: 10083 - DNA, 945 bp, Sorghum bicolor
  misc_feature: Ceres ANNOT ID no. 6109058
  misc_feature: Encodes the peptide sequence at SEQ ID NO 10084
atgagcgcgcccgggcgagctccgtgcggcctgccgcgcatcgggctgggcacggcggtgcagggcccgcggccggaccccgtccgcgccgcggtgctccgcgccatccagctcggctaccgccacttcgacacggccgcgcactacgccaccgaggcgcccatcggggaggccgccgccgaggccgtgcgtgcgggggtcgtcgcctcccgcgaggagctcttcatcacgtccaaggtctggtgcgccgacgcgcacccggacagggtgctcccggcgctccgccggacgctcagcaatctccagatggagtacgtggatctgtacatggtccactggcccgtgaccatgaaggccgggaggtacacggcccccttcacgcccgaggacttcgagccgttcgacatgcgatccgtgtgggaggccatggaggagtgccaccgcctgggcctcgccaaggccatcggcgtctgcaacttctcctgcaagaagctcgacaccctgctgtccttcgccaccatccctcccctcgtcaatcaggttgagatcaacccagtgtggcagcagcataagctgagggagttctgccgggagaaaggcatccagctatgcgcctactcgcccctgggcgccaagggcacgcactggggcagcgactcggtgatggactctggtgtcctgcacgagatcgccaagtccaagggcaaaaccgtggcacaggtgtgcctgaggtgggtgtacgagcagggcgactgcctgatcgtgaagagcttcgacgaagggcggatgaaggagaacctggacatcgtgggctgggagctgacggaggaggagaggcagcgcatcagcaagatcccccagaggaagatcaaccagggccgccgctacgtctccgagcacgggccctacaagtccctcgaggagctctgggacggcgagatataa

SEQ ID NO: 10084 - protein, 314 aa, Sorghum bicolor
  misc_feature: Ceres ANNOT ID no. 6109058
  misc_feature (7)..(287): Pfam Id: Aldo_ket_red Pfam Desc: Aldo/keto reductase family
  misc_feature (1)..(314): NCBI GI: 112807104 NCBI Desc: deoxymugineic acid synthase1 [zea mays]
  misc_feature (1)..(314): NCBI GI: 112807100 NCBI Desc: deoxymugineic acid synthase1 [hordeum vulgare]
  misc_feature (1)..(314): NCBI GI: 112807102 NCBI Desc: deoxymugineic acid synthase1 [triticum aestivum]
  misc_feature (10)..(314): NCBI GI: 112807098 NCBI Desc: deoxymugineic acid synthase1 [oryza sativa (japonica cultivar-group)]
  misc_feature (11)..(314): NCBI GI: 73621239 NCBI Desc: probable nad(p)h-dependent oxidoreductase 1
  misc_feature (11)..(314): SWISSPROT Homolog: EC 2.3.1.170 NAD(P)H-dependent 6'-deoxychalcone synthase
  misc_feature: Useful for making plants with modulated drought sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13495
  misc_feature: Useful for making plants with modulated drought sensitivity
  misc_feature: Functional homolog of the protein sequence given in SEQ ID NO 13495
MSAPGRAPCGLPRIGLGTAVQGPRPDPVRAAVLRAIQLGYRHFDTAAHYATEAPIGEAAAEAVRAGVVASREELFITSKVWCADAHPDRVLPALRRTLSNLQMEYVDLYMVHWPVTMKAGRYTAPFTPEDFEPFDMRSVWEAMEECHRLGLAKAIGVCNFSCKKLDTLLSFATIPPLVNQVEINPVWQQHKLREFCREKGIQLCAYSPLGAKGTHWGSDSVMDSGVLHEIAKSKGKTVAQVCLRWVYEQGDCLIVKSFDEGRMKENLDIVGWELTEEERQRISKIPQRKINQGRRYVSEHGPYKSLEELWDGEI

SEQ ID NO: 10085 - DNA, 1788 bp, Sorghum bicolor
  misc_feature: Ceres ANNOT ID no. 6109059
  misc_feature: Encodes the peptide sequence at SEQ ID NO 10086
atggcggcctcgccggccccggccgcggccgcagcgctcctcgtcctcctcgccctcgcggcggccggcggcgtggcggccgacggctccgaccaccggtacaagatgaacgagcccgtcccgctctacgccaacaaggtcggccccttccacaatcccagtgagacatatcgttacttcgacctgcctttctgctctcctgagaaagtgagggagaagagtgaggcccttggtgaggtcctcaatggggatcggttagttgatgcgccttacaagcttgatttccgtttagaagttgagtccaaggcagtttgctcaaagaagcttaccgtagaggatgtagtgaagttccggaatgcagtggcaaaggactactacttccagatgtactatgatgatctcccattgtgggggttcattggtaaagttgagaagggaggcaaggctgatccgagcgagtggaaatactacctgtacaggcacatcatctttgatatcctatacaacaacgaccgggtgatcgaaatcaatgtgcacactgatcagagtgcattggttgacctgacggaggataaggagaccaatgtggaattcctgtactcagtcaagtggaaggaaacaccaacaccattcgagaagaggatggagaagtattccagctcctccaacatgccacaccacctggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactattttctgctgctcttggcacaggaactcaactatttgccctcacaacctttatatttcttcttgcacttgttggagtattctacccctacaaccgtggtgcactatttactgcattggttgtcatctatgcactcacttcaggaattgctggatacgttgctacctctttctattgtcagctggaggggacaaactgggtgaggaacttgctattgacaggatgcctgttctgtggacctctcttcctgacattttgcttcttgaacactgttgctattgcttatagtgcaacagcagcattgccctttggcactatctgtgtcattgtgctcatctggaccttggtcacatttcctttgcttgttttgggaggtattgctggcaaaaacagcaaaagtgaattccaagctccttgccgtaccacaaaataccccagggaaattcctccgcttccctggtacaggagaactgttccacagatggcaatggccgggtttttgcctttcagtgccatatacatcgagctatactacatctttgctagtgtctggggccacaggatttacacaatctacagcattctgtttattgtcttcatcatcctccttattgtcactgcattcatcactgttgcactgacatacttccagcttgctgctgaggaccatgagtggtggtggaggtcattcctatgcggaggatcaactggatttttcgtgtacggctactgcctgtactactactatgcgcgatcagacatgtctggcttcatgcagacatctttcttctttggctacatggcctgcatctgctatgcattcttcttgatgcttgggatggtgggcttccgtgcggccttgttctttgtccgccacatatacaaatctatcaagtgtgagtga

SEQ ID NO: 10086 - protein, 595 aa, Sorghum bicolor
  misc_feature: Ceres ANNOT ID no. 6109059
  misc_feature (55)..(553): Pfam Id: EMP70 Pfam Desc: Endomembrane protein 70
  misc_feature (7)..(595): NCBI GI: 9758717 NCBI Desc: endosomal protein-like [arabidopsis thaliana]
  misc_feature (307)..(595): NCBI GI: 7527721 NCBI Desc: t5e21.15 [arabidopsis thaliana]
  misc_feature (263)..(595): NCBI GI: 8778208 NCBI Desc: f10b6.3 [arabidopsis thaliana]
  misc_feature (13)..(595): NCBI GI: 145323800 NCBI Desc: endomembrane protein 70 family protein [arabidopsis thaliana]
  misc_feature (13)..(595): NCBI GI: 37622957 NCBI Desc: phg1b [dictyostelium discoideum]
  misc_feature: Useful for making plants with altered cell wall content and/or composition
  misc_feature: GREAT-hit functional homolog of the protein sequence encoded by LOCUS at1g14670
  misc_feature: Useful for making plants with altered cell wall content and/or composition
  misc_feature: Functional homolog of the protein sequence given in SEQ ID NO 13589
MAASPAPAAAAALLVLLALAAAGGVAADGSDHRYKMNEPVPLYANKVGPFHNPSETYRYFDLPFCSPEKVREKSEALGEVLNGDRLVDAPYKLDFRLEVESKAVCSKKLTVEDVVKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 10087 - DNA, 2697 bp, Sorghum bicolor
  misc_feature: Ceres ANNOT ID no. 6109085
  misc_feature: Encodes the peptide sequence at SEQ ID NO 10088
atgcctcgctcactcgccggcggtgaccttgccgtaccggagatggcgcagccgtacatgaagaaggacgacgacgacgaagacgtcgagtattcaccattctttgggatcgagaagggggctgttctgcaggaggcacgggctttccatgatccacaacttgatgtgagacgatgttcgcaagtcatcaccaagctattatatttacttaatcaaggagagacattcacgaaggttgaggccacggaagtcttctttgcagtaacaaagttattccagtctagcgatgctggtcttaggaggctagtatatttaatgatcaaagagctctctccatcgtcagatgaggtcatcatagtcacaagctcattgatgaaagatatgaacagcaagacagatatgtaccgtgccaatgctattagagttctttgtagaataattgatggtaccctactaactcaaattgagagatatttgaagcaagctattgttgacaaaaacccagtggttgctagtgctgctcttgttagtggcatccacctggcccaggcaaacccagaaattgtgaaaagatggagcaacgaagtccaggaagctgttcaatcaagagctccacttgtccagtttcatggtctcgctcttcttcaccagattagacagaatgatcgtttggctgttagcaagttagtttctagtttgacaaggggatctgtccgttctcctcttgcacaatgtcttcttattcgttacacaagccaggttatgcgtgagtcaagcatgaacactcaaaatggtgaccgcccattttttgattttctggaatcatccctcagacataaagcagaaatggtggtcctggaagctgcacggaaaataacagagatggatgttacaagccgtgaattggcaccagcgattactgttttacagttatacttgaattcatccaagcctgtgcttcgatttgctgctgtccggactctcaataaggttgctatgacacgccctctggcggtgacaaactgcaacgtagacttggagagtttgatgtcagaccagaacaggagtatagcgaccctggcaatcactactcttcttaaaactggcaatgaatcaagtgtggatcgcctcattaaacaaattaccaatttcatgtctgatatagcagatgaattcaagatagttgttgttgaagctatacggtctctgtgcttgaagttcccactaaaatatcgctcaatgttgaattttttgagcaacagcttgagggaagaagggggctttgagtataaaaaggccatagtggattcaatagttgctttgatcagtgaaataccagatgccaaagaaattggcctgcttcatctctgtgaattcattgaagactgtgaattcacatatctttctagtcagattttgcattttttgggaaatgaagggccaaggacatcagatccaagcagatacattcgctacatttacaaccgcgtgatattggaaaatgcgactgttcgtgctagtgctgtcagcacgttggcaaagtttggtgccctggttgatacgctcaagcctcagatctttgttctcttgcaacgatgcctgtttgatactgaagatgaggttcgtgatcgtgctacactctatctccaaactcttagtggtgaagttgccattggtaacgatgagaaggatgcgaaggacttcctatttggatcctttgacgtgccattagccaacctggaagcaagcctaagaacttatgaaccttcagaagagccatttgacatatctttggtgtcgagagaagtcaggtcgctaccacttaaagagaaggcagcccctggcaagaagccacctgccgctgccgctgcccctgcacctgtttcaaccgttgatgcttatcagaaaatgctttcatccattcctgagttctctgggtttggaagactcttcaagtcctctgaacccatggagctgacagaggcagaaactgaatatgctgttagtgtggttaagcacatttatgacggctacattgtattgcagtacaattgtacaaacactatagaagaacaactgctagaagatgtcactgtttgcgttgatgcctctgatgctgaggagttttcagagatttgttcaaagcctcttacaagcttgccgtataattcacccgggcaagtttttgttgcttttgaaaagccagagggtgtacctgctgttgggaaattttcaaatttgttgaagttcacagttaaagaggttgacacaactacaggggaagctgatgaggatggtgtggaggatgaataccagttagaggactttgaaattgtttcatctgattatatgctgagggttgctgtctccaactttaggaacgcctgggaaaatatggacccagaaagtgagcgtgtcgatgagtatggacttggggttagagaaagtttggctgaggctgtcaatgctgtcattaatatccttgggatgcagccgtgtgagggcactgaggttgtaccaagaaatgcaagatcacacacctgcctgctatctggcgtgtttattggcaacgcgaaggtcctagttaggttgtcatttggactgagtgggcccaacgaagtggcaatgaaattggctgtgagatcagatgactctgaagtcagtgataagattcatgagattgttgccagcggataa

SEQ ID NO: 10088 - protein, 898 aa, Sorghum bicolor
  misc_feature: Ceres ANNOT ID no. 6109085
  misc_feature (38)..(556): Pfam Id: Adaptin_N Pfam Desc: Adaptin N terminal region
  misc_feature (630)..(896): Pfam Id: Gamma-COP Pfam Desc: Coatomer gamma subunit appendage domain
  misc_feature (15)..(898): NCBI GI: 146286093 NCBI Desc: coatomer subunit gamma-1 (gamma-coat protein 1) (gamma-cop 1)
  misc_feature (15)..(566): NCBI GI: 7270395 NCBI Desc: nonclathrin coat protein gamma-like protein [arabidopsis thaliana]
  misc_feature (230)..(898): NCBI GI: 110741159 NCBI Desc: nonclathrin coat protein gamma - like protein [arabidopsis thaliana]
  misc_feature (15)..(891): NCBI GI: 8567340 NCBI Desc: coatomer protein complex, subunit gamma 2 [mus musculus]
  misc_feature (15)..(891): NCBI GI: 66910281 NCBI Desc: copg2 protein [danio rerio]
MPRSLAGGDLAVPEMAQPYMKKDDDDEDVEYSPFFGIEKGAVLQEARAFHDPQLDVRRCSQVITKLLYLLNQGETFTKVEATEVFFAVTKLFQSSDAGLRRLVYLMIKELSPSSDEVIIVTSSLMKDMNSKTDMYRANAIRVLCRIIDGTLLTQIERYLKQAIVDKNPVVASAALVSGIHLAQANPEIVKRWSNEVQEAVQSRAPLVQFHGLALLHQIRQNDRLAVSKLVSSLTRGSVRSPLAQCLLIRYTSQVMRESSMNTQNGDRPFFDFLESSLRHKAEMVVLEAARKITEMDVTSRELAPAITVLQLYLNSSKPVLRFAAVRTLNKVAMTRPLAVTNCNVDLESLMSDQNRSIATLAITTLLKTGNESSVDRLIKQITNFMSDIADEFKIVVVEAIRSLCLKFPLKYRSMLNFLSNSLREEGGFEYKKAIVDSIVALISEIPDAKEIGLLHLCEFIEDCEFTYLSSQILHFLGNEGPRTSDPSRYIRYIYNRVILENATVRASAVSTLAKFGALVDTLKPQIFVLLQRCLFDTEDEVRDRATLYLQTLSGEVAIGNDEKDAKDFLFGSFDVPLANLEASLRTYEPSEEPFDISLVSREVRSLPLKEKAAPGKKPPAAAAAPAPVSTVDAYQKMLSSIPEFSGFGRLFKSSEPMELTEAETEYAVSVVKHIYDGYIVLQYNCTNTIEEQLLEDVTVCVDASDAEEFSEICSKPLTSLPYNSPGQVFVAFEKPEGVPAVGKFSNLLKFTVKEVDTTTGEADEDGVEDEYQLEDFEIVSSDYMLRVAVSNFRNAWENMDPESERVDEYGLGVRESLAEAVNAVINILGMQPCEGTEVVPRNARSHTCLLSGVFIGNAKVLVRLSFGLSGPNEVAMKLAVRSDDSEVSDKIHEIVASG

SEQ ID NO: 10089 - DNA, 1266 bp, Sorghum bicolor
  misc_feature: Ceres ANNOT ID no. 6109086
  misc_feature: Encodes the peptide sequence at SEQ ID NO 10090
atggcctgctgcttcctccgcgtcgctgcggcgccccgcctcctcctctaccgcgccgccgcttcgcggcagctcccgtcgccactcaccgtattcaggaagggtttttcggagcagtcagttctgccagtcacagactcgtctgagtgttttcaaggaccatcagtgcagaatactccacggattccactgtatgatgacagcatatcctcaagcatattagacacattgtcgaatccgactgaggttgtccctcatgctgatccttcaaagagcagaataatgctagttgacggaacgtcggttatgtacagatcctactacaagatattagcacagctgcagcacggccagttggagcatgctgatggaaatggggattgggttttaactatattcaaagctctatccctgcttcttgacatgctggagttcattccatctcatgctgcggttgtgtttgatcacgatggagttccatatggtcattatactgccatgccatccaaagaatgtcacatggcaaaaggaatgacctttcgtcatatgttgtaccctgcttacaagagcaaccgcactccaacacccgacacagttgtccagggcatgcaatacttgaaggcatccattaaggcgatgtcaataaaagtaattgaggttccaggcgttgaagctgatgatgttattggcaccctggccgtaaacagtgtttcagctggttacaaggtacggattgtctctcctgataaagacttcttccaaattttgtcaccttctttgcgtctgctcaggattgctccacgtggatcagggatggtttcatttggagttgaagacttcgtcaagcgatatggagcactgaaaccctcacagtttgttgatgttgttgcactttcaggagacaaagctgacaatatacctggagttgaggggattggagatattaatgcagtaaagctgataaccaagttcggttccttggagaatctactgaaatccgtggatgaagttgaggatgatcggattaaacaggctttgatttctcactcggaacaggcaatcctttgcaaaagcctggccacgttgcgttctgatcttccttcttatatggttcctttcaagacagccgaccttgcatataagaagccacaggatgatggagtcaaattcataaaactcttacgagcattggaagcatatgcagaaggctcctcagcagacccaatcatcagaagagcaacctatctttggaacaaactaaaatga

SEQ ID NO: 10090 - protein, 421 aa, Sorghum bicolor
  misc_feature: Ceres ANNOT ID no. 6109086
  misc_feature (287)..(390): Pfam Id: 5_3_exonuc Pfam Desc: 5'-3' exonuclease, C-terminal SAM fold
  misc_feature (92)..(284): Pfam Id: 5_3_exonuc_N Pfam Desc: 5'-3' exonuclease, N-terminal resolvase-like domain
  misc_feature (51)..(421): NCBI GI: 42565846 NCBI Desc: 5'-3' exonuclease family protein [arabidopsis thaliana]
  misc_feature (51)..(421): NCBI GI: 145332809 NCBI Desc: 5'-3' exonuclease family protein [arabidopsis thaliana]
  misc_feature (51)..(421): NCBI GI: 145332811 NCBI Desc: 5'-3' exonuclease family protein [arabidopsis thaliana]
  misc_feature (165)..(325): NCBI GI: 140070037 NCBI Desc: helix-hairpin-helix motif, class 2 [medicago truncatula]
  misc_feature (179)..(398): NCBI GI: 4090935 NCBI Desc: dna polymerase type i [rhodothermus sp. 'iti 518']
MACCFLRVAAAPRLLLYRAAASRQLPSPLTVFRKGFSEQSVLPVTDSSECFQGPSVQNTPRIPLYDDSISSSILDTLSNPTEVVPHADPSKSRIMLVDGTSVMYRSYYKILAQLQHGQLEHADGNGDWVLTIFKALSLLLDMLEFIPSHAAVVFDHDGVPYGHYTAMPSKECHMAKGMTFRHMLYPAYKSNRTPTPDTVVQGMQYLKASIKAMSIKVIEVPGVEADDVIGTLAVNSVSAGYKVRIVSPDKDFFQILSPSLRLLRIAPRGSGMVSFGVEDFVKRYGALKPSQFVDVVALSGDKADNIPGVEGIGDINAVKLITKFGSLENLLKSVDEVEDDRIKQALISHSEQAILCKSLATLRSDLPSYMVPFKTADLAYKKPQDDGVKFIKLLRALEAYAEGSSADPIIRRATYLWNKLK

SEQ ID NO: 10091 - DNA, 501 bp, Sorghum bicolor
  misc_feature: Ceres ANNOT ID no. 6109096
  misc_feature: Encodes the peptide sequence at SEQ ID NO 10092
atgatccaggcggtgatggtgatcagcacccaggccaagccccgcctcctcaagttttataatttccagccacccgagaagcatcaggacctcgtccgcagtgtcttccaattactctctgcaaggcctgacagcgtgagcaattttgtcaaggtggactccatatttggcccgggaacaaaaatggtctacaagcatttggccacactatactttgtttttgtatttgatagctctgagaatgagcttgccatgctcgatctgattcaagtttttgttgaaacattggacaaatgcttcaagaatgtatgcgagcttgacattgtgtttaacttcaacaagctgcacacgattttggatgagatgatattgggcggacaggtgatcgaaacgagttcagaacaaataatgaaatccgtggaagagattgaaagactggagaaacaatcgagcacaaccagtttcatacccaagtcaattacagagcgttttacccgttaa

SEQ ID NO: 10092 - protein, 166 aa, Sorghum bicolor
  misc_feature: Ceres ANNOT ID no. 6109096
  misc_feature (1)..(147): Pfam Id: Clat_adaptor_s Pfam Desc: Clathrin adaptor complex small chain
  misc_feature (8)..(145): NCBI GI: 144924637 NCBI Desc: longin-like [medicago truncatula]
  misc_feature (1)..(157): NCBI GI: 25151042 NCBI Desc: adaptin or adaptin-related protein (22.1 kd) (apt-8) [caenorhabditis elegans]
  misc_feature (1)..(157): NCBI GI: 48142301 NCBI Desc: similar to cg3029-pa [apis mellifera]
  misc_feature (1)..(157): NCBI GI: 5031581 NCBI Desc: adaptor-related protein complex 3, sigma 2 subunit [homo sapiens]
  misc_feature (1)..(157): NCBI GI: 119622476 NCBI Desc: adaptor-related protein complex 3, sigma 2 subunit, isoform cra_a [homo sapiens]
MIQAVMVISTQAKPRLLKFYNFQPPEKHQDLVRSVFQLLSARPDSVSNFVKVDSIFGPGTKMVYKHLATLYFVFVFDSSENELAMLDLIQVFVETLDKCFKNVCELDIVFNFNKLHTILDEMILGGQVIETSSEQIMKSVEEIERLEKQSSTTSFIPKSITERFTR

SEQ ID NO: 10093 - DNA, 372 bp, Sorghum bicolor
  misc_feature: Ceres ANNOT ID no. 6109107
  misc_feature: Encodes the peptide sequence at SEQ ID NO 10094
atggaggttgtgattcatgatggagtgattagagaaaaacctagcactccagaagaggcacggaaattcatcaaagggtactctgaaagccatgctgcgacgattggatctgtgcttgttacaaatgtgaagactggagctagaagggaaggatgggataaagcagaagtttatttccataaaattcctgatgaagttgtggagagtttgattgaggagggtaacgttttctatgtcgctggtggtctccttgtggagcatcccctaacttcccctcttgtggaagccattgttggtacaattgatagtgtaatggggctacctaaagcgctcacggagaagctcatcaaggaatccctttcggagccatag

SEQ ID NO: 10094 - protein, 123 aa, Sorghum bicolor
  misc_feature: Ceres ANNOT ID no. 6109107
  misc_feature (2)..(123): NCBI GI: 115451707 NCBI Desc: os03g0229600 [oryza sativa (japonica cultivar-group)]
  misc_feature (3)..(120): NCBI GI: 77551376 NCBI Desc: maf-like protein [oryza sativa (japonica cultivar-group)]
  misc_feature (3)..(120): NCBI GI: 22328154 NCBI Desc: maf family protein [arabidopsis thaliana]
  misc_feature (3)..(120): NCBI GI: 144924633 NCBI Desc: maf-like protein [medicago truncatula]
  misc_feature (2)..(118): NCBI GI: 145343440 NCBI Desc: septum formation protein maf-like protein [ostreococcus lucimarinus cce9901]
MEVVIHDGVIREKPSTPEEARKFIKGYSESHAATIGSVLVTNVKTGARREGWDKAEVYFHKIPDEVVESLIEEGNVFYVAGGLLVEHPLTSPLVEAIVGTIDSVMGLPKALTEKLIKESLSEP

SEQ ID NO: 10095 - DNA, 540 bp, Sorghum bicolor
  misc_feature: Ceres ANNOT ID no. 6109560
  misc_feature: Encodes the peptide sequence at SEQ ID NO 10096
atggctccctgtcactgcgcaatgctcccactcttctgtagcctcgtcttctccatggcggcagctgtcgtcggagagaccggcggcgacgtcgggcgcccgacgcacctgcatttctacttccacgagaacttctcaggcggccccaacggcacgacggtggtggtgtccaaggtgcgcggcggcagcaataacagctcgttcttcggcggtgtgtttgtcgtcgacgacatgctccgggagggcccggacccggcgtcccaactcctcggccgcgcgcaggggctcaccgtcggcacgtcactctccgacggcgcgctcctgacggtgcttaacttcgtgttcacggagggcgcctacagcggcagctccctgacgctcctcggccgcgccctgctgggcacggtcatggagaggcccatcgtcggcggcacgggcgtgttccggatggcgcgcgggtatacgcttagcaagatggttcagtcgccggaccccaacaacttgcttgtcctggagtacgacgcctacatttggcactag

SEQ ID NO: 10096 - protein, 179 aa, Sorghum bicolor
  misc_feature: Ceres ANNOT ID no. 6109560
  misc_feature (16)..(179): Pfam Id: Dirigent Pfam Desc: Dirigent-like protein
  misc_feature (35)..(176): NCBI GI: 115461162 NCBI Desc: os04g0666800 [oryza sativa (japonica cultivar-group)]
  misc_feature (23)..(179): NCBI GI: 88771157 NCBI Desc: dirigent-like protein pdir17 [picea sitchensis]
  misc_feature (8)..(179): NCBI GI: 88771125 NCBI Desc: dirigent-like protein pdir1 [picea glauca]
  misc_feature (35)..(158): NCBI GI: 71040679 NCBI Desc: disease resistance-responsive family protein [arachis hypogaea]
  misc_feature (1)..(179): NCBI GI: 88771137 NCBI Desc: dirigent-like protein pdir7 [picea glauca]
MAPCHCAMLPLFCSLVFSMAAAVVGETGGDVGRPTHLHFYFHENFSGGPNGTTVVVSKVRGGSNNSSFFGGVFVVDDMLREGPDPASQLLGRAQGLTVGTSLSDGALLTVLNFVFTEGAYSGSSLTLLGRALLGTVMERPIVGGTGVFRMARGYTLSKMVQSPDPNNLLVLEYDAYIWH

SEQ ID NO: 10097 - DNA, 1245 bp, Sorghum bicolor
  misc_feature: Ceres ANNOT ID no. 6109672
  misc_feature: Encodes the peptide sequence at SEQ ID NO 10098
atgaaccacaccgcacggctcacgtcgaccagaccactcctgaaaagcaagcgaattgaaatggcgccaagttcgccgcgcctcctcgtggccgtggtggcggcgcttctacacgccgccgccgccgtggcagccggcaacggagggcccctgacgcgctacgatcgtgttttcagctttggcgactccctcaccgacaccgggaacgcgctgcacctctcagcaaccgccggcggaccagcgagccgtccgccgtacggcgagactttcttccgtcgccctaccggccgctcctccgacggccgcctcgtcatcgacttcctcgtcgaggcgctgggcgtacctcacccgacgccgtacctcgccggcaagacggcggcggatttccggcgcggcgtgaacttcgcgttcggcggggcgacggcgctcgacctgcacttcttcgagagcagaggattgatgtcgttcgtgccggtttcgcttaggaaccagaccgtctggttcaacgacgttgtacgacgtgttggcgcagagccagagcagaggaagagcatggccacctccgtcttcctcgtcggagagatcggagtcaacgactacttcatcggcctcaacgagaaccgcaccgtcggcgaggtgcacaccttcgtgcctcacgtcgtcagtgccatccgttcggtcatcaccgacgtgatcgccgccggagcaagcacggtggtggtgccggggatgataccgctgggctgcgagccgcagctgctcacgctctacagaggcagcgtcgacgccgccgggtatgaccgggggtccggctgcatcaggagtctcaacggcctcgccgagctgcacaaccgcgagctgcgccgcgtgctcgggggcctccggcgagcgcaccccggcacgaccatcgtctacgcggacctctaccgtgcggtcaccgacatcatcgtgtcgccgcgcgaatacggtttcgggcacaggccgctggacgcgtgctgtggtggtggcggcggcgcgtacaactacgacgacgctgcgttctgcggcgcggcgcgggcggcggcgtgcgcggacccgtctgagtacgtctcctgggatggggtgcactacacggacgccgccaacaggctcatcgcctgcagcgtgctcgacgggtctcactcccacggcgccgacgccatgacgctgtccaactcatcggccacaatggaggattggcttcacaggatcggctgcgtcgtctag

SEQ ID NO: 10098 - protein, 414 aa, Sorghum bicolor
  misc_feature: Ceres ANNOT ID no. 6109672
  misc_feature (57)..(382): Pfam Id: Lipase_GDSL Pfam Desc: GDSL-like Lipase/Acylhydrolase
  misc_feature (24)..(385): NCBI GI: 115473671 NCBI Desc: os07g0642200 [oryza sativa (japonica cultivar-group)]
  misc_feature (27)..(378): NCBI GI: 54290849 NCBI Desc: lanatoside 15'-o-acetylesterase-like [oryza sativa (japonica cultivar-group)]
  misc_feature (21)..(327): NCBI GI: 115462629 NCBI Desc: os05g0210400 [oryza sativa (japonica cultivar-group)]
  misc_feature (54)..(388): NCBI GI: 10764858 NCBI Desc: f1k23.17 [arabidopsis thaliana]
  misc_feature (10)..(388): NCBI GI: 115435276 NCBI Desc: os01g0215700 [oryza sativa (japonica cultivar-group)]
MNHTARLTSTRPLLKSKRIEMAPSSPRLLVAVVAALLHAAAAVAAGNGGPLTRYDRVFSFGDSLTDTGNALHLSATAGGPASRPPYGETFFRRPTGRSSDGRLVIDFLVEALGVPHPTPYLAGKTAADFRRGVNFAFGGATALDLHFFESRGLMSFVPVSLRNQTVWFNDVVRRVGAEPEQRKSMATSVFLVGEIGVNDYFIGLNENRTVGEVHTFVPHVVSAIRSVITDVIAAGASTVVVPGMIPLGCEPQLLTLYRGSVDAAGYDRGSGCIRSLNGLAELHNRELRRVLGGLRRAHPGTTIVYADLYRAVTDIIVSPREYGFGHRPLDACCGGGGGAYNYDDAAFCGAARAAACADPSEYVSWDGVHYTDAANRLIACSVLDGSHSHGADAMTLSNSSATMEDWLHRIGCVV

SEQ ID NO: 10099 - DNA, 2328 bp, Sorghum bicolor
  misc_feature: Ceres ANNOT ID no. 6109775
  misc_feature: Encodes the peptide sequence at SEQ ID NO 10100
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggagactactagcacaacaaatgagcagcctggtaggggggcaatgtgggagctggaaaggaatctcgatcagcccatggatgcagaggccgggagattgaggaatatgtacagggaaaagacctaccctacaattgtgctgttacaactagctttccaaagcctcggtgtggtgtttggggatttaggcacatcgcctttatatgtattctataacattttccctcgtgaaatagaagacacggaacaagttattggagcactctcgcttattatttactcccttaccctgattccacttgttaaatacgtcttcattgtcttgagggcaaacgataatggccaaggtggaacatttgctctttactcactgctttgccggcatgcaaagataaacattattccgaatcagcatagaacagatgaagacctaacaacatacagccgccacacatatgatgagaaatctcttgctgcaaagattaaaagatggttagaggggcaccaaatcaggaagaatgccattcttattcttgttctttttggtacttgtatggcagttggagatggaatcctcactcctgcaatatcagttctttctgcaactggaggaatacaagtggagcagcccagaatgagaaatgatgtggttgtcatcgtctctgtggttatattgattggattattcagcatgcagcactttggtactgataaagtcagttggctttttgctccaatagtatttgtttggttcatactcattggagtcctgggcgccgtaaacatttccaaatacgatcaatctgttctcaaggcttttaatcctatttatgtatatcggtactttaagcgagggaagactagctgggcttctttaggaggaattatgcttagcattacagggacagaagcattgtttgctgatctttcatatttccctgtacaagctattcagattgctttcacggtggttgtgtttccatgccttcttttgcagtatacgggccaagctgcctatatagctcagaacaaagaccatgtctcccatgccttctatttttcccttccagctgctgcagtagttgctagtcaggcaactatatcgatgacctattcaattatcaagcaagcacttgctctagggtgcttccccagagtgagaattatccatacttccaagaaatatctaggccaaatatacagtcctgatattaattggatccttttgatattctgcatcgctgtcactgctggatttaaaaaccaaagtcagatagcaaatgcatatggtactgctgtgataatggttatgcttgtgacaacatttctcatgatccccataatgctgctggtgtggcgcagccactggaccttggtcattcttttcaccacgctgtcattggttattgaaattccatacttcactgctgtggtgcggaagatcgatcagggtggttgggttccacttgtgtttgctgttgccttcctcatcatcatgtatgtatggcactatggtacactcaagcggtatgaattcgagatgcacagcaaggtatccatggcgtggatcctaggccttggcccaagccttggtctggtcagggtgcctggtgtaggcctggtttacaccgagctggcgagtggtgtccctcacatcttctcacacttcatcaccaatctccctgccatccactccactctggtcttcgtctgtgtgaaataccttcctgtttacactgtgccactagatgaaaggttccttgtgaagcgaattggtcccaagaacttccacatgtttagatgtgtggcgcggtatggctacaaggacatccacaagaaggatgacgacttcgagcagatgctctttaacagcctgatgctctatatcaggctggagagtatgatggaagagtacacggattctgatgactacagcacccgtgagctgaaccaggcaggcaacgccaaccaaagaatcaatggcatcagcaccagttcaaacatggatctcagctatacatcccatgactccattatacaggtgcagtccccaaatcatatagggaacagccaggttgtgtcatcaggtcagatgtaccagactgtgggcgacgagattgcgtttctgaacgcgtgcagggacgctggtgtggtgcacatcctagggaacacgattgtcagggcccgtagggattcagggttcatcaagaagtttgctatcaactacatgtatgctttccttaggaagatctgcagggagaacagtgccatcttcaatgttccccatgagagccttctgaatgttgggcaggtgttctatgtgtaa

SEQ ID NO: 10100 - protein, 775 aa, Sorghum bicolor
  misc_feature: Ceres ANNOT ID no. 6109775
  misc_feature (50)..(775): Pfam Id: K_trans Pfam Desc: K+ potassium transporter
  misc_feature (8)..(775): NCBI GI: 82592898 NCBI Desc: probable potassium transporter 11 (oshak11)
  misc_feature (8)..(775): NCBI GI: 113565430 NCBI Desc: os04g0613900 [oryza sativa (japonica cultivar-group)]
  misc_feature (9)..(775): NCBI GI: 79324347 NCBI Desc: kup11; potassium ion transporter [arabidopsis thaliana]
  misc_feature (187)..(775): NCBI GI: 38568028 NCBI Desc: osjnba0070c17.23 [oryza sativa (japonica cultivar-group)]
  misc_feature (337)..(775): NCBI GI: 7268791 NCBI Desc: potassium transporter-like protein [arabidopsis thaliana]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 279 in the 11/188,298 US application
METTSTTNEQPGRGAMWELERNLDQPMDAEAGRLRNMYREKTYPTIVLLQLAFQSLGVVFGDLGTSPLYVFYNIFPREIEDTEQVIGALSLIIYSLTLIPLVKYVFIVLRANDNGQGGTFALYSLLCRHAKINIIPNQHRTDEDLTTYSRHTYDEKSLAAKIKRWLEGHQIRKNAILILVLFGTCMAVGDGILTPAISVLSATGGIQVEQPRMRNDVVVIVSVVILIGLFSMQHFGTDKVSWLFAPIVFVWFILIGVLGAVNISKYDQSVLKAFNPIYVYRYFKRGKTSWASLGGIMLSITGTEALFADLSYFPVQAIQIAFTVVVFPCLLLQYTGQAAYIAQNKDHVSHAFYFSLPAAAVVASQATISMTYSIIKQALALGCFPRVRIIHTSKKYLGQIYSPDINWILLIFCIAVTAGFKNQSQIANAYGTAVIMVMLVTTFLMIPIMLLVWRSHWTLVILFTTLSLVIEIPYFTAVVRKIDQGGWVPLVFAVAFLIIMYVWHYGTLKRYEFEMHSKVSMAWILGLGPSLGLVRVPGVGLVYTELASGVPHIFSHFITNLPAIHSTLVFVCVKYLPVYTVPLDERFLVKRIGPKNFHMFRCVARYGYKDIHKKDDDFEQMLFNSLMLYIRLESMMEEYTDSDDYSTRELNQAGNANQRINGISTSSNMDLSYTSHDSIIQVQSPNHIGNSQVVSSGQMYQTVGDEIAFLNACRDAGVVHILGNTIVRARRDSGFIKKFAINYMYAFLRKICRENSAIFNVPHESLLNVGQVFYV

SEQ ID NO: 10101 - DNA, 1767 bp, Sorghum bicolor
  misc_feature: Ceres ANNOT ID no. 6109778
  misc_feature: Encodes the peptide sequence at SEQ ID NO 10102
atgtacctgaccgccgtttccttcgcccccgcagccggcttctcgccctcatctcagcagctgctgcctaggtcggccagggtcggccgccgcctggtggtccgggcagacgtcaaggtcatatcgaccggcgaggcctgccgtcgtgggctcgccgccggcatcgacaagctcgccgacgccgtcgccgtcaccctcggccccaaagggaggaatgttgttattgaccaagatgatgtacctaaagtaattaatgatggtgtcacaattgccaaggctatagagctcccaaatgcgcttgagcatgcaggtgccacgctacttcaagaggtaagccagatagcatccaagacaaatagtgctgttggcgatggaactacaacagcaattgttttggctcgggaaatcatcaatcttgggttgttggcagttgcaactggtgctaacccagttgcattgagaaggggtattgacaaagccgttcatgagctaattaagatcttgaagagtaaatgtatccctgtgagtacaaaggaggacataaaagctgttgcttcaatatcatctggcaatgatgaatatgttggcaatctcattgctgatgcaatggagaagataggtcctgatggtataatcaaaattgagtcatcatcttcaatatacacgacagttgaggtccaggaaggaatgaagatagacaagggatatgtttctccatacttcatcacaaatcaagacaaagcaatcgttgaatttgaaaatgctagagtgcttttaactgatcagcgtgtgaacgaagtccaagagatacttcccttgctggagaagacaacacagttgagtgtccctttattaattattgctgaggatgtgtcacatgaggtgtattcaacactggttcttaacaaactgaatggattgctaaatgttgcggtcgttaaatgtcctgggttgggagatgaaaagaaggctattctccaagatattgctattatgacaggtgcagatttctttgctagtgaccttggctggggtcttcatggcattacttctgatcagcttggtatggctcagaaaatcacaataactagtgaatctacaactatcatagcacatccttcaatgagaccagagatcgaggccagaatcatgcaactgaaaaaagatctagaggagacaacgagttcctatctaaaggaaaggttctctgcgagaatcgctaaactttcgagaggtgttggagtcatcaaggttggggcggccactgaagctgaactcgaggataggaaactgagagtggaggatgcaaagaatgcaacttttgcagccattagtgaaggcataactcctggtggtggggtgacatatgttcatttatcaaagcatattcccagtatcatggacctagttgatgatgcagaagagaagatgggtgtaaatatagttgggaaggcacttcttgtccctgctatgacaatagctcgcaatgccggggcagaaggtccagctgttgtggagaagcttctcgccagtgagtggcgggttggttacaacgcaatgactggcgagtttgaagaccttgttgctgctggtgtggtggacccatgcagggtcgcaagatgcgtgctccagaactctgcttctatcgcagggctgattcttatgactcaagctatgatgtttgacaaggtaaagaagaaaaagtcccccatcccagatattcctggtattccaccgttacagataagccaaaaggctaaggcttga

SEQ ID NO: 10102 - protein, 588 aa, Sorghum bicolor
  misc_feature: Ceres ANNOT ID no. 6109778
  misc_feature (58)..(564): Pfam Id: Cpn60_TCP1 Pfam Desc: TCP-1/cpn60 chaperonin family
  misc_feature (183)..(586): NCBI GI: 115480691 NCBI Desc: os09g0563300 [oryza sativa (japonica cultivar-group)]
  misc_feature (31)..(567): NCBI GI: 1351030 NCBI Desc: rubisco subunit binding-protein alpha subunit, chloroplast precursor (60 kda chaperonin alpha subunit) (cpn-60 alpha)
  misc_feature (18)..(573): NCBI GI: 77554291 NCBI Desc: rubisco subunit binding-protein alpha subunit, chloroplast precursor(60 kda chaperonin alpha subunit) (cpn-60 alpha) [oryza sativa (japonica cultivar-group)]
  misc_feature (31)..(563): NCBI GI: 124301264 NCBI Desc: groel-like chaperone, atpase [medicago truncatula]
  misc_feature (31)..(567): NCBI GI: 1710807 NCBI Desc: rubisco subunit binding-protein alpha subunit, chloroplast precursor (60 kda chaperonin alpha subunit) (cpn-60 alpha)
  misc_feature: Useful for making plants with modulated nitrogen use efficiency
  misc_feature: Functional homolog of the protein sequence given in SEQ ID NO 13023
MYLTAVSFAPAAGFSPSSQQLLPRSARVGRRLVVRADVKVISTGEACRRGLAAGIDKLADAVAVTLGPKGRNVVIDQDDVPKVINDGVTIAKAIELPNALEHAGATLLQEVSQIASKTNSAVGDGTTTAIVLAREIINLGLLAVATGANPVALRRGIDKAVHELIKILKSKCIPVSTKEDIKAVASISSGNDEYVGNLIADAMEKIGPDGIIKIESSSSIYTTVEVQEGMKIDKGYVSPYFITNQDKAIVEFENARVLLTDQRVNEVQEILPLLEKTTQLSVPLLIIAEDVSHEVYSTLVLNKLNGLLNVAVVKCPGLGDEKKAILQDIAIMTGADFFASDLGWGLHGITSDQLGMAQKITITSESTTIIAHPSMRPEIEARIMQLKKDLEETTSSYLKERFSARIAKLSRGVGVIKVGAATEAELEDRKLRVEDAKNATFAAISEGITPGGGVTYVHLSKHIPSIMDLVDDAEEKMGVNIVGKALLVPAMTIARNAGAEGPAVVEKLLASEWRVGYNAMTGEFEDLVAAGVVDPCRVARCVLQNSASIAGLILMTQAMMFDKVKKKKSPIPDIPGIPPLQISQKAKA

SEQ ID NO: 10103 - DNA, 1335 bp, Sorghum bicolor
  misc_feature: Ceres ANNOT ID no. 6109806
  misc_feature: Encodes the peptide sequence at SEQ ID NO 10104
atggcctccgccgccgccgtgactctccggcgcgtggtgcttgtgtccgccgcgctgcggctggcactggtggtgttcggggagtggcaggatgcccacctcgaggtgcgctataccgacgtcgactacctcgtcttctccgacgccgccgcctctgtggccgccggcggttccccgttcgcccgcgcgacctaccgctactctccaatcctggccttcctgcttctcccgaactcactcctccatgctgcctggggcaagctcctcttctccgccgcagatttgctcgtagggttgttcatagacaccattctggaactaagaggaattcctgagaaaatgcggatgtggtctgtggtagcttggctgttcaatcccttcacattcactattggtacaagaggaaactgcgaaccaatagtctgcgcagtcatgctctggattctcatatgtttgatgaagggtagagtattgcaggcagctttctggtatgggcttattgtgcacttcagaatatacccaatcatatacgcgattccttttgtaatagttcttggcaagggctatgctggtcctgttggtaggcctactcttacaatgtggaggtccaaacaacagttgcaaaatgacgaagtcagtcaaatagaagaaccaacatcatttgtggccactgtatggggtttcctttcaaacttcataagcagaaatgcaatcctgtttggattactctctggatctgtgttctttgcctggactggtattttcttctatctttatggttgggacttcctaaatgaagcattactttaccatcttactcgtaccgacccaagacacaatttctcgatatatttctaccacatatatctacatcatcagcaagggttctcaagtattcagaggcttgcttcatttcttcctcaactgatcgtgcaactggcactcattctacgcttctctagggatcttccattctgcatgtttctccaaacggttgcatttgttgcttttaacaaggtgatgacggcacaatacttcgtgtggttcttctgcctgttgcccctcattctcccttggagcagcatgaaacttaagtggaagggtctggcttgtacggtagtgtggatggggtcccagctgcattggctcatgtgggcttacctgctggaattcaagggcagaaacgtttttgtgcagctctgggttgcaggcctcatgtttctggctgcgaacacctttattatgctcatggtgatgaagcaccacaactacactcagctcttctcattgccggtgaagtctggcaacaaggttgctaccaagaaggaagaatag

SEQ ID NO: 10104 - protein, 444 aa, Sorghum bicolor
  misc_feature: Ceres ANNOT ID no. 6109806
  misc_feature (131)..(419): Pfam Id: Mannosyl_trans Pfam Desc: Mannosyltransferase (PIG-M)
  misc_feature (156)..(443): NCBI GI: 50881457 NCBI Desc: mannosyltransferase (pig-m) domain containing protein [oryza sativa (japonica cultivar-group)]
  misc_feature (5)..(443): NCBI GI: 140038714 NCBI Desc: mannosyltransferase, dxd [medicago truncatula]
  misc_feature (10)..(444): NCBI GI: 22326970 NCBI Desc: mannosyltransferase family protein [arabidopsis thaliana]
  misc_feature (10)..(444): NCBI GI: 31872096 NCBI Desc: peanut1 [arabidopsis thaliana]
  misc_feature (137)..(444): NCBI GI: 13374872 NCBI Desc: mannosyltransferase-like protein [arabidopsis thaliana]
MASAAAVTLRRVVLVSAALRLALVVFGEWQDAHLEVRYTDVDYLVFSDAAASVAAGGSPFARATYRYSPILAFLLLPNSLLHAAWGKLLFSAADLLVGLFIDTILELRGIPEKMRMWSVVAWLFNPFTFTIGTRGNCEPIVCAVMLWILICLMKGRVLQAAFWYGLIVHFRIYPIIYAIPFVIVLGKGYAGPVGRPTLTMWRSKQQLQNDEVSQIEEPTSFVATVWGFLSNFISRNAILFGLLSGSVFFAWTGIFFYLYGWDFLNEALLYHLTRTDPRHNFSIYFYHIYLHHQQGFSSIQRLASFLPQLIVQLALILRFSRDLPFCMFLQTVAFVAFNKVMTAQYFVWFFCLLPLILPWSSMKLKWKGLACTVVWMGSQLHWLMWAYLLEFKGRNVFVQLWVAGLMFLAANTFIMLMVMKHHNYTQLFSLPVKSGNKVATKKEE

SEQ ID NO: 10105 - DNA, 963 bp, Sorghum bicolor
  misc_feature: Ceres ANNOT ID no. 6109818
  misc_feature: Encodes the peptide sequence at SEQ ID NO 10106
atgatggctgcggctaatggaatagtagtccgtgcatccacaaaggaacccttgttttcctttggtgtcatagctgatgttcagtatgctgatatcccagatggccgctcgttcctcggtgtcccacgatactaccgccacagcatcagcgtcctccaaagggctgtcaacaggtggaacgaacaaggcagcatcaagttctcgatcaattttggcgacatcattgatggttactgcccaaaggataaatcattatgggcggtgcagaaggtccttgatgaatttgacaagtttgatggcccaacatatcacatgattggcaaccactgcctgtacaaccttccgcgcagcaagctggtgtctctgcttaagatttcaacagattctgatcacgcttattatgacttctcgccatgccccgggttcagaatcgttgttctagatgcttatgacttcagttgccttggctggcccaatgatcatcctgtgactgcagcagcaatgaagctactggatgagaagaacccaaacactgacaagaacagccctgatggtctggtcggcgtcgacaggcggttcgtgaagttcaatggcgcagttggcaaggagcagctgtcctggctcaatggtgtccttaaggacgcatcgacgcaccatcaaaatgtcatcatatgcagccatctcccaatggatcccggggcatcttcccctgcagctctcatgtggaactacgatgaggtgatggctattgttcaccggtacaactgtgtcaaggcctgctttgccgggcatgaccacaagggtggccactctgtggactcacacggtgtgcaccaccgcaccctcgaggctgccttggagtgtcctcctggcaccagcgcatttggtcatgtcgaagtgtatcctgacaggctgctgcttgtaggtgttgacagaatggctaatactgagatccctttctaa

SEQ ID NO: 10106 - protein, 320 aa, Sorghum bicolor
  misc_feature: Ceres ANNOT ID no. 6109818
  misc_feature (19)..(268): Pfam Id: Metallophos Pfam Desc: Calcineurin-like phosphoesterase
  misc_feature (6)..(318): NCBI GI: 42407941 NCBI Desc: calcineurin-like phosphoesterase family-like [oryza sativa (japonica cultivar-group)]
  misc_feature (124)..(309): NCBI GI: 51703361 NCBI Desc: mgc79502 protein [xenopus tropicalis]
  misc_feature (128)..(309): NCBI GI: 33416711 NCBI Desc: mds006-prov protein [xenopus laevis]
  misc_feature (195)..(311): NCBI GI: 68551780 NCBI Desc: metallophosphoesterase [prosthecochloris aestuarii dsm 271]
  misc_feature (43)..(185): NCBI GI: 47124497 NCBI Desc: x 006 protein [homo sapiens]
MMAAANGIVVRASTKEPLFSFGVIADVQYADIPDGRSFLGVPRYYRHSISVLQRAVNRWNEQGSIKFSINFGDIIDGYCPKDKSLWAVQKVLDEFDKFDGPTYHMIGNHCLYNLPRSKLVSLLKISTDSDHAYYDFSPCPGFRIVVLDAYDFSCLGWPNDHPVTAAAMKLLDEKNPNTDKNSPDGLVGVDRRFVKFNGAVGKEQLSWLNGVLKDASTHHQNVIICSHLPMDPGASSPAALMWNYDEVMAIVHRYNCVKACFAGHDHKGGHSVDSHGVHHRTLEAALECPPGTSAFGHVEVYPDRLLLVGVDRMANTEIPF

SEQ ID NO: 10107 - DNA, 438 bp, Sorghum bicolor
  misc_feature: Ceres ANNOT ID no. 6110003
  misc_feature: Encodes the peptide sequence at SEQ ID NO 10108
atggcggccgccgcgctgagggagcagctcaacgccctcctctcctccatgttctcctcgggtctggtggacgaccagttccagcagctgcagatgctgcaggaagacgggggcacgccgggcttcgtcgccgaggtcgtcaccctcttctgcgacgacgccgacaggatcatctccgagctcgccgccctgctggagcagcccatcgtggactttgataaggtggacgcctacgtgcatcagctcaaagggagcagcgccagtgttggtgctcagaaagtgaagtttacttgcatgcagttccgtcagttatgtcaggataagaacagagacgggtgcatcatggcattggctgttgtgagaaacgagttctatgatctgcgcaataaatttcagactatgcttcagcttgagcagcaaatccaggctcaacaataa

SEQ ID NO: 10108 - protein, 145 aa, Sorghum bicolor
  misc_feature: Ceres ANNOT ID no. 6110003
  misc_feature (45)..(130): Pfam Id: Hpt Pfam Desc: Hpt domain
  misc_feature (1)..(145): NCBI GI: 60593896 NCBI Desc: chain d, crystal structure of histidine-containing phosphotransfer protein, zmhp2, from maize
  misc_feature (1)..(143): NCBI GI: 33637784 NCBI Desc: two-component phosphorelay mediator hp1 [oryza sativa (japonica cultivar-group)]
  misc_feature (1)..(143): NCBI GI: 37719728 NCBI Desc: histidine-containing phosphotransfer protein [triticum aestivum]
  misc_feature (1)..(143): NCBI GI: 54208747 NCBI Desc: histidine-containing phosphotransfer protein [oryza sativa (japonica cultivar-group)]
  misc_feature (1)..(143): NCBI GI: 33637786 NCBI Desc: two-component phosphorelay mediator hp2 [oryza sativa (japonica cultivar-group)]
  misc_feature: The sequence is a functional homolog of SEQ ID NO. 465 in the 11/188,298 US application
MAAAALREQLNALLSSMFSSGLVDDQFQQLQMLQEDGGTPGFVAEVVTLFCDDADRIISELAALLEQPIVDFDKVDAYVHQLKGSSASVGAQKVKFTCMQFRQLCQDKNRDGCIMALAVVRNEFYDLRNKFQTMLQLEQQIQAQQ

SEQ ID NO: 10109 - DNA, 1527 bp, Sorghum bicolor
  misc_feature: Ceres ANNOT ID no. 6110006
  misc_feature: Encodes the peptide sequence at SEQ ID NO 10110
atggaggaaacaagcaggaggatccctgggtacttcaagaacaagggcatcctcatcactggcgcaacaggcttccttggaaagatactcgtggagaagatactgagggtccagccggacgtcaagaggatctacctccccgtgcgtgcgccggacgcagcatcggccaagaaacggctggagactgaggtgatcgggaaggagctgtttgggcggcttcgggaaacgcacggcaaggggttccagtccttcatcgaggagaaggtcatcccgttggccggagacatcatccacgagaacctcggcgtggaggagccccagctgagccagatgactcaggagctcaacgtcatcgtcaatggagctgccacaacaaacttctacgagaggtacgacgtggccctggatgtgaacgtgatgggagtgaaacatatttgccagctcgccaagcagtgccccaatctcgaggtcgtcctccatgtgtccacggcctatgtggtgggcgagaagcaaggggtgatccaggagcgggcgttcaagcagggcgagacgctgcgggagacggaggcggagctggacatcgacgccgagctgcggctggccagtgactaccagcggcaggtcgccggcgacgacgcggagcagaagaacgagcggaaggccatgaaggagctgggcctcgccagggcccgggagttcggctggcccaacacctacgtcttcaccaaggcgctcggggagatgacgctggcgcgggagctcgccggcgttggcgtccccggcgtcatcgtgcggcccagcatcatcaccagcgtccagaaggagccgctccccgggtggatcgaaggcaccaggaccatcgacgccatcctcatcggctacgccaagcagagcctctcctgcttcctcgccgacctccagctcaccatggacgtgatccccggggacatggtggtgaacgcgatgatggccgcgacggtggcgcacgcgtcgacggcggcggcggccccggccgaccagaagaagaagacgccgccggcgccgccgccgacggtgtaccacgcgacgtcgtccctgcgcaacccggcgccgtacgcggtgctgtaccggacggggatccggtacttcagcgagcacccgcgggtgggcaaggacgggcgcgcggtgcgcacgcgcaaggtgcacttcttcggcaccgtggcgggcttcaccgcctacatggtgctccgctacaggctgccgctggagctgctgcgcctgctcagcctgctctgctgcggcctcctcttctcgcgcctctacgcggagctggaccgcaagtacaggttcgtcatgcgcctcgtcgacctctacgggcccttcgcgctcttcaagggcatcttcgacgacgccaacatggagaggctcaggatcgccatgcccgtcgctgaccgggtggagttcaatttcgacccaaagaccgtcgattgggacgattacttctacaagatccacatcccaggggtcatgaagtacgtcctcaactag

SEQ ID NO: 10110 - protein, 508 aa, Sorghum bicolor
  misc_feature: Ceres ANNOT ID no. 6110006
  misc_feature (19)..(322): Pfam Id: NAD_binding_4 Pfam Desc: Male sterility protein
  misc_feature (409)..(509): Pfam Id: Sterile Pfam Desc: Male sterility protein
  misc_feature (7)..(506): NCBI GI: 22003088 NCBI Desc: fatty acyl coa reductase [triticum aestivum]
  misc_feature (1)..(508): NCBI GI: 115480737 NCBI Desc: os09g0567500 [oryza sativa (japonica cultivar-group)]
  misc_feature (4)..(507): NCBI GI: 22003084 NCBI Desc: fatty acyl coa reductase [triticum aestivum]
  misc_feature (4)..(508): NCBI GI: 22003092 NCBI Desc: fatty acyl coa reductase [triticum aestivum]
  misc_feature (11)..(507): NCBI GI: 79432534 NCBI Desc: oxidoreductase, acting on the ch-ch group of donors [arabidopsis thaliana]
MEETSRRIPGYFKNKGILITGATGFLGKILVEKILRVQPDVKRIYLPVRAPDAASAKKRLETEVIGKELFGRLRETHGKGFQSFIEEKVIPLAGDIIHENLGVEEPQLSQMTQELNVIVNGAATTNFYERYDVALDVNVMGVKHICQLAKQCPNLEVVLHVSTAYVVGEKQGVIQERAFKQGETLRETEAELDIDAELRLASDYQRQVAGDDAEQKNERKAMKELGLARAREFGWPNTYVFTKALGEMTLARELAGVGVPGVIVRPSIITSVQKEPLPGWIEGTRTIDAILIGYAKQSLSCFLADLQLTMDVIPGDMVVNAMMAATVAHASTAAAAPADQKKKTPPAPPPTVYHATSSLRNPAPYAVLYRTGIRYFSEHPRVGKDGRAVRTRKVHFFGTVAGFTAYMVLRYRLPLELLRLLSLLCCGLLFSRLYAELDRKYRFVMRLVDLYGPFALFKGIFDDANMERLRIAMPVADRVEFNFDPKTVDWDDYFYKIHIPGVMKYVLN

SEQ ID NO: 10111 - DNA, 1413 bp, Sorghum bicolor
  misc_feature: Ceres ANNOT ID no. 6110051
  misc_feature: Encodes the peptide sequence at SEQ ID NO 10112
atggagcccaccacagccgaggacgccgcagccgcagccgccgcgccggactcgtgggagacggccgacatcgacgggcccatgagccggctcatcctctccgcgcgccgcgtgtcctcgtcgcccgacctcgccgacgaccaggacccgccccagccgccgccgcctactctgcagccgcagagcggcccggcttcctcggctgcgcgcgaggatttggtcgctcaggtcgatcagttcctacgggaggccctcgagaaaccaagggagaggctttctgtgctaagaatggagcaagaaattttgaagttcattcgtgaccctaggcgtacagagtttgaattcaatggtcttccaacttcgtatctgcgtcttgctgcacatcgcctggcacagcattacttcctgcagtctattgccataccagacaacagtttgcctgatggaactggttcgcgtatcatcctccgtaagacatcatccgagtgccgactgcctgctgtccgccttgcagatattccagttaacctgccacaagaagaaagcatctctgtggcgaaagtagctattaagcagaggcctcaaaagaatttccatggcatgaacagctcaagtgctcactcatctagagaaaacctccagaaaagcgtcgaagaaaggaaagaggaatacaacaaggcacgagcgcggatatttaacaacagcaatagcagtagtgctactgatgggagatcagctgaggaagtgactttacccagtactcttcacaggtccacttccttggagttgaactcaagcagtagaatgggccaaggggctgaaattactctcgaaaggagcttgactaccacgtcagctagcagcaggtcaaatagaagcaagattgataaggagcctgcagtcaatagaagcaggcagaacaatagggttgcaattttcagagaccgtgagtcagagcgcaaggatcctgattatgacagaagctatgacaggtatatgcaaagatttgatcctggatttggatttagtggaggcccatacacaattcaacccctgtatgcccctgctgttaactacaacactgaattcccccagcttggtgcagcacaccgatcacctgttgctgttgaacagcaaccgcgcccaatagctcagcacatgcctgcatcatggtcagtggctcaagcatctaatgcaattggctatgggccagatggtgtcatgggaccttacagccctggccatactggtgcacctgtgagatcgtctgttttcatgcatgcttcacagcaatatgccataccttcacgccctggagtcccatttgtacatccacaggaatccatgggaccatttgcacagactcaccaacaacaacctgatgctagtttgcgctttgcccggccccggtga

SEQ ID NO: 10112 - protein, 470 aa, Sorghum bicolor
  misc_feature: Ceres ANNOT ID no. 6110051
  misc_feature (21)..(469): NCBI GI: 140052882 NCBI Desc: single-stranded nucleic acid binding r3h [medicago truncatula]
  misc_feature (15)..(305): NCBI GI: 92871442 NCBI Desc: single-stranded nucleic acid binding r3h [medicago truncatula]
  misc_feature (65)..(245): NCBI GI: 124361205 NCBI Desc: single-stranded nucleic acid binding r3h [medicago truncatula]
  misc_feature (38)..(280): NCBI GI: 72536048 NCBI Desc: dip1 [zea mays]
  misc_feature (40)..(469): NCBI GI: 48428374 NCBI Desc: r3h domain protein kiaa1002
MEPTTAEDAAAAAAAPDSWETADIDGPMSRLILSARRVSSSPDLADDQDPPQPPPPTLQPQSGPASSAAREDLVAQVDQFLREALEKPRERLSVLRMEQEILKFIRDPRRTEFEFNGLPTSYLRLAAHRLAQHYFLQSIAIPDNSLPDGTGSRIILRKTSSECRLPAVRLADIPVNLPQEESISVAKVAIKQRPQKNFHGMNSSSAHSSRENLQKSVEERKEEYNKARARIFNNSNSSSATDGRSAEEVTLPSTLHRSTSLELNSSSRMGQGAEITLERSLTTTSASSRSNRSKIDKEPAVNRSRQNNRVAIFRDRESERKDPDYDRSYDRYMQRFDPGFGFSGGPYTIQPLYAPAVNYNTEFPQLGAAHRSPVAVEQQPRPIAQHMPASWSVAQASNAIGYGPDGVMGPYSPGHTGAPVRSSVFMHASQQYAIPSRPGVPFVHPQESMGPFAQTHQQQPDASLRFARPR

SEQ ID NO: 10113 - DNA, 1413 bp, Sorghum bicolor; identical to SEQ ID NO: 10111
  misc_feature: Ceres ANNOT ID no. 6110055
  misc_feature: Encodes the peptide sequence at SEQ ID NO 10114

SEQ ID NO: 10114 - protein, 470 aa, Sorghum bicolor; identical to SEQ ID NO: 10112
  misc_feature: Ceres ANNOT ID no. 6110055
  misc_feature (21)..(469): NCBI GI: 140052882 NCBI Desc: single-stranded nucleic acid binding r3h [medicago truncatula]
  misc_feature (15)..(305): NCBI GI: 92871442 NCBI Desc: single-stranded nucleic acid binding r3h [medicago truncatula]
  misc_feature (65)..(245): NCBI GI: 124361205 NCBI Desc: single-stranded nucleic acid binding r3h [medicago truncatula]
  misc_feature (38)..(280): NCBI GI: 72536048 NCBI Desc: dip1 [zea mays]
  misc_feature (40)..(469): NCBI GI: 48428374 NCBI Desc: r3h domain protein kiaa1002

SEQ ID NO: 10115 - DNA, 1365 bp, Sorghum bicolor
  misc_feature: Ceres ANNOT ID no. 6110155
  misc_feature: Encodes the peptide sequence at SEQ ID NO 10116
atgtcgctggcctgcggcctgccgctgctcgagtgcgtctactgcctcgcctgcgcgcgctgggcatggaagcgctgcctccacagcggcgaggtcgacagcgccacctggggcctcgccaccgccgccgacttcgagcccgtgccgcgcatgtgccgcctcgtcatggccaactacgagcccgacctctccccctccgcgccgctcctcttcgcgccgcccgggcccggcggctacggcatcgaccccgcatgcgtcctccgccgccggacctacgccgacacccgcggccgcgtcacgccctacctcctctacctcgaccacgcccacgccgacatcgtcctcgcgctccgcggcctcaacctcgccaaggagtccgactacgcgctcctcctcgacaaccgcctcggcaagcgccgcttcgacggcggctacgtccacaacggcctcctcagggccgccgcctgggtgctcgacgccgagtgcgacctccttagggaactactcgagaggtaccccgactacacgctcaccttcacgggtcattcgctgggcgccggcatcgcagccatgctcaccatggtcctcgtgctcaacctcgacaagcttggcaacgtcgacaggacccgcacgcgctgctacgccatagcgccggccaggtgcatgtcgctaaatctcgccgtcagatacgccgacgttattaactcggtcgtccttcaggacgacttcttgccgcggacggctactcctcttgaagacattttcaagtccatcctctgcttgccatgcctcctaggtttgagatgtttgagagatacatgtatacccgaagacgccttgctaaaggatccaaggaggctttatgcaccaggccggatttatcacatagtggaaagaagaatgtgcaggtgcgggagatatccacctgtagtcaaaacagctgtgccggtggatggtagatttgagcacatagttctttcctgcaatgccacagcggaccatgccattatttggattgagagggaggcccagaaggctttggatctgatgctggaggaggaggacacgatggcagtgccatccgagcagcagatggagcggaacgaaaccctgcagaaggagcacgtggaggagcacagggccgctctgcgccgggctgtcacgctgtcagtgccagacgcgcggggaccatcgccgtatggtacgtttgacgaagtcgagcagcatcaccaccagccggagaggagcgagagcttcccgccggcagggcccaggcagcgcatgagctggaacgacctgatcgagcgggtgttcgacaaagacgaggacggccatatcgtgctgcgcagctcagttcttctctga

SEQ ID NO: 10116 - protein, 454 aa, Sorghum bicolor
  misc_feature: Ceres ANNOT ID no. 6110155
  misc_feature (114)..(252): Pfam Id: Lipase_3 Pfam Desc: Lipase (class 3)
  misc_feature (9)..(81): Pfam Id: Lipase3_N Pfam Desc: Lipase 3 N-terminal region
  misc_feature (1)..(451): NCBI GI: 55793838 NCBI Desc: calmodulin-binding heat shock protein [gossypium hirsutum]
  misc_feature (1)..(451): NCBI GI: 56118085 NCBI Desc: calmodulin binding heat shock protein [gossypium hirsutum]
  misc_feature (1)..(449): NCBI GI: 140060405 NCBI Desc: lipase, class 3; lipase 3, n-terminal; zinc finger, c2h2-type [medicago truncatula]
  misc_feature (1)..(449): NCBI GI: 1087073 NCBI Desc: calmodulin-binding heat-shock protein; cambp [nicotiana tabacum]
  misc_feature (1)..(453): NCBI GI: 9757980 NCBI Desc: calmodulin-binding heat-shock protein [arabidopsis thaliana]
MSLACGLPLLECVYCLACARWAWKRCLHSGEVDSATWGLATAADFEPVPRMCRLVMANYEPDLSPSAPLLFAPPGPGGYGIDPACVLRRRTYADTRGRVTPYLLYLDHAHADIVLALRGLNLAKESDYALLLDNRLGKRRFDGGYVHNGLLRAAAWVLDAECDLLRELLERYPDYTLTFTGHSLGAGIAAMLTMVLVLNLDKLGNVDRTRTRCYAIAPARCMSLNLAVRYADVINSVVLQDDFLPRTATPLEDIFKSILCLPCLLGLRCLRDTCIPEDALLKDPRRLYAPGRIYHIVERRMCRCGRYPPVVKTAVPVDGRFEHIVLSCNATADHAIIWIEREAQKALDLMLEEEDTMAVPSEQQMERNETLQKEHVEEHRAALRRAVTLSVPDARGPSPYGTFDEVEQHHHQPERSESFPPAGPRQRMSWNDLIERVFDKDEDGHIVLRSSVLL

SEQ ID NO: 10117 - DNA, 966 bp, Sorghum bicolor
  misc_feature: Ceres ANNOT ID no. 6110209
  misc_feature: Encodes the peptide sequence at SEQ ID NO 10118
atgatgacctcgtggcttctgggccgccggggcgcctccggcttctcctggagctccaccgccgatcaagtcacgcagggcatctccgccgccggcctcaccgccatcgtcaccggggcgtccagcggcatcggcgccgagacggcgcggacactggcgctgcgcggggcccacgtcgtcatggccgtcaggagcctccccgccgcccaggccgtcagggacgccgtcctcgcccaggcgccggaggccaagctcgacgtcatggagctcgacctctcgtccatggcctccgtccgcgccttcgcgtcccaattcatcgacaggggtctccccctcaacatcctcatgtatgatactgatagcaacaatgcaggagtaatggcaataccttttgagctttcaaaggatggaattgagatgcagtttgcaactaatcatgttgggcatttcctgctgacacaccttctattggataccatgaagaagacctctcgtgaatcaaatgtggaaggaagaattgtcaacgtttcgtcagaggggcacagatttgcatatcaggaaggcatccgttttgacaagatcaacgatgaatcagtgtatagtatctttggagcatatgggcagtcaaagcttgcaaacatcttgcatgctaatgaacttgccaggcgattccaggaagagaatgtcaacataactgcaaattctcttcatcctggctccattatcacgaaccttcttcgtcaccacagtatcatagatgttctccatcggacgcttggtaaattggtgctgaaaaatgctgagcagggtgcggcaactacatgctatgtggcactccacccgcaggtgaagggtgtgtccgggaagtacttctgcgacagtaacctgtacgagccaagcgcgaaggccaaggacatggagctggccaagaggctctgggatttcagcgtcgagctcgtcacctag

SEQ ID NO: 10118 - protein, 321 aa, Sorghum bicolor
  misc_feature: Ceres ANNOT ID no. 6110209
  misc_feature (33)..(186): Pfam Id: adh_short Pfam Desc: short chain dehydrogenase
  misc_feature (1)..(321): NCBI GI: 115480783 NCBI Desc: os09g0570300 [oryza sativa (japonica cultivar-group)]
  misc_feature (9)..(320): NCBI GI: 42725482 NCBI Desc: short-chain dehydrogenase tic32 [pisum sativum]
  misc_feature (5)..(319): NCBI GI: 62956022 NCBI Desc: 3-ketoacyl-coa reductase 3 [gossypium hirsutum]
  misc_feature (5)..(319): NCBI GI: 30686197 NCBI Desc: short-chain dehydrogenase/reductase (sdr) family protein [arabidopsis thaliana]
  misc_feature (4)..(320): NCBI GI: 18413950 NCBI Desc: short-chain dehydrogenase/reductase (sdr) family protein [arabidopsis thaliana]
  misc_feature: The sequence is a functional homolog of SEQ ID NO. 453 in the 11/188,298 US application
MMTSWLLGRRGASGFSWSSTADQVTQGISAAGLTAIVTGASSGIGAETARTLALRGAHVVMAVRSLPAAQAVRDAVLAQAPEAKLDVMELDLSSMASVRAFASQFIDRGLPLNILMYDTDSNNAGVMAIPFELSKDGIEMQFATNHVGHFLLTHLLLDTMKKTSRESNVEGRIVNVSSEGHRFAYQEGIRFDKINDESVYSIFGAYGQSKLANILHANELARRFQEENVNITANSLHPGSIITNLLRHHSIIDVLHRTLGKLVLKNAEQGAATTCYVALHPQVKGVSGKYFCDSNLYEPSAKAKDMELAKRLWDFSVELVT

SEQ ID NO: 10119 - DNA, 519 bp, Sorghum bicolor
  misc_feature: Ceres ANNOT ID no. 6110495
  misc_feature: Encodes the peptide sequence at SEQ ID NO 10120
atggcaacaagcagcaggcttgcgctcatggccgtgatggcagcagccgtcctactgggcatggcgtcggcggcgacctacaacgtcggcgagcccagcgggtcttgggacctgcgcaccaactacgacacctgggtttcctccaagaggttccacccgggtgaccagatcgtgttcaagtactcgccccaagcgcacgacgtggtggaggtgagcaaggcagactacgactcctgctccaacgcgagtcccatcgccacccacaactccggcaacgacgccatcgccctcgcctcccccggcacccgctacttcatctgcggcttctctggccactgcaccggaggcatgaagattcagatcgacgtcgtgcccagcgccaactccctcacccccgccggcgctccctccgctaactctcccccggccacgtccacgcccgattccgctgctaccaaggccaccggtttcggcgtcctcgccgccgtcatgatcgccgccggcctcatggcttactag

SEQ ID NO: 10120 - protein, 172 aa, Sorghum bicolor
  misc_feature: Ceres ANNOT ID no. 6110495
  misc_feature (36)..(117): Pfam Id: Cu_bind_like Pfam Desc: Plastocyanin-like domain
  misc_feature (1)..(170): NCBI GI: 115480813 NCBI Desc: os09g0572700 [oryza sativa (japonica cultivar-group)]
  misc_feature (1)..(156): NCBI GI: 115474721 NCBI Desc: os08g0137800 [oryza sativa (japonica cultivar-group)]
  misc_feature (1)..(172): NCBI GI: 52550771 NCBI Desc: blue copper-binding protein [oryza sativa (japonica cultivar-group)]
  misc_feature (6)..(171): NCBI GI: 4104058 NCBI Desc: blue copper-binding protein homolog [triticum aestivum]
  misc_feature (6)..(171): NCBI GI: 37651973 NCBI Desc: blue copper binding protein [hordeum vulgare subsp. vulgare]
MATSSRLALMAVMAAAVLLGMASAATYNVGEPSGSWDLRTNYDTWVSSKRFHPGDQIVFKYSPQAHDVVEVSKADYDSCSNASPIATHNSGNDAIALASPGTRYFICGFSGHCTGGMKIQIDVVPSANSLTPAGAPSANSPPATSTPDSAATKATGFGVLAAVMIAAGLMAY

SEQ ID NO: 10121 - DNA, 1875 bp, Sorghum bicolor
  misc_feature: Ceres ANNOT ID no. 6110497
  misc_feature: Encodes the peptide sequence at SEQ ID NO 10122
  misc_feature: Up-regulated in root tissues in response to salicylic acid treatment
atggcgtccatggagggcctgatcgggttgatgaaccgcatccagcgcgcctgcaccgccctcggagaccacggaggaggaagcgacttgcccaccctctgggagtctctcccaaccatcgccgtcgttggaggccagagttcgggcaaatcctctgtacttgagagcattgttggcaccgactttcttccccgtggatcgggaatcgtcacgcgaaggcctttggtgctacagctgcaacagacagacaatggatctcaggaatacgcagagttcttacataagccaaaaacaaggttttcagactttgcccttgttcgccaagaaattgctgatgagacggatagactgactggaaaaactaagcaaatatctcctgtccctattcatctcagcatctactcgcccaaggttgtgaacttaaccttgattgatcttccagggttgacaaaagttgctgtagagggacagtctgaaaatattgtgcaagatatagagaatatggttcgctcatatgttgataagcccaactgtattattttggctatatctccagcaaatcaggatattgcaacttctgatgcaattaagctctcaaaagaagttgatccaacaggtgaaaggacgtttggcgtgttgacaaagctggacctaatggataaaggaacaaatgctctcgatgttcttgagggaagagcctatcggctgcagaatccttgggttggaatcgtcaaccgctcgcaagcagatattaataggaaggttggcatgctttcagcgagggaaaaagaaagggaatattttgaaaccagtcctgactatgctcatttagcaagtcggatgggttccgagtatcttgctaagcttctttctcagcatcttgaatctgttatcaaagcacgcattcctagtatcacagcgacaatcaacaaaactatagatgaacttgaatcagagctggacatcattgggagaggtgtggcttctgatccaggggctcaactgtacaccatattggacctctgccgtgcttttgaccgtgttttcaaggaacatcttgatggagggaggtcaggtggagatagaatatatggcgtgtttgatcataagcttcctgctgcttttaagaagcttccctttgaccgctatctgtctgtgcaaaacgtgaagaaggtggtttcagaagcagatggctatcagccccatcttatcgctcccgaacaaggataccgtcggcttattgaaaaaggcattacctatttcagaggaccagctgaagccacggttgatgcggtccacgttgttctaaaagacttggtcaggaaatccattggggagacagagcaactgagaagattcccaactcttcaagctgcgattgcgaccgccgcgaatgaagccctggaacgattccgggaggatgggcgcagcacagcacttcgtctagtggacatggaggctgcatacgtgacggtggaattcttccggaagctccctcaggatcctgctgatcctagtagtaaggtcggacctaataaacctccagtggagccgtcgccgacgccggaccgctatggtgatgggcacttcaggaatattgcctccaacgtgtcccagtacattcggatggttggagacgaactcttgcagaagatccccaaggcagctgtccactgccaagttcgcgaggcgaagaggtctctgctcaaccatttctacgtgcagatcgggaagaaagagggtggggagtttgggcatatgctggatgaggacccggcgatgatggagcgccggcagcaatgcttgaagaggctggagctgtacaaatctgcgagggatgaggtcgattctgtggcatggagcagcagcagataa

SEQ ID NO: 10122 - protein, 624 aa, Sorghum bicolor
  misc_feature: Ceres ANNOT ID no. 6110497
  misc_feature (40)..(216): Pfam Id: Dynamin_N Pfam Desc: Dynamin family
  misc_feature (225)..(511): Pfam Id: Dynamin_M Pfam Desc: Dynamin central region
  misc_feature (525)..(618): Pfam Id: GED Pfam Desc: Dynamin GTPase effector domain
  misc_feature (38)..(217): Pfam Id: MMR_HSR1 Pfam Desc: GTPase of unknown function
  misc_feature (1)..(620): NCBI GI: 11991508 NCBI Desc: dynamin-like protein dlp2 [arabidopsis thaliana]
  misc_feature (4)..(620): NCBI GI: 19423872 NCBI Desc: dynamin-like protein e [arabidopsis thaliana]
  misc_feature (1)..(620): NCBI GI: 6651403 NCBI Desc: dynamin-like protein 5 [arabidopsis thaliana]
  misc_feature (4)..(620): NCBI GI: 19569772 NCBI Desc: dynamin-like protein c [arabidopsis thaliana]
  misc_feature (1)..(620): NCBI GI: 92891191 NCBI Desc: dynamin central region; dynamin; dynamin gtpase effector [medicago truncatula]
  misc_feature: Up-regulated in root tissues in response to salicylic acid treatment
MASMEGLIGLMNRIQRACTALGDHGGGSDLPTLWESLPTIAVVGGQSSGKSSVLESIVGTDFLPRGSGIVTRRPLVLQLQQTDNGSQEYAEFLHKPKTRFSDFALVRQEIADETDRLTGKTKQISPVPIHLSIYSPKVVNLTLIDLPGLTKVAVEGQSENIVQDIENMVRSYVDKPNCIILAISPANQDIATSDAIKLSKEVDPTGERTFGVLTKLDLMDKGTNALDVLEGRAYRLQNPWVGIVNRSQADINRKVGMLSAREKEREYFETSPDYAHLASRMGSEYLAKLLSQHLESVIKARIPSITATINKTIDELESELDIIGRGVASDPGAQLYTILDLCRAFDRVFKEHLDGGRSGGDRIYGVFDHKLPAAFKKLPFDRYLSVQNVKKVVSEADGYQPHLIAPEQGYRRLIEKGITYFRGPAEATVDAVHVVLKDLVRKSIGETEQLRRFPTLQAAIATAANEALERFREDGRSTALRLVDMEAAYVTVEFFRKLPQDPADPSSKVGPNKPPVEPSPTPDRYGDGHFRNIASNVSQYIRMVGDELLQKIPKAAVHCQVREAKRSLLNHFYVQIGKKEGGEFGHMLDEDPAMMERRQQCLKRLELYKSARDEVDSVAWSSSR

SEQ ID NO: 10123 - DNA, 3300 bp, Sorghum bicolor
  misc_feature: Ceres ANNOT ID no. 6110561
  misc_feature: Encodes the peptide sequence at SEQ ID NO 10124
atggcagcggcggaggacgcggagggcgaccgcgtgatcgagatcgtgtcagcgggggcgctctaccaccgcggcggcgactgggagcgcaaatactggagctgctcgaggggcaaggaccggtacccttacccggtgggttaccatgctgtccgccatttcaccggaatatcctatgccatggaaatccaacaggggcccaagggtccaatattcctggttacatccactgaaggagactcagcgacagggcagacccctgatatcgcttggaagaacttccagaaaaagactggggctaaagtgaagaactggcagaggagaaagagcttccctcaaaagattgatggtgctgagctttttgggttcaaaaatgcatctattcagagattgcttcgtgagcttatagtagattcaactggagcagttgaacttaacctgccttgtgaagtcacttctgaggctggtgcacatttagttcgtaaagatgcatctgatgtttccgaggctgaagatctatctgtttgcttaggcatggaaagtggaactcctagaagaagtatagagcgcagccaggtggaaaataccttgatagtccactgcccggacatgttaacttcagttgataagtgcaatgtatccacacataaaaatacaagtgaaggagatactgtaggtagagcacttttgcaagatgtctctgattcaagatgctcccttccattgctggaagaaatccctaataatgcacaatccacttctcttgatgataatttgggagagccttccctagtttcatctcaacaagttggtttatcttctggttcttattcgagccctgaaaagtctaatatagaattggctgagaaggaagtagcaaagtctatgatgtctattttgcttccccaagccattccccttctcatgaaaacttacaaaaggaagaaatccaagcataaaagtaaagaaacctctactgtttcggcgaaaacaggttcagcttacaatccatctgttagttgctgccaaggtgtaactgtaccgacaattatggaagaaggtataaatgaaaatagtcctggaatgtgtgaccatgggggatctcatcatgacatggttaaaaatggcttcgccaatgatgactgcagaaatgatgactcagtggttaaattagatgagatgaatgattacgttgcagatagttttgaggatgatgcacacattttgggtgaccatatgaagaaatcaatgggtaatcatcaccattatcgtgaggatgtgtgctctagagaacctaatgggaagtcaaagttgctaaatggcaagagtgaagcttttgagtaccaggcgagtgtacataagggcaaaaatgcacctgatgtggtatacaatcatgaaaatggacaatatattttgtctgattcactcgttgcttgtctagaggatgagttcggtggggaagatagttcccaccctgcaaactacaaccaatttattggcgatgttaaacaatttgagcagaaatctgaggagcttacaaattttataaaaaatgactcatcagtttcggtggatgtttcataccacaagaacactggtaatggatcaattgatgctagacatggttcagcagtttcgaggaatgaagagtgtttagcaaacatcttgccttctccagttcattctaatgcacataatgataatgttgaatttgttgacaaacatgttgcttttgagtcatcagacaaattcatccattctagtgatgggtcacaaagattaaggaccactaaaggttggcctgttggtgacagaattaaaggagatcaaggaaattcgcttggcaaagtggaagaatgtcaaattggatgtcaaaaaggtaataagaacacaatgctatgtgtttgcggggaaggcaatgtttgtgaaaatgatgtttttcatcaccaaccagataattccctttctatgactaattgtacaaatggtttagtatctgaatacacaagaacacaagcaagaaggtcagatcatcacctagagctggtgggatgctacctgcacccactgcctgtcttgtctgtcatgttaaatgctaaagatcatagcagcttctatatttatgtattgtgtggccttttggagagctgccatagatccctttatgtttacactatgactcctaaagaccagaaagatgcgccaccatgttttgttggttacactccccttctactgcccaccttggaccattcttcaacaggaaattttccgtttggaagatccggtttgcattttacacctgatggccagtttctggtcctcctgagcagcatcagaataccttcttgcaggatgcaaaacattgattgcttgtgctcggtgtgcaacttgggccaatgcgaagataattctttaaaaattgtatctgttaactttggttatgtttcacttgtaaccagtttgatgccttatgggacagtgtcatgcattctgatatttgaaccaaattacattgtagctactgaagacagcagaaacttgcatatctgggaaatggtcgatgagtggagtgagatatctgagcagtatgtgattcctagtttgggtaacatgggtcctgtactggagcttagaaggatgccaaaaagcacatctctcattattggccatgatggcgaaggcggcttttgtttgtgggacatctccatgcgcacactattggcaacttttgcagctccaggaaacacagtcttccagattctgccagttggcttctgtagtttgcaggaggatattatccatgctccagttgatgacatagataaaaagctacaagagatcacagtcagtgacttgtccagaaaaaatgacagggagaactttatgatgccaccaagagaagatatagcagtttgggtactgatttcttctgcttctgttgctgagtatcaacatgatcttcgagccaaggaaaacaatgcgcggtggaggctagctctgctagcgaagaaaagagttttcatgggaaatgttttggatacaagagttactgctttagatgcctgcggtaactatggatatgctgggacacatgctggtctgctgtatttgtgggaattgtcttctgggagaaaagtgacttgtacacagtgtttcaacggtggacgagtctcctgtgttgctgttgattccaaatcaggtgcagtggtagtgactgatggtggatgccatgtattactttacacacaggacaaggtacaaactgatgccggagcagatgggcacatatctctttag

SEQ ID NO: 10124 - protein, 1099 aa, Sorghum bicolor
  misc_feature: Ceres ANNOT ID no. 6110561
  misc_feature (638)..(1082): NCBI GI: 144924410 NCBI Desc: wd40-like [medicago truncatula]
  misc_feature (680)..(1082): NCBI GI: 9797764 NCBI Desc: this gene may be cut off. [arabidopsis thaliana]
MAAAEDAEGDRVIEIVSAGALYHRGGDWERKYWSCSRGKDRYPYPVGYHAVRHFTGISYAMEIQQGPKGPIFLVTSTEGDSATGQTPDIAWKNFQKKTGAKVKNWQRRKSFPQKIDGAELFGFKNASIQRLLRELIVDSTGAVELNLPCEVTSEAGAHLVRKDASDVSEAEDLSVCLGMESGTPRRSIERSQVENTLIVHCPDMLTSVDKCNVSTHKNTSEGDTVGRALLQDVSDSRCSLPLLEEIPNNAQSTSLDDNLGEPSLVSSQQVGLSSGSYSSPEKSNIELAEKEVAKSMMSILLPQAIPLLMKTYKRKKSKHKSKETSTVSAKTGSAYNPSVSCCQGVTVPTIMEEGINENSPGMCDHGGSHHDMVKNGFANDDCRNDDSVVKLDEMNDYVADSFEDDAHILGDHMKKSMGNHHHYREDVCSREPNGKSKLLNGKSEAFEYQASVHKGKNAPDVVYNHENGQYILSDSLVACLEDEFGGEDSSHPANYNQFIGDVKQFEQKSEELTNFIKNDSSVSVDVSYHKNTGNGSIDARHGSAVSRNEECLANILPSPVHSNAHNDNVEFVDKHVAFESSDKFIHSSDGSQRLRTTKGWPVGDRIKGDQGNSLGKVEECQIGCQKGNKNTMLCVCGEGNVCENDVFHHQPDNSLSMTNCTNGLVSEYTRTQARRSDHHLELVGCYLHPLPVLSVMLNAKDHSSFYIYVLCGLLESCHRSLYVYTMTPKDQKDAPPCFVGYTPLLLPTLDHSSTGNFPFGRSGLHFTPDGQFLVLLSSIRIPSCRMQNIDCLCSVCNLGQCEDNSLKIVSVNFGYVSLVTSLMPYGTVSCILIFEPNYIVATEDSRNLHIWEMVDEWSEISEQYVIPSLGNMGPVLELRRMPKSTSLIIGHDGEGGFCLWDISMRTLLATFAAPGNTVFQILPVGFCSLQEDIIHAPVDDIDKKLQEITVSDLSRKNDRENFMMPPREDIAVWVLISSASVAEYQHDLRAKENNARWRLALLAKKRVFMGNVLDTRVTALDACGNYGYAGTHAGLLYLWELSSGRKVTCTQCFNGGRVSCVAVDSKSGAVVVTDGGCHVLLYTQDKVQTDAGADGHISL

SEQ ID NO: 10125 - DNA, 666 bp, Sorghum bicolor
  misc_feature: Ceres ANNOT ID no. 6110634
  misc_feature: Encodes the peptide sequence at SEQ ID NO 10126
atgagacaggaggcggcaaacagcatagtggtgacccaggaggacgccctgcaccaccgcgaggagctgcagccgcccccctgccgccaggacgatccgccagcaccggctgcgtcgctctcatggccgtcgtcactgtcggagggcgagccggcgtccgcggcagcgggggaggagctgttgttggtaccaccactcaacttcgccatggtggaccacggcgtgtaccgctccggattcccggacgtctccaatcttccgttccttgagaccctccgactccgctccgtcctgtgtctgtgcccggagccgtatccggaggcgaacctggagttcctccgtgcccacgggatcaagctcttccagtttggaatcgacggctccaaggagccgtttgtgaacataccagaagatagaatccgcgaagctctaaaagttattctagacgcaagtaaccatccggttcttattcactgcaagcgaggaaagcatcgaactggctgtgtggttggatgctttaggaaattgcagcgctggtgtctaacttcaatatttgacgaataccagcgttttgctgctgccaagacaagagtttctgatctccgattcatggagctatttgatgtatctagcataaagcatttgccagcatcgtacccatgctag

SEQ ID NO: 10126 - protein, 221 aa, Sorghum bicolor
  misc_feature: Ceres ANNOT ID no. 6110634
  misc_feature (62)..(222): Pfam Id: Y_phosphatase2 Pfam Desc: Tyrosine phosphatase family
  misc_feature (23)..(219): NCBI GI: 115467010 NCBI Desc: os06g0208700 [oryza sativa (japonica cultivar-group)]
  misc_feature (33)..(219): NCBI GI: 50313187 NCBI Desc: tyrosine-specific protein phosphatase protein [oryza sativa]
  misc_feature (4)..(221): NCBI GI: 60459387 NCBI Desc: tyrosine specific protein phosphatase family protein [capsicum annuum]
  misc_feature (47)..(208): NCBI GI: 44982430 NCBI Desc: adl204wp [eremothecium gossypii]
  misc_feature (47)..(208): NCBI GI: 45187669 NCBI Desc: adl204wp [eremothecium gossypii]
  misc_feature (62)..(215): SWISSPROT Homolog: EC 3.1.3.48 Tyrosine-protein phosphatase SIW14
MRQEAANSIVVTQEDALHHREELQPPPCRQDDPPAPAASLSWPSSLSEGEPASAAAGEELLLVPPLNFAMVDHGVYRSGFPDVSNLPFLETLRLRSVLCLCPEPYPEANLEFLRAHGIKLFQFGIDGSKEPFVNIPEDRIREALKVILDASNHPVLIHCKRGKHRTGCVVGCFRKLQRWCLTSIFDEYQRFAAAKTRVSDLRFMELFDVSSIKHLPASYPC

SEQ ID NO: 10127 - DNA, 663 bp, Sorghum bicolor
  misc_feature: Ceres ANNOT ID no. 6110739
  misc_feature: Encodes the peptide sequence at SEQ ID NO 10128
atggccgccgccgacgaccagccggagactgtggaggtcacgctgcgcgccgtcggcccgtcccgcccatccaccctccgcctccctccgcttctctcggttgccgagcttcgcggccgcatcgcgcgcgaacgccgtctggcaggcacagaagaggttcgactccgcctggtcctgcggggaaagacgctcccgcaccaacacgatacccatgtcaatcttcgcgatggggatactttaatagtggccgtggcgcctaagcctcctgctaatcatctccttgacgatgacgaggaggaagaagaggaagaactgaagttcaaaataccacaaacgacaaccttgtggaagaggaaaatttttatgtttcttcgagacaagttgagattacctgatatcattttgatggcgctgttttctctcagtatgaaagcatggattatcattgcaatgtggttcctattggcaccgactgctcagaagtataacgttggacctttatatatacttggtaccggtttcttgatcatagttcttaatcttggaagacgacaacaaggtgatgttagtgcatactccatattcaacgaagattttagggagctgccaggaacacttaatgcagatcgcattgatcgagacatccgggcaggtcaattttag

SEQ ID NO: 10128 - protein, 220 aa, Sorghum bicolor
  misc_feature: Ceres ANNOT ID no. 6110739
  misc_feature (141)..(218): NCBI GI: 125775886 NCBI Desc: ga12444-pa [drosophila pseudoobscura]
  misc_feature: Useful for making plants with modulated oxidative stress sensitivity
  misc_feature: GREAT-hit functional homolog of the protein sequence encoded by LOCUS at2g35360
  misc_feature: Useful for making plants with modulated oxidative stress sensitivity
  misc_feature: Functional homolog of the protein sequence given in SEQ ID NO 13591
MAAADDQPETVEVTLRAVGPSRPSTLRLPPLLSVAELRGRIARERRLAGTEEVRLRLVLRGKTLPHQHDTHVNLRDGDTLIVAVAPKPPANHLLDDDEEEEEEELKFKIPQTTTLWKRKIFMFLRDKLRLPDIILMALFSLSMKAWIIIAMWFLLAPTAQKYNVGPLYILGTGFLIIVLNLGRRQQGDVSAYSIFNEDFRELPGTLNADRIDRDIRAGQF

SEQ ID NO: 10129 - DNA, 1578 bp, Sorghum bicolor
  misc_feature: Ceres ANNOT ID no. 6111124
  misc_feature: Encodes the peptide sequence at SEQ ID NO 10130
atgggccagtgcccctccgtcccgcgccgccgcaagcccccgcccctgcctccgtcccccgcgctctccgcgccgccgcaggtcctctgctccatcgccgaggccgccggggaggaccacaccgccgacctccccgaggagctgctcgccctcgtcttcggtctcctcggctccggcgaccgcaagcgctgctccctcgtgtgccgccgctggctagccgtagaggccgcctcccgcctccgcctcgcgctcgacgccagggcacctctgctcgccgactccgccctcccccgcctcctcgcgcgcttccccgccgtctccaagcttgcgctaaagtgcgaccgccgcgctgagagcgtgggcgacccggccctcgcgcaagttgccgaccgcctcggcccgggccttcggcgcctcaaactccgctccctgcgcgcggtcaccgacgatggggtcgctgcgctcgccgccgcggccgctaatctccgcaagctctccgtcggctcctgtgccttcggagcaaagggaatcgaggctgtcctccgctcctgcctccacctcgaggagctgtccgtcaagcgcctccgtggcctcgctgagtcagagcccgtttccgtctccggcccgcgcctccaatctctttcgctcaaggagctctacaacggccagtgcttctcctatttgatcacccagtcgcccaacctcaaaaccctcaagattatcagatgctcgggtgactgggacatcgtgctccaggacgtcccgagggattccctcctagctgagctccaccttgagaagctgcaggtcagcgaccggggtgtagccgccttaattgggctcgaggtactctaccttgccaaggcacctgaggtcactgatgttggattagccgagcttgctgccaagtcgccatgcctccgcaagctgcatgttgatggatggaaagcaaacaggattggtgaccgggggcttgctgccgttgcacagaaatgtgccagcttgcaggaactggtcctcattggtgtgaatttgacatcatccagtcttgaattgattgctgccaactgttcctccttagagcggcttgcgttgtgtgggtcagacacgtttggtgatgcggagatctcatgtgttgctgccaaatgtgctgcattgcgtaagctgtgcatcaaggcatgtccagtgtctgatgcggggatgaataagcttgctgaaggctgcccacgccttgtcaaggttaaggtgaagaagtgccgccgggtgaccttcgagtgtgctgagcgcctccgggctagcaggaatggaactctcactgtgaattttgacactcctggtggagctggtgagttgcaggatggtcggagtgtggatgagagtggtgtgttagacaatgctgggagtgatgtgctgccagaggatttggatgatcggatagtaccagagcttttgagtggaagcagtggcaggccgtcaagatggaaagcacggatgggttctttgatatcgaggagcttgtctgtttccatattccgaaggcaaccacgtggtggctgctctacaagtcatgagtcatga

SEQ ID NO: 10130 - protein, 525 aa, Sorghum bicolor
  misc_feature: Ceres ANNOT ID no. 6111124
  misc_feature (39)..(86): Pfam Id: F-box Pfam Desc: F-box domain
  misc_feature (39)..(523): NCBI GI: 87240761 NCBI Desc: cyclin-like f-box [medicago truncatula]
  misc_feature (39)..(525): NCBI GI: 30013671 NCBI Desc: avr9/cf-9 rapidly elicited protein 189 [nicotiana tabacum]
  misc_feature (39)..(503): NCBI GI: 116310258 NCBI Desc: osigba0145c12.2 [oryza sativa (indica cultivar-group)]
  misc_feature (39)..(503): NCBI GI: 32490274 NCBI Desc: osjnbb0116k07.16 [oryza sativa (japonica cultivar-group)]
  misc_feature (118)..(503): NCBI GI: 115459308 NCBI Desc: os04g0505700 [oryza sativa (japonica cultivar-group)]
MGQCPSVPRRRKPPPLPPSPALSAPPQVLCSIAEAAGEDHTADLPEELLALVFGLLGSGDRKRCSLVCRRWLAVEAASRLRLALDARAPLLADSALPRLLARFPAVSKLALKCDRRAESVGDPALAQVADRLGPGLRRLKLRSLRAVTDDGVAALAAAAANLRKLSVGSCAFGAKGIEAVLRSCLHLEELSVKRLRGLAESEPVSVSGPRLQSLSLKELYNGQCFSYLITQSPNLKTLKIIRCSGDWDIVLQDVPRDSLLAELHLEKLQVSDRGVAALIGLEVLYLAKAPEVTDVGLAELAAKSPCLRKLHVDGWKANRIGDRGLAAVAQKCASLQELVLIGVNLTSSSLELIAANCSSLERLALCGSDTFGDAEISCVAAKCAALRKLCIKACPVSDAGMNKLAEGCPRLVKVKVKKCRRVTFECAERLRASRNGTLTVNFDTPGGAGELQDGRSVDESGVLDNAGSDVLPEDLDDRIVPELLSGSSGRPSRWKARMGSLISRSLSVSIFRRQPRGGCSTSHES

SEQ ID NO: 10131 - DNA, 1140 bp, Sorghum bicolor
  misc_feature: Ceres ANNOT ID no. 6111292
  misc_feature: Encodes the peptide sequence at SEQ ID NO 10132
atggcgaagccggcggcggcggcgacgaggaagccctctgcggcgtcgaccgtcgcactgacactggctctggccctggcctcggctggcctcctcttcctcctactccgcctctctccctcctccccgtcccccaccccgcacccgcaccgccgcctccgcctccgcgcccgcgcgcacgtgcaccaccaccagatcccattcgaccctgtcgtcgcggacatcgagcgccgcatcgaagaccgcgagtgggagcgcctcgccgccgcggggctgcacgcgccgggcatggaggcggcgccggtcccagaggatctcaccgacggcgaggccgacgccgacgaggactacatcaacgacgccgcgcgcttcaacgtcacgcatcgcgtggaggcgctgttcccaaagatcgacgtcgaccctgccgatggcgccgtcacgggcgccgagctggccgcgtggaacctcgcgaatgcgcggcgggaggtgctgcaccgcaccgcccgggagctcgagctgcacgaccgcgatcacgacggccgcgtcgccttcggcgagtacgagcggcccagctgggcctggcgtttcgacgatcataactcaactaatgatggagtgggatggtggaaggaggagcattttaacgctgcagatatggatggtgatggctttctgaatcttactgagtttaatgactttttacatccagctgatacaaccaacccaaagctaataaattggttgtgcaaagaagaagtcagggaaagagataaagacaacgatggaaagctcaatttccaagagttcttcagtggattattttattccattcgacactatgatgacgaaggcataacagatgacactggtggctctgatgcaccagctaaaaagtcattttcacaccttgatctggataatgatgggctcttatcagcagatgagctaaagcctataattgataatctccatccgtcagaacacttctatgccaagcaacaagctgactatgtaatatctcaggctgacacaaacaaagatggacagttgaacatgaacgagatgatcgagaacccctatgtcttttacaatgctttattcacagaagatgattatgggtttcatgacgagctccgttag

SEQ ID NO: 10132 - protein, 379 aa, Sorghum bicolor
  misc_feature: Ceres ANNOT ID no. 6111292
  misc_feature (1)..(379): NCBI GI: 46806523 NCBI Desc: calcium-binding ef hand family protein-like [oryza sativa (japonica cultivar-group)]
  misc_feature (151)..(379): NCBI GI: 115437796 NCBI Desc: os01g0572700 [oryza sativa (japonica cultivar-group)]
  misc_feature (171)..(379): NCBI GI: 52076360 NCBI Desc: calcium binding protein-like [oryza sativa (japonica cultivar-group)]
  misc_feature (19)..(379): NCBI GI: 115461380 NCBI Desc: os04g0681500 [oryza sativa (japonica cultivar-group)]
  misc_feature (22)..(379): NCBI GI: 38345557 NCBI Desc: osjnba0032f06.6 [oryza sativa (japonica cultivar-group)]
MAKPAAAATRKPSAASTVALTLALALASAGLLFLLLRLSPSSPSPTPHPHRRLRLRARAHVHHHQIPFDPVVADIERRIEDREWERLAAAGLHAPGMEAAPVPEDLTDGEADADEDYINDAARFNVTHRVEALFPKIDVDPADGAVTGAELAAWNLANARREVLHRTARELELHDRDHDGRVAFGEYERPSWAWRFDDHNSTNDGVGWWKEEHFNAADMDGDGFLNLTEFNDFLHPADTTNPKLINWLCKEEVRERDKDNDGKLNFQEFFSGLFYSIRHYDDEGITDDTGGSDAPAKKSFSHLDLDNDGLLSADELKPIIDNLHPSEHFYAKQQADYVISQADTNKDGQLNMNEMIENPYVFYNALFTEDDYGFHDELR

SEQ ID NO: 10133 - DNA, 1059 bp, Sorghum bicolor
  misc_feature: Ceres ANNOT ID no. 6111318
  misc_feature: Encodes the peptide sequence at SEQ ID NO 10134
  misc_feature: Up-regulated in shoot tissues in response to salicylic acid treatment
atggcgtcgacgtcgggggatacatcggcagcggaggctctccgccgcggtcgcatcctctccagccgcctctacctcgacggcgtccccagctccaaggcacccgtggtctactcgccggcgtatgacatcgagttcaacgggatcgagaaacagcacccgtttgattcggcgaaatggggtcgcgtccgcaacttccttgtggacgcagggctcctccagaacgatcggatcatcgagccgctggaagcctccgaggatgatctgctagtggtgcactcagagtcgtacttgaacagccttaagagcagcgcgaaggttgcccgcattgtagaggttccagcagtggcactactacctaacttgcttgttcagcaaaaactcctttatccatttcggaagcaggtgggtggctccattttatcagcaaaacttgcactagaaagaggatgtgctatcaacattggcggaggcttccaccactgttcggcagaggaagggggtggcttttgtgcatatgctgatatttctctgtgcatccattttgcttttgttcgtttaaatatctcaagagtaatgatcattgatctagatgctcaccaaggaaatggccatgaaaaagattttgggagtgatgagagagtttacaccttggacatgtacaactctggaatatatccttttgatcatgtggctaagaagtacattgatcaaaagatcgagttacatagtgggacaaaaacagaagattatttggagatccttgataaggctctcaaggtagctgaaagtagatttcagccccagttgattctgtacaatgctggaactgatatcctagatggcgatcctttaggcagcctaaaggttagtccagacggtgtgattactagagatgaaaaggttttcaggtttgcaaaggatcagagtattcctctcctcatgctgacatcaggaggctatatgaagtcaagtgctcgggtcatagcagattcaattatcaacctctcgaacaaaaacttgatagatattgatacacactgtatagaaattgaataa

SEQ ID NO: 10134 - protein, 352 aa, Sorghum bicolor
  misc_feature: Ceres ANNOT ID no. 6111318
  misc_feature (33)..(343): Pfam Id: Hist_deacetyl Pfam Desc: Histone deacetylase domain
  misc_feature (12)..(342): NCBI GI: 30690103 NCBI Desc: histone deacetylase family protein (hda2) [arabidopsis thaliana]
  misc_feature (12)..(342): NCBI GI: 21105771 NCBI Desc: hda2 [arabidopsis thaliana]
  misc_feature (196)..(342): NCBI GI: 30690100 NCBI Desc: histone deacetylase family protein (hda2) [arabidopsis thaliana]
  misc_feature (135)..(342): NCBI GI: 5107816 NCBI Desc: contains similarity to histone deacetylases; pfam pf00850, score=13.3, e=5e-10, n=1 [arabidopsis thaliana]
  misc_feature (21)..(342): NCBI GI: 119584569 NCBI Desc: histone deacetylase 11, isoform cra_i [homo sapiens]
  misc_feature: Up-regulated in shoot tissues in response to salicylic acid treatment
MASTSGDTSAAEALRRGRILSSRLYLDGVPSSKAPVVYSPAYDIEFNGIEKQHPFDSAKWGRVRNFLVDAGLLQNDRIIEPLEASEDDLLVVHSESYLNSLKSSAKVARIVEVPAVALLPNLLVQQKLLYPFRKQVGGSILSAKLALERGCAINIGGGFHHCSAEEGGGFCAYADISLCIHFAFVRLNISRVMIIDLDAHQGNGHEKDFGSDERVYTLDMYNSGIYPFDHVAKKYIDQKIELHSGTKTEDYLEILDKALKVAESRFQPQLILYNAGTDILDGDPLGSLKVSPDGVITRDEKVFRFAKDQSIPLLMLTSGGYMKSSARVIADSIINLSNKNLIDIDTHCIEIE

SEQ ID NO: 10135 - DNA, 1134 bp, Sorghum bicolor
  misc_feature: Ceres ANNOT ID no. 6111325
  misc_feature: Encodes the peptide sequence at SEQ ID NO 10136
atgtctaccatctacatgagccaactgtctactctccctctaatggagatggagggagagcaggatcaggatcagggactctttcggccggcgcccttccatgtcgcaaaggaccctcccatcttgttcccgttcatgatcaccaatcctgtggatcagctccaagggcaaagcagcagctatggagatcagcacttgaggcagcatgttttgtctgaatctactcatcaacagttcaccgatcggatgatgatgagcggatcagaagtcttccctactatgccatcgccgttccggcagactatccaaagcatcgatggtgacatgatccagcgatctgcgtatgatccatatgatacagagaataataagcacaccgaaggattgcgcagcggcggcggcggcggcggctggacagtgtcgtcgtcaccgccagcgaagatgaagatcatgcggaggaaggcaacgagcgagtatcccgagggcggtggtgggggagcaagaaagccaaggagaagaccacaagcgcaccaccaagatgctgagagccagctactccagcagcagcagcaggctatgggtggtgtcgttagagtgtgctccgactgcaacaccacaaagacccccttgtggaggagtggtccttgtggccccaagtctctttgcaacgcatgtggcataaggcaaaggaaggcgaggcgggcgatggcggcagccgcggcagctgctgctgccagcagcaacggaggcgctccacaagcggccaccgagcagcagccgaagccggccaagaaggagaagaggtcggacatcgtcgaccggtcgtcgctgccgttcaagaagcggtgcaagcagacgatgccactgaagcgacgccgccgccgccgccgccaggaaaccgctgctctgaccaaggatcaggcggatgtggatcacgtctccagtgacaagaagcaggttaatggccatggcgcgacgagtctggagagcagcaagatcgtcgccactcctcctccccaggcgatgtcgtcgtttcatgccttcccggctgacgagatcactgacgccgccatgctgctcatgaccctgtcctgtgggcacgctcgtctgcagctagccatggcttctagctag

SEQ ID NO: 10136 - protein, 377 aa, Sorghum bicolor
  misc_feature: Ceres ANNOT ID no. 6111325
  misc_feature (200)..(235): Pfam Id: GATA Pfam Desc: GATA zinc finger
  misc_feature (44)..(366): NCBI GI: 46806488 NCBI Desc: zinc finger protein-like [oryza sativa (japonica cultivar-group)]
  misc_feature (1)..(255): NCBI GI: 54291240 NCBI Desc: zinc finger protein-like [oryza sativa (japonica cultivar-group)]
  misc_feature (198)..(299): NCBI GI: 57899525 NCBI Desc: zinc finger protein-like [oryza sativa (japonica cultivar-group)]
  misc_feature (192)..(254): NCBI GI: 20521225 NCBI Desc: gata-type zinc finger transcription factor-like [oryza sativa (japonica cultivar-group)]
  misc_feature (195)..(235): NCBI GI: 15240409 NCBI Desc: zinc finger (gata type) family protein [arabidopsis thaliana]
  misc_feature: The plant is abnormally small.
  misc_feature: The sequence is a functional homolog of SEQ ID NO 1032 in the 10/666,642US patent application
  misc_feature: The sequence is a functional homolog of SEQ ID NO 1054 in the 10/666,642US patent application
  misc_feature: The sequence is a functional homolog of SEQ ID NO 1655 in the 10/374,780US patent application
  misc_feature: The sequence is a functional homolog of SEQ ID NO 1656 in the 10/374,780US patent application
  misc_feature: The sequence is a functional homolog of SEQ ID NO 1657 in the 10/374,780US patent application
  misc_feature: The sequence is a functional homolog of SEQ ID NO 242 in the 10/666,642US patent application
  misc_feature: The sequence is a functional homolog of SEQ ID NO 607 in the 10/374,780US patent application
  misc_feature: The sequence is a functional homolog of SEQ ID NO 608 in the 10/374,780US patent application
  misc_feature: The sequence is a functional homolog of SEQ ID NO 609 in the 10/374,780US patent application
  misc_feature: Useful for making plants with modulated biomass
  misc_feature: Useful for making plants with modulated growth and phenotype characteristics
  misc_feature: Useful for making plants with modulated heat sensitivity
  misc_feature: Useful for making plants with modulated low light sensitivity
  misc_feature: GREAT-hit functional homolog of the protein sequence given in SEQ ID NO 13434
  misc_feature: GREAT-hit functional homolog of the protein sequence given in SEQ ID NO 13464
  misc_feature: The sequence is a functional homolog of SEQ ID NO 1655 in the 20060162006 US patent application
  misc_feature: The sequence is a functional homolog of SEQ ID NO 1656 in the 20060162006 US patent application
  misc_feature: The sequence is a functional homolog of SEQ ID NO 1657 in the 20060162006 US patent application
  misc_feature: The sequence is a functional homolog of SEQ ID NO 607 in the 20060162006 US patent application
  misc_feature: The sequence is a functional homolog of SEQ ID NO 608 in the 20060162006 US patent application
  misc_feature: The sequence is a functional homolog of SEQ ID NO 609 in the 20060162006 US patent application
  misc_feature: The sequence is a functional homolog of SEQ ID NO 1032 in the 20070033671 US patent application
  misc_feature: The sequence is a functional homolog of SEQ ID NO 1054 in the 20070033671 US patent application
  misc_feature: The sequence is a functional homolog of SEQ ID NO 242 in the 20070033671 US patent application
MSTIYMSQLSTLPLMEMEGEQDQDQGLFRPAPFHVAKDPPILFPFMITNPVDQLQGQSSSYGDQHLRQHVLSESTHQQFTDRMMMSGSEVFPTMPSPFRQTIQSIDGDMIQRSAYDPYDTENNKHTEGLRSGGGGGGWTVSSSPPAKMKIMRRKATSEYPEGGGGGARKPRRRPQAHHQDAESQLLQQQQQAMGGVVRVCSDCNTTKTPLWRSGPCGPKSLCNACGIRQRKARRAMAAAAAAAAASSNGGAPQAATEQQPKPAKKEKRSDIVDRSSLPFKKRCKQTMPLKRRRRRRRQETAALTKDQADVDHVSSDKKQVNGHGATSLESSKIVATPPPQAMSSFHAFPADEITDAAMLLMTLSCGHARLQLAMASS

SEQ ID NO: 10137 - DNA, 1620 bp, Sorghum bicolor
  misc_feature: Ceres ANNOT ID no. 6111337
  misc_feature: Encodes the peptide sequence at SEQ ID NO 10138
atgtccgccgctcatcttctccgtcactcccgcaagctgcggagtttgcaaaatgctgtgggttgtgagaattttagtcttgttcggcatttctccagcggttccggatccgttatcgccaaggaaaatggtgttggaaaaagaaccagaggtaccagattttcccagcataaccagcctgcaaaagagctcgagacattctcactaggagtaaatggaagctgcacttggagaagagcatccaacagccttaccccaagtgctgctagcaggctcaatggttcattctcatgtggacaggtagtttcagctcgtccattctcaagtagtgcagacctgcctccacatcaagaaattggcatgccgtctctttcgcctacaatgactgagggaaacattgccaagtggcttaagaaggaaggagacaaggtctcccctggtgaggttctctgtgaggtggaaactgataaagccactgtggagatggagtgcatggaagagggctatcttgctaagattgttcaaggagatggtgcaaaggagattaaagttggcgaggtcattgctataactgtggaagaagagggtgacattgagaagtttaaggattataagccgtcatcttcagctgaacctgtagctcctgctgaatcaaaggctcaaccagaaccatcccagccgaaggtggaggaaaaaaagcttacccaggctcctgaggccaaggccccgaagattgaagatgcttctcaatctggagatcgtatatttgccagccctcttgcccgtaaactggctgaagataacaatgtcccactatcaagtgtgaaaggtactggtcctgatgggcgtattttgaaggcagatattgaagattacttggccaagggtgggacgagggaggcttttgcagctccagggttaggttatattgatattccaaatgcacagataagaaaggttaccgcgaaccgcttgctacaatcaaaacagaccattcctcattactacttgacagtagatgcacgtgttgacaaacttgtcaagttgcgaggtgaactgaacccgctgcaggatgctgctggtggaaagaaaatatcaattaatgatcttgtcatcaaggctgcagctttggctcttcgaaaggtcccacagtgtaacagctcatggatgaatgattttattcgccaataccacaatgtaaacatcaacgtggccgttcagactgaacatggattgtttgttccagtaattagggatgcagacaagaagggacttggtacaattgctgaggaggtgaagcagttggctcaaaaagcaagagataatagcttaaaaccagcagattacgaaggtggcaccttcaccgtatcaaacttgggaggtccctttggaattaaacaattctgtgccatcataaatcctcctcagtcagcaattttggccattggttctgctgagaagagggtgatacctggttccgctgacggtcagtacgaatttggttcattcatgtcagctacactgagctgtgaccacagggttatagatggtgcaattggtgccgaattcctgaaagcattcaagggctacatcgagaacccgacctcaatgctactgtga

SEQ ID NO: 10138 - protein, 539 aa, Sorghum bicolor
  misc_feature: Ceres ANNOT ID no. 6111337
  misc_feature (306)..(539): Pfam Id: 2-oxoacid_dh Pfam Desc: 2-oxoacid dehydrogenases acyltransferase (catalytic domain)
  misc_feature (253)..(291): Pfam Id: E3_binding Pfam Desc: e3 binding domain
  misc_feature (117)..(191): Pfam Id: Biotin_lipoyl Pfam Desc: Biotin-requiring enzyme
  misc_feature (1)..(539): NCBI GI: 5669871 NCBI Desc: dihydrolipoamide s-acetyltransferase [zea mays]
  misc_feature (3)..(539): NCBI GI: 20260138 NCBI Desc: dihydrolipoamide acetyltransferase [arabidopsis thaliana]
  misc_feature (3)..(539): NCBI GI: 92871491 NCBI Desc: dihydrolipoamide succinyltransferase [medicago truncatula]
  misc_feature (3)..(539): NCBI GI: 14161722 NCBI Desc: mono-lipoyl e2 [arabidopsis thaliana]
  misc_feature (3)..(539): NCBI GI: 11994364 NCBI Desc: dihydrolipoamide acetyltransferase [arabidopsis thaliana]
  misc_feature (3)..(539): SWISSPROT Homolog: EC 2.3.1.12 Dihydrolipoyllysine-residue acetyltransferase component 2 of pyruvatedehydrogenase complex, mitochondrial precursor
MSAAHLLRHSRKLRSLQNAVGCENFSLVRHFSSGSGSVIAKENGVGKRTRGTRFSQHNQPAKELETFSLGVNGSCTWRRASNSLTPSAASRLNGSFSCGQVVSARPFSSSADLPPHQEIGMPSLSPTMTEGNIAKWLKKEGDKVSPGEVLCEVETDKATVEMECMEEGYLAKIVQGDGAKEIKVGEVIAITVEEEGDIEKFKDYKPSSSAEPVAPAESKAQPEPSQPKVEEKKLTQAPEAKAPKIEDASQSGDRIFASPLARKLAEDNNVPLSSVKGTGPDGRILKADIEDYLAKGGTREAFAAPGLGYIDIPNAQIRKVTANRLLQSKQTIPHYYLTVDARVDKLVKLRGELNPLQDAAGGKKISINDLVIKAAALALRKVPQCNSSWMNDFIRQYHNVNINVAVQTEHGLFVPVIRDADKKGLGTIAEEVKQLAQKARDNSLKPADYEGGTFTVSNLGGPFGIKQFCAIINPPQSAILAIGSAEKRVIPGSADGQYEFGSFMSATLSCDHRVIDGAIGAEFLKAFKGYIENPTSMLL

SEQ ID NO: 10139 - DNA, 2223 bp, Sorghum bicolor
  misc_feature: Ceres ANNOT ID no. 6111346
  misc_feature: Encodes the peptide sequence at SEQ ID NO 10140
atggccgcagcgcggcgtcttcttgccgcctgcagcagcggcggcggcgccggcgccggcgccggtagtcgcatcctgctcgctgtcttcttcctggcggcctcgctcttggcctccgcggccaatgcggccgtctcgtacgaccaccgctccctcgtcatcaacggccgccgccgcatcctcatctccggctctatccactacccgagaagcacccccgagatgtggcccgggctgatccagaaggccaaggacggcggcctcgacgtcatccagacctacgtcttctggaacggccacgagccggtgcaggggcagtaccacttcgccgaccgctacgacctcgtccgcttcgtcaagctcgtcaggcaggccggcctctacgtccacctccgcatcggcccctacgtctgcgccgagtggaacttcggtggctttcctgtttggctcaagtatgtgccgggcatcaggttcaggacagacaatggccccttcaaggctgcaatgcagaagttcgtcgagaagatagtgtccatgatgaagtcggaggggctatttgagtggcagggaggcccaatcatcatggctcaggtggagaacgagttcgggccgatggagtctgttgtgggcagtggcgccaagccatatgctcactgggcggcccagatggctgttgggaccaacaccggtgtgccgtgggtgatgtgcaagcaagatgacgcccctgaccctgtgatcaacacttgcaatggcttctattgcgactacttcacaccgaacaggaagtacaagccaaccatgtggaccgaagcctggactggatggtttaccaagtttggtggtgcgttgcctcaccggcctgtcgaagacctggccttcgctgtggcacggttcattcagaaaggaggctccttcgtgaactactacatgtaccatggagggacaaactttgggcgcacggctggtggcccttttatcgcaaccagctacgactatgatgcccccatcgatgaatttggtctgcttaggcaaccaaaatggggtcacctgagggacctgcacagggctatcaagcaggctgagcctgcgttgatttctggcgatccaacaatacaatcaattggaaactatgagaaggcatacatcttcaagtcgaagaatggagcctgtgctgcattcctgtcgaactaccacatgaagactgctgtgaaaatcaggtttgatgggcgtcattatgacctccctgcttggtccatcagcattcttcctgactgcaaaaccgcggtcttcaacactgcgacggtgaaggagccaactctgctgccaaagatgaacccagtgttacactttgcttggcagtcctacagcgaagacacaaactcgctggatgacagtgcgtttacaaggaatggcctggttgagcaactcagcttgacatgggacaagtcggactatctgtggtacaccacccatgtcagcattggtggcaatgaacaattcctgaagtctggccagtggcctcagctcactgtgtactcggctggacactcgatgcaggtgttcgtcaatgggagatcatatggatctgtttatggcggctatgacaacccgaaacttacgttcaatgggcatgtgaagatgtggcagggcagtaacaagatctccatcctaagctcggcagtgggccttcctaacaacgggaaccattttgagctgtggaacgtcggcgtcctcgggccggtgaccctctctggcctgaatgaggggaagagggacctcagccatcagaaatggacataccaggtcggcctgaaaggcgaatcgctcggcctccacaccgtgactggaagctccgccgtggaatgggccggccctggcggcaagcagccactgacttggcacaaggccttgttcaacgcgccggcggggagcgatccggtggctctggacatgggcagcatgggcaaaggccagatttgggtgaacgggcaccacgccgggcggtactggtcgtacagggcctactccggcagctgccggcggtgcagctacgccgggacgtaccgcgaggaccagtgcttgtccaactgcggcgacatctcccagagatggtatcacgtgccgcggtcgtggctgaagccgagcgggaacctgctggtggtgctggaggagtacggcggcggcgacctcgccggcgtcaccctcgcgacgcggaccacatga

SEQ ID NO: 10140 - protein, 740 aa, Sorghum bicolor
  misc_feature: Ceres ANNOT ID no. 6111346
  misc_feature (51)..(357): Pfam Id: Glyco_hydro_35 Pfam Desc: Glycosyl hydrolases family 35
  misc_feature (25)..(739): NCBI GI: 452712 NCBI Desc: beta-galactosidase [asparagus officinalis]
  misc_feature (26)..(739): NCBI GI: 33521214 NCBI Desc: beta-galactosidase [sandersonia aurantiaca]
  misc_feature (20)..(740): NCBI GI: 20384648 NCBI Desc: beta-galactosidase [citrus sinensis]
  misc_feature (25)..(738): NCBI GI: 14970839 NCBI Desc: beta-galactosidase [fragaria x ananassa]
  misc_feature (25)..(738): NCBI GI: 4138137 NCBI Desc: ss-galactosidase [lycopersicon esculentum]
  misc_feature (25)..(739): SWISSPROT Homolog: EC 3.2.1.23 Beta-galactosidase precursor
  misc_feature: Useful for making plants with altered cell wall content and/or composition
  misc_feature: Functional homolog of the protein sequence encoded by LOCUS at3g13750
  misc_feature: Functional homolog of the protein sequence encoded by LOCUS at3g52840
  misc_feature: Functional homolog of the protein sequence encoded by LOCUS at4g26140
  misc_feature: Functional homolog of the protein sequence encoded by LOCUS at5g56870
  misc_feature: Useful for making plants with altered cell wall content and/or composition
  misc_feature: Functional homolog of the protein sequence given in SEQ ID NO 13590
  misc_feature: Useful for making plants with altered carbohydrate content
  misc_feature: Functional homolog of the protein sequence given in SEQ ID NO 13588
  misc_feature: The sequence is a functional homolog of SEQ ID NO 2 in US patent 7084321
MAAARRLLAACSSGGGAGAGAGSRILLAVFFLAASLLASAANAAVSYDHRSLVINGRRRILISGSIHYPRSTPEMWPGLIQKAKDGGLDVIQTYVFWNGHEPVQGQYHFADRYDLVRFVKLVRQAGLYVHLRIGPYVCAEWNFGGFPVWLKYVPGIRFRTDNGPFKAAMQKFVEKIVSMMKSEGLFEWQGGPIIMAQVENEFGPMESVVGSGAKPYAHWAAQMAVGTNTGVPWVMCKQDDAPDPVINTCNGFYCDYFTPNRKYKPTMWTEAWTGWFTKFGGALPHRPVEDLAFAVARFIQKGGSFVNYYMYHGGTNFGRTAGGPFIATSYDYDAPIDEFGLLRQPKWGHLRDLHRAIKQAEPALISGDPTIQSIGNYEKAYIFKSKNGACAAFLSNYHMKTAVKIRFDGRHYDLPAWSISILPDCKTAVFNTATVKEPTLLPKMNPVLHFAWQSYSEDTNSLDDSAFTRNGLVEQLSLTWDKSDYLWYTTHVSIGGNEQFLKSGQWPQLTVYSAGHSMQVFVNGRSYGSVYGGYDNPKLTFNGHVKMWQGSNKISILSSAVGLPNNGNHFELWNVGVLGPVTLSGLNEGKRDLSHQKWTYQVGLKGESLGLHTVTGSSAVEWAGPGGKQPLTWHKALFNAPAGSDPVALDMGSMGKGQIWVNGHHAGRYWSYRAYSGSCRRCSYAGTYREDQCLSNCGDISQRWYHVPRSWLKPSGNLLVVLEEYGGGDLAGVTLATRTT

SEQ ID NO: 10141 - DNA, 2622 bp, Sorghum bicolor
  misc_feature: Ceres ANNOT ID no. 6111356
  misc_feature: Encodes the peptide sequence at SEQ ID NO 10142
  misc_feature: Up-regulated in shoot tissues in response to methyl jasmonate treatment
  misc_feature: Up-regulated in root tissues in response to methyl jasmonate treatment
atggcggcggagccggagcagaccgcggagcagttccggggccaggcgcggctgccccacttcgcgaccccgcggcgctacgacctgcgcctcacgcccgacctcgccgcctgcgccttcgccggctcggtgtcggtgtccctcggcgtcaccgcgccgacgcggttcctcgtgctcaacgccgccgagctcgacgtcgcgccagcgggcgtcagcttcgcgccgcagggctccgaccaggtgctgcaacctttggaggttaccaacgtgtcagaagatgagatcctgattattcgcttcagtgaggtgcttcctctcggggaggggactttgacgattgccttccagggaactttgaatgataagatgcatgggttctacagaagtgtgtatgagctcaatggagagaagaaaaacatggctgtaacacagtttgaaccagctgatgcgaggcgctgcttcccttgttgggatgagcctgctttcaaggctgtgttcaaaattactcttgaagttccttctgagaccattgctttgtcaaatatgccagccactgaagagaagatcaatggtcctaccaaaatagtctacttccaggaatctccgataatgtctacatacctagtggctgttattgttggcatttttgactatgtggaagatttcaccacagatggaactagagtccgtgtttatacacaagttggtaagagtgcgcaagggaagtttgctctagaggttgccttgaagacattggtcctctttaaggagtattttgctgtgccataccccctccccaaaatggacatgattgctattccggattttgcagctggagccatggagaactatggcttggttacataccgtgaaacagcattgctatttgatgaaaaacactctgcagctgccaataagcaacgggttgcagttgttgtagctcatgaattagctcatcaatggtttggaaatcttgtcacaatggagtggtggacacatctgtggcttaatgagggctttgcgacttgggtgtcttacttagctgcagatcagttcttccctgaatggaatgtttggactcagtttctagaggaatctacaacaggtttcaagttggatgctcttgcaggttcacatccaattgaggtggacataaatcatgttgatgaaatagatgagatatttgatgctataagctataggaaaggagcttctgtcattcggatgctgcaaagctatcttggggctgaggtctttcagaaatctttggctgcatacatcaaaagatttgcgtattcaaatgcaaagacagaggacttatgggctgcccttgaagaggggtctggtgaaccagttagaacattaatgcattcatggacaaaacagcaaggttatcctgttgtcagtgtgaaagtcaaggatggaaaggtccagctggagcagacacaatttctttcaagtgggtccacaggagatgggcaatgggtggttcctgtcacactatgttgttgtgcgtactcacgccaagagaagttcctttttcatgggaaacaagaagattttgatttgtcagggttagggctcacagaatgccaaaagaagtgtagcttctggattaaacttaatgtcaaccagaccagcttctatagggtgagctatgatgatgaacttgcatcccgacttcggtatgcaattgaaaccaacaaattgagtgcagcagacagatacggtgtgctcgatgatgcttatgccctctgtatggctggcaaacaaaagctagtctccttgttgcagttgatttctgtatacaaggatgagactgagtatactgtgcttgcacaagtaatcacgacgagtctgcacattgccgagatgatggctgttgctgctccagaggagttggttaatctgaagaagttcctaattgatttcctggagccatttgcactgaaacttggctgggatgctaagagtagcgagggccacctgaatgctttgttaagaggcacactattaactgctcttgcagaacttggccatgagactaccataaatgaagctgttcgtcgatttaatgtctttttggaagacagagagacgccgctcctccctccagatgttagaaagacagtgagcaaatcaaacaaaactggctacgaatcgctattgaagatatatagagagactgatctaagccaggagaaagttcgtgtgttaggttctttggcatcatcccctgaccctgatgttgtccgtgaagcattggatttcatattgtcacctgaggtgaggaatcaggacgcaatatttttgctaagaggggtgagttcaggggcacacgaggtcgcatggcaatggctgaaggacaactgggactacatattgggagcctactctggcactctgctcacctatttcgtcaacataaccgtgtcgccactggccaccgatgaacacggtgatgaggcggaggagttcttcaagagcagaaccaagccgaacatcgcgaggactgtgaagcagagcattgagagagtaaggatcaatgcccaatgggtcaagaacatcaaggctgaggctgacctcggcagtgttctcgagaagctggctcacaagcactga

SEQ ID NO: 10142 - protein, 873 aa, Sorghum bicolor
  misc_feature: Ceres ANNOT ID no. 6111356
  misc_feature (18)..(403): Pfam Id: Peptidase_M1 Pfam Desc: Peptidase family M1
  misc_feature (10)..(870): NCBI GI: 29028734 NCBI Desc: at4g33090/f4i10_20 [arabidopsis thaliana]
  misc_feature (1)..(871): NCBI GI: 115476300 NCBI Desc: os08g0398700 [oryza sativa (japonica cultivar-group)]
  misc_feature (344)..(770): NCBI GI: 7270256 NCBI Desc: aminopeptidase-like protein [arabidopsis thaliana]
  misc_feature (4)..(709): NCBI GI: 92871493 NCBI Desc: peptidase m, neutral zinc metallopeptidases, zinc-binding site [medicago truncatula]
  misc_feature (1)..(870): NCBI GI: 51704228 NCBI Desc: puromycin-sensitive aminopeptidase (psa)
  misc_feature: Up-regulated in shoot tissues in response to methyl jasmonate treatment
  misc_feature: Up-regulated in root tissues in response to methyl jasmonate treatment
MAAEPEQTAEQFRGQARLPHFATPRRYDLRLTPDLAACAFAGSVSVSLGVTAPTRFLVLNAAELDVAPAGVSFAPQGSDQVLQPLEVTNVSEDEILIIRFSEVLPLGEGTLTIAFQGTLNDKMHGFYRSVYELNGEKKNMAVTQFEPADARRCFPCWDEPAFKAVFKITLEVPSETIALSNMPATEEKINGPTKIVYFQESPIMSTYLVAVIVGIFDYVEDFTTDGTRVRVYTQVGKSAQGKFALEVALKTLVLFKEYFAVPYPLPKMDMIAIPDFAAGAMENYGLVTYRETALLFDEKHSAAANKQRVAVVVAHELAHQWFGNLVTMEWWTHLWLNEGFATWVSYLAADQFFPEWNVWTQFLEESTTGFKLDALAGSHPIEVDINHVDEIDEIFDAISYRKGASVIRMLQSYLGAEVFQKSLAAYIKRFAYSNAKTEDLWAALEEGSGEPVRTLMHSWTKQQGYPVVSVKVKDGKVQLEQTQFLSSGSTGDGQWVVPVTLCCCAYSRQEKFLFHGKQEDFDLSGLGLTECQKKCSFWIKLNVNQTSFYRVSYDDELASRLRYAIETNKLSAADRYGVLDDAYALCMAGKQKLVSLLQLISVYKDETEYTVLAQVITTSLHIAEMMAVAAPEELVNLKKFLIDFLEPFALKLGWDAKSSEGHLNALLRGTLLTALAELGHETTINEAVRRFNVFLEDRETPLLPPDVRKTVSKSNKTGYESLLKIYRETDLSQEKVRVLGSLASSPDPDVVREALDFILSPEVRNQDAIFLLRGVSSGAHEVAWQWLKDNWDYILGAYSGTLLTYFVNITVSPLATDEHGDEAEEFFKSRTKPNIARTVKQSIERVRINAQWVKNIKAEADLGSVLEKLAHKH

SEQ ID NO: 10143 - DNA, 1461 bp, Sorghum bicolor
  misc_feature: Ceres ANNOT ID no. 6111362
  misc_feature: Encodes the peptide sequence at SEQ ID NO 10144
atgccgccgccaccgcaccagcctaagaatcgtagccgtggtcccgcgcccaccggagagaaccggcggccccagcgtcggatggcgagccgggacgcggcggagcgggccgcgttcttcgcgcggcgagaggcagcagctgtgctccggcgcgtgctccgcggggatgccaccaggcgcgccgcgggctccataaaatcccttgtctactccccaaccgtccgaaacaagcgcgccaccttcgctctcgtctgccagaccctcaagtgtaagtgtcatggtagtcatctgagtaaacaggaggaattggtttatgtgactacctatgacattctctttggtcagggaattgcagtttctggatcagtcgagcaattaattatgcaacaaaaagattctctcaggactactcttgataaagtttgcgctagaaggaaagtcagctgtgctgaagacctattgggcaataaaacagccgtcaaaccaaagccccgatttcttcgtgttaacacactcaagatcactacagagtctgtcattgaagaattgaacaaaatacacatggttgacaaagatgatatgattccagacatgttggtactcccacctggaactgatttgcataaccatccgttggttacagatgggaaagtgtttttgcaggggagagctagttgtatggtagcagttgcattgtcccctaagccaggctggaaggttattgatgcatgtgcggctccagggaacaaaacagtccaccttgctgcactcatgaatggaaagggaagtattatagcttgcgaacttaacaaagagagggccaagacattgcaacatactgtcagaagatctggagcaaataatattcaaatagttaatggtgactttctggaagtagatagaaatgatccatcatatgctgaggtccgtgctattctattggacccctcgtgctctggttctggaatatctacagagagactcgattatttgcttccttcacattctagagataatcaggatgacgcgagtacaagctcaagggtcatgaaactctccgctttccagaagaaagctctctcccatgctctatcatttccctctgtggagagagtggtctacagcacttgctcaatccaccaggcagagaacgaggatgtcgtgaactccgtcctgcccttagctacatcccttggatttgagcttgccacaccattccctcagtggcaccgccgcggccttccagttttccaaggatctgaacatttgcttcggacggaccctgaggatggcctggagggcttcttcattgcattgttcgtcagaaaagaagtgggtggtacttcagaagagcctagcgaagatgccacggtagaagtaagaacaaaacgagtgcccggaaggcgaaatggggtaagggcgttcagctccttgaggttgtccaggatgatcctctggtga

SEQ ID NO: 10144 - protein, 486 aa, Sorghum bicolor
  misc_feature: Ceres ANNOT ID no. 6111362
  misc_feature (154)..(441): Pfam Id: Nol1_Nop2_Fmu Pfam Desc: NOL1/NOP2/sun family
  misc_feature (1)..(485): NCBI GI: 115445043 NCBI Desc: os02g0217800 [oryza sativa (japonica cultivar-group)]
  misc_feature (178)..(474): NCBI GI: 21703826 NCBI Desc: nol1r protein [mus musculus]
  misc_feature (192)..(445): NCBI GI: 16226071 NCBI Desc: nol1r [homo sapiens]
  misc_feature (192)..(445): NCBI GI: 119590100 NCBI Desc: hcg39703, isoform cra_c [homo sapiens]
  misc_feature (176)..(460): NCBI GI: 47086913 NCBI Desc: zgc:77183 [danio rerio]
MPPPPHQPKNRSRGPAPTGENRRPQRRMASRDAAERAAFFARREAAAVLRRVLRGDATRRAAGSIKSLVYSPTVRNKRATFALVCQTLKCKCHGSHLSKQEELVYVTTYDILFGQGIAVSGSVEQLIMQQKDSLRTTLDKVCARRKVSCAEDLLGNKTAVKPKPRFLRVNTLKITTESVIEELNKIHMVDKDDMIPDMLVLPPGTDLHNHPLVTDGKVFLQGRASCMVAVALSPKPGWKVIDACAAPGNKTVHLAALMNGKGSIIACELNKERAKTLQHTVRRSGANNIQIVNGDFLEVDRNDPSYAEVRAILLDPSCSGSGISTERLDYLLPSHSRDNQDDASTSSRVMKLSAFQKKALSHALSFPSVERVVYSTCSIHQAENEDVVNSVLPLATSLGFELATPFPQWHRRGLPVFQGSEHLLRTDPEDGLEGFFIALFVRKEVGGTSEEPSEDATVEVRTKRVPGRRNGVRAFSSLRLSRMILW

SEQ ID NO: 10145 - DNA, 1308 bp, Sorghum bicolor
  misc_feature: Ceres ANNOT ID no. 6111365
  misc_feature: Encodes the peptide sequence at SEQ ID NO 10146
atggccgccgcgacagccgcgggggccggagctgcgaccccgcagccgccacggcagtacaagctagctccgcagagcgagctgcgtgtggaggtgctccccgacgcgcccctccgagtgcgcctcgtcaccggcacggcggagatcttcggcaccgagctgcccccggagggctgggtccccgtccctccccgatccaagatcgccattttcacctggcacggcgcgacggtggaactggatggggtgagcgagagcgagtactcgtctgacgagactccaatggtaatttacgtcaacacgcacgccattctggatgcccgtagggcaagggcgagggctgctgcagctcaggggggcgatatggaggcctcacagggacctagagtgattgttgtggggccaacagattccggaaaaagtactctctgcaagatgctccttagctgggctgccaaactgggctggaagcctacatatgtcgatttagatattggccaggggtctataacaatccctggatgtatttctgccacaccaattgagaaacctatagatatagttgatgggattcccttggaaatgccacttgtatacttctatggccactcaagtccaagtattaatgcggatgtttacaaagttcttatgaaggagctagctaaaacattggagaaacagttctctggcaatgctgaatctagggcagcaggaatggttatcaatacaatggggtgggttgaaggccttgggtatgagttacttcttaatgcaattgagaccttcaaggccaatgtagtactggagaaactctggaagatgttaaaagatgcagttcaaagcaagtccaacattgatgttgtaaaacttcacaaatcagagggtgttgtcctcagaaatacaaaatatcggcaaaaaacgagaagcttccgaatcagggaatatttttatgggattgcaaatgatcttgcaccgcactcaaacattgtcaatttcagtcatgtctcggtgtacaaaatcggtggtggccatcaagctccccgttcagcattacctatcggtgcagagcctgtggcagatcctactcgacttgttgctgtcaacatcagcacggatatgatccatacagtgcttgccatttcctatgctaaggaacctgatgaaataatttctagcaatattgccggattcattcatgttactgatgttgacatccaaaggaagaagctgacgtacattgcaccttgcccgggggacttaccaagcaggctgttgatcgcgagttcactgacatggtacgaagcctga

SEQ ID NO: 10146 - protein, 435 aa, Sorghum bicolor
  misc_feature: Ceres ANNOT ID no. 6111365
  misc_feature (165)..(434): Pfam Id: Clp1 Pfam Desc: Pre-mRNA cleavage complex II protein Clp1
  misc_feature (3)..(434): NCBI GI: 92892674 NCBI Desc: pre-mrna cleavage complex ii clp1 [medicago truncatula]
  misc_feature (16)..(435): NCBI GI: 55245198 NCBI Desc: ensangp00000020766 [anopheles gambiae str. pest]
  misc_feature (19)..(434): NCBI GI: 59709481 NCBI Desc: atp/gtp-binding protein [gallus gallus]
  misc_feature (15)..(434): NCBI GI: 119594176 NCBI Desc: atp/gtp-binding protein [homo sapiens]
  misc_feature (15)..(434): NCBI GI: 123233588 NCBI Desc: novel protein (ai462438) [mus musculus]
MAAATAAGAGAATPQPPRQYKLAPQSELRVEVLPDAPLRVRLVTGTAEIFGTELPPEGWVPVPPRSKIAIFTWHGATVELDGVSESEYSSDETPMVIYVNTHAILDARRARARAAAAQGGDMEASQGPRVIVVGPTDSGKSTLCKMLLSWAAKLGWKPTYVDLDIGQGSITIPGCISATPIEKPIDIVDGIPLEMPLVYFYGHSSPSINADVYKVLMKELAKTLEKQFSGNAESRAAGMVINTMGWVEGLGYELLLNAIETFKANVVLEKLWKMLKDAVQSKSNIDVVKLHKSEGVVLRNTKYRQKTRSFRIREYFYGIANDLAPHSNIVNFSHVSVYKIGGGHQAPRSALPIGAEPVADPTRLVAVNISTDMIHTVLAISYAKEPDEIISSNIAGFIHVTDVDIQRKKLTYIAPCPGDLPSRLLIASSLTWYEA

SEQ ID NO: 10147 - DNA, 1554 bp, Sorghum bicolor
  misc_feature: Ceres ANNOT ID no. 6111380
  misc_feature: Encodes the peptide sequence at SEQ ID NO 10148
  misc_feature: Up-regulated in shoot tissues in response to salicylic acid treatment
  misc_feature: Up-regulated in root tissues in response to salicylic acid treatment
atggacccgtcatcggcgggctccggcggcaactccctcccgtccgttggcgccgacgggcagaagcggcgcgtgtgctacttctacgactcggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgcccgagacgcagcaggaccagatccgcctgctcaagcgcttcaacgtcggcgaggactgccccgtcttcgacggcctctacagcttctgccagacctacgcgggcgcctccgtcggcggggccgtcaagctcaaccacggccacgacatcgcaatcaactggtccggcggcctgcaccacgccaaaaagtgcgaggcgtcgggcttctgctacgtcaacgacatcgtgctcgccatactcgagctgctcaagcatcacgagagagttctgtatgtcgacatcgatatccaccatggggatggagtggaggaggctttctacacaacagacagggttatgacagtctcgttccacaagtttggggattatttcccaggaacaggggatatccgtgacattgggcactcaaaggggaagtactactccctgaatgtccctctggatgatgggattgatgatgaaagctaccagtctcttttcaagccaatcatgggcaaagttatggaggttttccgccctggtgcagttgtgcttcagtgtggtgctgattccttgtctggggataggttgggttgcttcaacctctcaatcagaggtcatgcggaatgtgttaggtacatgaggtctttcaacgttccattgttgctccttggcggtggtggatataccataagaaatgttgcacgctgttggtgttatgagacgggagttgctcttggccaagagcttgaagacaagatgcctgtcaacgagtactatgaatacttcggtccagattacactcttcatgttgcaccaagtaacatggagaacaaaaatacacgaaaccaactggatgatataagatctaaacttctggataatctttcaaaacttcgacatgctcctagcgtccagtttcaagagagagttcctgacaccgaagtacctgagccagatgaagatcaagatgatccagatgaacggcatgatcctgactctgatatggaagtggatgatcacaaggctgtggaagagtcagcgaggaggagcattccaggtataaaagttaagagagaatttggtgaaaatgagaccaaagtgcaggatggtggcagaattgcatctgaccatagaggagtggaacccatggcagaagacattggttcttccaagcaagctcctcaggcggatgccagtgcgatggctgttgatgagccaagcaatgttaagaatgaacctgagagctcaactaaattgcaagatcaagcagctgcataccacaagccataa

SEQ ID NO: 10148 - protein, 517 aa, Sorghum bicolor
  misc_feature: Ceres ANNOT ID no. 6111380
  misc_feature (24)..(334): Pfam Id: Hist_deacetyl Pfam Desc: Histone deacetylase domain
  misc_feature (1)..(517): NCBI GI: 14550104 NCBI Desc: histone deacetylase hda101 [zea mays]
  misc_feature (1)..(517): NCBI GI: 109716220 NCBI Desc: histone deacetylase hdac3 [triticum aestivum]
  misc_feature (1)..(516): NCBI GI: 31324093 NCBI Desc: histone deacetylase hdac1 [oryza sativa (japonica cultivar-group)]
  misc_feature (1)..(482): NCBI GI: 12698880 NCBI Desc: histone deacetylase hd1 [oryza sativa]
  misc_feature (1)..(506): NCBI GI: 31324097 NCBI Desc: histone deacetylase hdac3 [oryza sativa (japonica cultivar-group)]
  misc_feature: Up-regulated in shoot tissues in response to salicylic acid treatment
  misc_feature: Up-regulated in root tissues in response to salicylic acid treatment
MDPSSAGSGGNSLPSVGADGQKRRVCYFYDSDVGNYYYGQGHPMKPHRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKKCEASGFCYVNDIVLAILELLKHHERVLYVDIDIHHGDGVEEAFYTTDRVMTVSFHKFGDYFPGTGDIRDIGHSKGKYYSLNVPLDDGIDDESYQSLFKPIMGKVMEVFRPGAVVLQCGADSLSGDRLGCFNLSIRGHAECVRYMRSFNVPLLLLGGGGYTIRNVARCWCYETGVALGQELEDKMPVNEYYEYFGPDYTLHVAPSNMENKNTRNQLDDIRSKLLDNLSKLRHAPSVQFQERVPDTEVPEPDEDQDDPDERHDPDSDMEVDDHKAVEESARRSIPGIKVKREFGENETKVQDGGRIASDHRGVEPMAEDIGSSKQAPQADASAMAVDEPSNVKNEPESSTKLQDQAAAYHKP

SEQ ID NO: 10149 - DNA, 2223 bp, Sorghum bicolor
  misc_feature: Ceres ANNOT ID no. 6111382
  misc_feature: Encodes the peptide sequence at SEQ ID NO 10150
atggaccatccgtggcgcttccccgcgggcgccggcaccggcgccgacctctgcccggtctgttgcgcgcgccacttacccttctgcccgccgccgcctctcccgccgcatcccttcccctacgacctccagccgccgccaccccctcccccgccgaacccctacccatacgacttccacccgcctccgccaccaccgccgccgatgtggggccctccacctcccgggccgcatgacccgcgtccctacgagctccccggcagggaggggcctcacaagcggatgcgcgtgggcgaggcaccaccgttcgatccgtacgactttgtgcctccaccgcctccgggaagggcttctgtggagggcgatcggctgctcggcctcatccgggatcatggccgtaatcgtaatccacttcctggttgcccacctgacggtggctttggttacggaggaggtagattctatccccggcaaggaggtgatttcgcggatttctaccaaatgttgccacctcccatgccgattgaagattggcataatggcttcggtcaaggttttgtgcccgaagaaggccctcaccggaagtattttgacggttccaatcaccatttccatcagttccacccagaggatttacgacctctcatgcctggtgcgccgctgcaccctccactgcctcgctatcctgaggcagccaatcgccatggttcacatgcttggcatcttgaggcaggtgctgtgccactgccagcagagcctccattcccctctaaccaggattaccgtgctgcaccgccaaggccgactgcaaattcgtcattgtttcctgtcctttctggttctccaacaaccgaaattgttccgtcgaccgctcgtaccttgcctcaagctcatccgacgccaaacacaaaccgttatgatggacacatcaatgatgaggggtcaggtttcatttatcgaccgcagtcagagcagaacttgatagatggaaggccggccagtgcacattattctctggaaaattccaaagtcacgatcatcaatgcttgtgatttgttcaagcagccccttcgtgcttcacgccctgaccatattgttatcatcctcagagggcttccaggtagtggaaagagttatctggcaaaggcattgcgcgatcttgaagtcgagaatggtgcaaatgcgcctaggatccattccatggatgattatttcatgattgaagttgagaaggaagtggaagacactgaaggctctaaatcttctagtgcatcaaaagggaggaggcagttgaccaagaaagtgattgagtattgttatgagctggaaatggaggagacttacaggtcaagcatgttgaaggcattttcaaagacccttgacgaaggaaattttacatttgtgattgtggatgaccgcaatctgcgggtagctgattttgctcaattttgggcaactgcgaagaaatcaggctatgaggtgtacttgctggaggcaccatacaaggatccaacgggctgtgctgcaaggaatgtgcacggatttacattggatgagataaaaaagatggcagcagactgggaggaggctccaccactgtatctgcagctagatatacattcattattccatgatgataaccttcgtggccattctatacaagaggtagatatggacactgaggatgttgatgatgctaatgacacaactagcatcattgctgagacttcacagaaggctgtacaggatccaccatatgaaggcttctcaaagccaggggagaagtggaactcagaagtagaagatgaccgggatggcttaaaagagctaggacagagtaaatggtcaaaagattttgacgatgacaccgaaaagtctgaaaatacagaggaaaacacacatgctctttctggcctggcccagacatatagcactggacgcaaaagagtcagttggggtgatcggcttgaaaagggtgggttttccatttctgcaactaaaagaaaacttacttcgtcactagtcatagggcctggatcagggtacaatttggtctccaaccccttggctgaagatgattccacagggacaaaagggaagacaaacaacgagaacaaaagacggttcagtgaacaacttcgtgttgaaggtgaatccttcagggcagtttttgacaagacaaagcagcgtgttggagtttttgagaatggaaatgaggaataa

SEQ ID NO: 10150 - protein, 740 aa, Sorghum bicolor
  misc_feature: Ceres ANNOT ID no. 6111382
  misc_feature (1)..(740): NCBI GI: 115445011 NCBI Desc: os02g0215000 [oryza sativa (japonica cultivar-group)]
  misc_feature (1)..(740): NCBI GI: 49387952 NCBI Desc: nuclear protein zap-like [oryza sativa (japonica cultivar-group)]
  misc_feature (170)..(588): NCBI GI: 140039777 NCBI Desc: ylp motif-containing protein 1 , related [medicago truncatula]
  misc_feature (245)..(731): NCBI GI: 30697732 NCBI Desc: nuclear protein zap-related [arabidopsis thaliana]
  misc_feature (348)..(658): NCBI GI: 57015374 NCBI Desc: ylp motif containing protein 1 (nuclear protein zap3) (zap113)
MDHPWRFPAGAGTGADLCPVCCARHLPFCPPPPLPPHPFPYDLQPPPPPPPPNPYPYDFHPPPPPPPPMWGPPPPGPHDPRPYELPGREGPHKRMRVGEAPPFDPYDFVPPPPPGRASVEGDRLLGLIRDHGRNRNPLPGCPPDGGFGYGGGRFYPRQGGDFADFYQMLPPPMPIEDWHNGFGQGFVPEEGPHRKYFDGSNHHFHQFHPEDLRPLMPGAPLHPPLPRYPEAANRHGSHAWHLEAGAVPLPAEPPFPSNQDYRAAPPRPTANSSLFPVLSGSPTTEIVPSTARTLPQAHPTPNTNRYDGHINDEGSGFIYRPQSEQNLIDGRPASAHYSLENSKVTIINACDLFKQPLRASRPDHIVIILRGLPGSGKSYLAKALRDLEVENGANAPRIHSMDDYFMIEVEKEVEDTEGSKSSSASKGRRQLTKKVIEYCYELEMEETYRSSMLKAFSKTLDEGNFTFVIVDDRNLRVADFAQFWATAKKSGYEVYLLEAPYKDPTGCAARNVHGFTLDEIKKMAADWEEAPPLYLQLDIHSLFHDDNLRGHSIQEVDMDTEDVDDANDTTSIIAETSQKAVQDPPYEGFSKPGEKWNSEVEDDRDGLKELGQSKWSKDFDDDTEKSENTEENTHALSGLAQTYSTGRKRVSWGDRLEKGGFSISATKRKLTSSLVIGPGSGYNLVSNPLAEDDSTGTKGKTNNENKRRFSEQLRVEGESFRAVFDKTKQRVGVFENGNEE

SEQ ID NO: 10151 - DNA, 936 bp, Sorghum bicolor
  misc_feature: Ceres ANNOT ID no. 6111384
  misc_feature: Encodes the peptide sequence at SEQ ID NO 10152
atgacgaagggcggtcagtctgcgtcctcttcggggcctgaggacgagtcagcggcggcgacttcaacctccgctcccacacccgccccggggcggcggccgagggcgacgcagcagcggctggagatcgagggctaccacgtggagggcatctccatcgccgggcacgagacctgcgtcatgttcccttccctcaacctcgccttcgacatcggccggtgcccgccgctcgccgtctcgcaggacttcctcttcgtctcccacgcgcacatggaccacatcgggggcctcccagtgtacgtcgccacgcggggccgcaggcggatgcgcccgcccaccgtcttcgtccccgcctgcctcgcggacctcgtgcggaggctcttcgacgtgcaccgcgccatggaccagtccgacctcgaccacaagctcgtgccgctcgaggtcggcgaggagtaccagctcaccaaggacctcagcgtcaggccgttcaggacctaccacgtcgggtatgtgatatacaaggtgaagcagaagctcaaggaagagtatgctggcctccctgggaaagagctcagtaatctcaaaaagtctggagttgagattacgaatgtagagtcaacacctgagattgctttctctggagatacaatgtcagatttcatccttgatcctgataatgcagatgtgttgaaggcaaagattcttgtggtcgagagtacttttattgatgactccaaatcaattgaggatgcaagagaaagagggcacattcacttgtctgagatagtgagtctgtctgacaagcttaaaaacaaagctattctactgaatcacttttcacttcgatatactgctgaggacattgatgcagcaataaacagattgccaccatctttccgaagcagagtgtatgcattgaaggaaggcttcttctag

SEQ ID NO: 10152 - protein, 311 aa, Sorghum bicolor
  misc_feature: Ceres ANNOT ID no. 6111384
  misc_feature (38)..(310): NCBI GI: 20975609 NCBI Desc: rnase z [arabidopsis thaliana]
  misc_feature (38)..(310): NCBI GI: 5882718 NCBI Desc: ests gbaa067482 and gbai100542 come from this gene. [arabidopsis thaliana]
  misc_feature (32)..(310): NCBI GI: 20975607 NCBI Desc: rnase z [arabidopsis thaliana]
  misc_feature (40)..(203): NCBI GI: 41017597 NCBI Desc: nuclear ribonuclease z (rnase z) (trna 3 endonuclease) (zinc phosphodiesterase elac)
  misc_feature (46)..(304): NCBI GI: 116120244 NCBI Desc: metallo-beta-lactamase [leptospira borgpetersenii serovar hardjo-bovis l550]
  misc_feature (38)..(310): SWISSPROT Homolog: EC 3.1.26.11 Nuclear ribonuclease Z
  misc_feature: The plant produces a reduced number of seeds.
  misc_feature: The plant senesces significantly earlier than wild-type.
  misc_feature: Useful for biocontainment applications
  misc_feature: Useful for making plants with modulated time to senescence
  misc_feature: Functional homolog of the protein sequence given in SEQ ID NO 13532
  misc_feature: Useful for biocontainment applications
  misc_feature: Useful for making plants with modulated time to senescence
  misc_feature: Functional homolog of the protein sequence given in SEQ ID NO 13532
MTKGGQSASSSGPEDESAAATSTSAPTPAPGRRPRATQQRLEIEGYHVEGISIAGHETCVMFPSLNLAFDIGRCPPLAVSQDFLFVSHAHMDHIGGLPVYVATRGRRRMRPPTVFVPACLADLVRRLFDVHRAMDQSDLDHKLVPLEVGEEYQLTKDLSVRPFRTYHVGYVIYKVKQKLKEEYAGLPGKELSNLKKSGVEITNVESTPEIAFSGDTMSDFILDPDNADVLKAKILVVESTFIDDSKSIEDARERGHIHLSEIVSLSDKLKNKAILLNHFSLRYTAEDIDAAINRLPPSFRSRVYALKEGFF

SEQ ID NO: 10153 - DNA, 1278 bp, Sorghum bicolor
  misc_feature: Ceres ANNOT ID no. 6111397
  misc_feature: Encodes the peptide sequence at SEQ ID NO 10154
atgtcctccaacacggtggagctaccaccatcgccgccagaggaagacacctctgcttctaacgtgctcacaaacgaagatctccttgacaacattcttctccgcctcaaatgtcgaagctgccttgttagtgccgcgctcactagcaagcgctggctgcgcgttgcctctgggctcttcatccccgatttctgcgcgagccaccagccacgcctacttggggtctatgtctccagttgtgatgacctatctagctcagagttcatcccgctcctgcaacctgatgtcgtcaaccatgccaacttcggttttggcaacttgccggcgccgaatgtttgggactgccgaaacggctttgtcctctttgagtttggtggtgagaccttgcaccacactggtatcgctgtgtgctccccactaatctaccctagcatggatagggtcatggtgctcccacggccgccacagccgccctgcttcccggagtaccctcatgcgatgcttctccctactgaccatggtgatgatgccttgtgctaccgcatcaatgtccgtacctgggagtcatcgtatgatacggtcacagtgatggtgtgtgtcctgcggttaggctcctgggtcatccaatgcatagccacagatcgtctcgctaagtcaccgggtcagatcttgccgactactgtgctctccgacggtaagatctacatggcgacccaagcagggtacatcctcggactaaacccaatcaaaaaggcattcttcatcatcgatctcccgaagggtgtagagcatgatcagtacccaggcaactttgtccactgtcggggagacaactcggtcctctacctcatccatgtggatggggacaacatgctcaacgtttggctccgcaagatgaatgatgaccacgggcacaatgacactagtgctgctagcggcagtgccaacgggtgggtgctcagggataccatttccatgcgtgagacttgtggccatctcatggagcagggttgggagacgacagacgacgaggatgaggatgccgctgcaataatggtgaccggcgccggggacaatgccgagtttgtgttcttggagctgggtataactggtgtcatcatctacatgcatctcaagactagggaggtgaagcaggtgtacaagagggagcctgacaatgactacttgattagtgttcgtccgttcatgttcgtaaggcctcctattttcccagtacaggatgctcatgaatgcgaggccgcaccgcatcaagagtaa

SEQ ID NO: 10154 - protein, 425 aa, Sorghum bicolor
  misc_feature: Ceres ANNOT ID no. 6111397
  misc_feature (9)..(411): NCBI GI: 115445599 NCBI Desc: os02g0287900 [oryza sativa (japonica cultivar-group)]
  misc_feature (99)..(414): NCBI GI: 38347670 NCBI Desc: osjnba0054d14.5 [oryza sativa (japonica cultivar-group)]
  misc_feature (99)..(414): NCBI GI: 21742220 NCBI Desc: osjnba0087h01.6 [oryza sativa (japonica cultivar-group)]
  misc_feature (99)..(414): NCBI GI: 116309209 NCBI Desc: osigba0139j17.11 [oryza sativa (indica cultivar-group)]
  misc_feature (10)..(110): NCBI GI: 115481344 NCBI Desc: os10g0188000 [oryza sativa (japonica cultivar-group)]
MSSNTVELPPSPPEEDTSASNVLTNEDLLDNILLRLKCRSCLVSAALTSKRWLRVASGLFIPDFCASHQPRLLGVYVSSCDDLSSSEFIPLLQPDVVNHANFGFGNLPAPNVWDCRNGFVLFEFGGETLHHTGIAVCSPLIYPSMDRVMVLPRPPQPPCFPEYPHAMLLPTDHGDDALCYRINVRTWESSYDTVTVMVCVLRLGSWVIQCIATDRLAKSPGQILPTTVLSDGKIYMATQAGYILGLNPIKKAFFIIDLPKGVEHDQYPGNFVHCRGDNSVLYLIHVDGDNMLNVWLRKMNDDHGHNDTSAASGSANGWVLRDTISMRETCGHLMEQGWETTDDEDEDAAAIMVTGAGDNAEFVFLELGITGVIIYMHLKTREVKQVYKREPDNDYLISVRPFMFVRPPIFPVQDAHECEAAPHQE

SEQ ID NO: 10155 - DNA, 1029 bp, Sorghum bicolor
  misc_feature: Ceres ANNOT ID no. 6111417
  misc_feature: Encodes the peptide sequence at SEQ ID NO 10156
atgaacgacctcttcacgtcggcgtcgttcaagaagtacgcggacctgaagcatcaggtggtgatggacgacctggagtccggcgtcggcggcggcgaggcggagggcccctgcctggaccggttcttcgaggacgtggagggcgtgaaggaggacctgcgcgggctggagtcgctgcaccggcggctgcagtcggcgcacgaggagagcaagaccgcgcacgacgcccgcgccgtcaaggccctccgcgcccgcatggacgccgacgtcgaccaggtgctccgccgcgccaaggccgtgaagaccaagctggaggcgctcgaccgcgccaacgccgccagccgcaggctccccggctgcggtccgggctcctccgccgaccgcacccgcacctccgtcgtcaccggcctcggcaagaagctcaaggacctcatggacgacttccagggcctgcggacgcggatggcggcggagtacaaggagacggtggcgcggcggtactacacggtgacgggggaggaggcggcggaggggacggtggaggcgctgatcgcgtcggggcagagcgagacgttcctgcagaaggcgatccaggagcaggcggcggcggcggggcgcgcgcaggtggtggacacggtgtcggagatccaggagcggcgcgacgcggtggtggaggtggagcgcagcctcagggagctccaccaggtgttcctggacatggcggcgctggtggaggcgcagggacaccagctgaacgacatcgagagccacgtggcgcgcgccagctccttcgtgctccgcggcgccgtcgagctcgaggccgccagggagtaccagaggagtggccgaaagtgggcgtgcgtcgccctcgtcgctgccgcgttgctcgccgctgtcgtcgttctacccgtcctcgtcaacctccacctcctcagcctgagacggaatgttcgtggcctgccgagagtgcggtctgcggtggcagcagatgctgcagcctgtggcgaggttctttggtggcggccgtaa

SEQ ID NO: 10156 - protein, 342 aa, Sorghum bicolor
  misc_feature: Ceres ANNOT ID no. 6111417
  misc_feature (38)..(145): Pfam Id: Syntaxin Pfam Desc: Syntaxin
  misc_feature (218)..(280): Pfam Id: SNARE Pfam Desc: SNARE domain
  misc_feature (4)..(314): NCBI GI: 32308092 NCBI Desc: syntaxin-like protein 4 [hordeum vulgare subsp. vulgare]
  misc_feature (1)..(304): NCBI GI: 4206787 NCBI Desc: syntaxin-related protein nt-syr1 [nicotiana tabacum]
  misc_feature (32)..(305): NCBI GI: 42572385 NCBI Desc: syntaxin 121 (syp121) / syntaxin-related protein (syr1) [arabidopsis thaliana]
  misc_feature (1)..(306): NCBI GI: 78146241 NCBI Desc: snare protein [oryza sativa (japonica cultivar-group)]
  misc_feature (1)..(306): NCBI GI: 33465459 NCBI Desc: syntaxin [hordeum vulgare subsp. vulgare]
MNDLFTSASFKKYADLKHQVVMDDLESGVGGGEAEGPCLDRFFEDVEGVKEDLRGLESLHRRLQSAHEESKTAHDARAVKALRARMDADVDQVLRRAKAVKTKLEALDRANAASRRLPGCGPGSSADRTRTSVVTGLGKKLKDLMDDFQGLRTRMAAEYKETVARRYYTVTGEEAAEGTVEALIASGQSETFLQKAIQEQAAAAGRAQVVDTVSEIQERRDAVVEVERSLRELHQVFLDMAALVEAQGHQLNDIESHVARASSFVLRGAVELEAAREYQRSGRKWACVALVAAALLAAVVVLPVLVNLHLLSLRRNVRGLPRVRSAVAADAAACGEVLWWRP

SEQ ID NO: 10157 - DNA, 1470 bp, Sorghum bicolor
  misc_feature: Ceres ANNOT ID no. 6111418
  misc_feature: Encodes the peptide sequence at SEQ ID NO 10158
atgccggaataccaagtggcgccgacgccggcgccgccacgaccgtccaaaaggtctcggcactttcaagaggcgcgggcgccggtggtgccaccgccgtttctacccaacgaagtgatcctcgaacagattctgacgcgcgtcccggcagctgacaccattcgcttccgggcggtctgccgagagtggcgcgccgcgctcacctccgaccacttcgtccgggcgcaccaagccgtcgtcagagccgccgcccagccgccgtcgccggagatcgttttcttcgcgcccaccgccgcaggctccaccaccacgtccttctactcctcgaggctgctgcttactacgtcatccgcacagcagaacggcggctcgtcgtcgtcggcccgcgagctcgtcaccgtgcgcgacatgcccgccgacgatctcgtcatctccggcaccaagccctgccgcgggctcaccctcctcttccagcccagcgtgtccgcgtaccacgtctgcaacctctccaccggagagcacgtctccctgcccccttgcccatgggctaggagagtgatcgccgacggtccctacgtgctgtcgagcaccgggctcggcttcgaccgggcggccaacgagcacaaggtggtcaggctcttcgaggactggaataagcagccgcactgcgaggtgtacggcctgaggtccggcggatggtggcgcccctgcgccggcgacgtgccgccgcacgcgcccaggggtctctgcagccgtcccccggtgtttgtggacggctacttctactggcacatgaacaccgagatgaacttctatggctgggaagccaggtccttggcaacgccggagcccatcctgtcgctcgccgtcgacaccgagcagttccggtgggtacacccgccggaggaacgggcgcgctacgccttccatctcgccgacctcgacggctttctgtgccgacctcgaggaggctcgacgacgacgacgacgacgacggcgacgtcgccgtggacgttgcgctgccgcatcagcttggcgagcgtggtgcctcggccgatgggggacgccctgcgcgctgggttccgtgtgctcccgctcggctcctcctcgcctggaggagagatccttctcgccacgagccggcacgaggtgtacgcctacgaccctgagagcaaccgtgctcgcagggcgttctccgcgcacgagttcgtagacaccctgacgcgcgagtcggagcttctcctcaacatcgccgtacatgaggaatgggccaccccggtgtgccggcgtcctggggacgacggtgatgatgtgggcaagctgaagatgaagcctggcaaccggactgttgccaggcaaggaggacgaggacctacggaccggcgcagagacgatgtcattgctatggccgtgcggatgttctgccttcatcagcgtcacaagaatggcctaatacggcctaacatctag

SEQ ID NO: 10158 - protein, 489 aa, Sorghum bicolor
  misc_feature: Ceres ANNOT ID no. 6111418
  misc_feature (30)..(78): Pfam Id: F-box Pfam Desc: F-box domain
  misc_feature (17)..(428): NCBI GI: 115471483 NCBI Desc: os07g0268000 [oryza sativa (japonica cultivar-group)]
  misc_feature (143)..(396): NCBI GI: 108862971 NCBI Desc: f-box domain containing protein [oryza sativa (japonica cultivar-group)]
  misc_feature (131)..(391): NCBI GI: 115464951 NCBI Desc: os05g0521400 [oryza sativa (japonica cultivar-group)]
  misc_feature (19)..(214): NCBI GI: 38346710 NCBI Desc: osjnba0086o06.8 [oryza sativa (japonica cultivar-group)]
  misc_feature (35)..(230): NCBI GI: 110289289 NCBI Desc: f-box domain containing protein [oryza sativa (japonica cultivar-group)]
  misc_feature: The sequence is a functional homolog of SEQ ID NO. 456 in the 11/188,298 US application
MPEYQVAPTPAPPRPSKRSRHFQEARAPVVPPPFLPNEVILEQILTRVPAADTIRFRAVCREWRAALTSDHFVRAHQAVVRAAAQPPSPEIVFFAPTAAGSTTTSFYSSRLLLTTSSAQQNGGSSSSARELVTVRDMPADDLVISGTKPCRGLTLLFQPSVSAYHVCNLSTGEHVSLPPCPWARRVIADGPYVLSSTGLGFDRAANEHKVVRLFEDWNKQPHCEVYGLRSGGWWRPCAGDVPPHAPRGLCSRPPVFVDGYFYWHMNTEMNFYGWEARSLATPEPILSLAVDTEQFRWVHPPEERARYAFHLADLDGFLCRPRGGSTTTTTTTATSPWTLRCRISLASVVPRPMGDALRAGFRVLPLGSSSPGGEILLATSRHEVYAYDPESNRARRAFSAHEFVDTLTRESELLLNIAVHEEWATPVCRRPGDDGDDVGKLKMKPGNRTVARQGGRGPTDRRRDDVIAMAVRMFCLHQRHKNGLIRPNI

SEQ ID NO: 10159 - DNA, 2793 bp, Sorghum bicolor
  misc_feature: Ceres ANNOT ID no. 6111429
  misc_feature: Encodes the peptide sequence at SEQ ID NO 10160
atgggcgtgctccggcagccgctccggttggatatcaagaggaagctcgcgcagaggtccgagagggtgaagtccgtggatctgcatccgacagagccatggattttgtcgagtctgtactcgggaagcgtttgtgtatggaactaccagactcagacaatggtgaaatcatttgaagtcacggatttaccagttcgttcggctaaatttattgcacgtaagcaatgggttgttgctggtgctgacgatatgttcatccgtgtgtacaactataacacaatggacaaggtcaaggtttttgaagctcacactgattacattaggtgtgtggctgttcatccaacccagccctttgtgctatcatcgtccgatgacatgctgattaagctgtgggattgggataaaggctgggtgtgtactcaaatattcgaagggcattctcactatgtgatgcaagttacatttaacccaaaagataccaacacctttgccagtgcttccctggatcgcacaataaagatatggagtcttggttcccctgacccaaatttcacactagatggccattcaaaaggtgtgaactgtgttgattacttcactggtggtgatcgaccatacttaattactggctctgatgatcagactgcaaaggtttgggactaccaaacaaagagttgcgttcaaacacttgaaggacatgcacataatgtgtctgctgtatgtttccatccagagctacctataataattactggttcagaggatgggacagttcgaatgtggcattctactacctacaggcttgagaacactcttaactatggccttgagcgagtttgggctttaggatatatgaaagggtcaagaagggtcgtgattggatatgatgaagggacaataatgataaaaattggtcgtgaagttcctgttgctagcatggatagcagtgggaaaattatatgggcaaagcataatgaaatccaaactgttaatatcaagagtgttggtgcagacaatgagatcgcagatggtgatcggttaccattggccgtgaaggagttgggaagctgcgatctttatccacaaagcttaaggcacaatccgaatgggagatttgttgttgtatgcggagatggagattacataatatacacagcattagcatggagaaacaaatcatttgggaccgcacttgaagttgtttggtcaactgatggagaatatgccatcagagaaagcacctcgaggataaagatatacactaaaaatttccaggagaagaaaagtataaggccatcattttctgctgaacggatatttggtggagtgttacttgctatgtgtacaaatgacttcatttgcttctatgattgggtggattgcagattgatacgtcgaattgatgtcaatgtgaagaatctttactgggccgacagtggtgatttagtaacaattgcaagtgatacgtcattctacattttgaaatataatagggatgtagtttcatctcatttggatggagggggttcagctggtgaggaaggtgtggaagatgcctttgaactgcttcatgagatcaatgaacgtgtccgcactgggctatgggttggcgattgcttcatctacaataattcttcatggcggcttaattactgtgtaggaggagaggtcacaaccttgtttcacttggatcggccaatgtatttactaggatatcttgcaaaccaaagccgtgtctatcttattgataagcaatttaatgttgtggggtatactttactccttagtttgatcgagtataaaacacttgtaatgcgtggggattttgatcgcgcgaatgatgttttatcatctataccaaaggaacaatatgacagtgtggcacgtttcttggaatcacggggaatgttggaggaagccctcgagatagcaactgacactaattacaaatttgacctggctgtgcagcttggtcgacttgaaattgcgaaggcgattgctaccgaggtgcaaagtgagtccaagtggaagcaattaggggagttagctatgtcaaatggaaagcttgagatggcagaggagtgtcttctacatgctatggacctcagtggtttgttgcttttgtattcttcccttggggatgctgatggcattaagaaattggcatctgtagccaaagaacaaggaaagaacaatgtttctttcctttgtttcttcatgctaggaaagctggaagagtgtcttcagttgctaatagaaagcaaccgtattccggaagcagcattgatggcaagatcttatcttcctagcaaagtccctgagattgtagcattgtggaaaaaggatctccagaaggtaaacccaaaagcagcagagtcgctggctgatcctaatgagtacccaaacttatttgaagactggcagattgctctcaatgtagaagctgttgttgccccgaaaaggggtatctatccacctgccgaggagtacatgattcatgctgaaaggtcaaatgagagtttagtggaagcttttaaaaatatgcatgtacatgaagagatggtaccagatgataatgaagatactgttcatgaggttattgaggatggtggagtagaagagagtcaagaagatgctgttgagggtgatgcagaggatgacggagtagaagaagaaagtcaagacgaagctgttgaggttgaggctgagggttcaactgatggtgctgtccttgtgaatggaaacagtagtgaggaacagtggggtacgaaaaatgaagaaccatcagcataa

SEQ ID NO: 10160 - protein, 930 aa, Sorghum bicolor
  misc_feature: Ceres ANNOT ID no. 6111429
  misc_feature (324)..(784): Pfam Id: Coatomer_WDAD Pfam Desc: Coatomer WD associated region
  misc_feature (94)..(132): Pfam Id: WD40 Pfam Desc: WD domain, G-beta repeat
  misc_feature (137)..(176): Pfam Id: WD40 Pfam Desc: WD domain, G-beta repeat
  misc_feature (180)..(220): Pfam Id: WD40 Pfam Desc: WD domain, G-beta repeat
  misc_feature (224)..(262): Pfam Id: WD40 Pfam Desc: WD domain, G-beta repeat
  misc_feature (7)..(929): NCBI GI: 119638456 NCBI Desc: coatomer complex subunit [brachypodium sylvaticum]
  misc_feature (14)..(930): NCBI GI: 9294445 NCBI Desc: coatomer protein complex, beta prime; beta'-cop protein [arabidopsis thaliana]
  misc_feature (295)..(930): NCBI GI: 115444969 NCBI Desc: os02g0209100 [oryza sativa (japonica cultivar-group)]
  misc_feature (7)..(895): NCBI GI: 56789724 NCBI Desc: coatomer protein complex, subunit beta 2 (beta prime) [rattus norvegicus]
  misc_feature (7)..(839): NCBI GI: 27697187 NCBI Desc: wu:fc55e05-prov protein [xenopus laevis]
  misc_feature: The sequence is a functional homolog of SEQ ID NO. 485 in the 11/188,298 US application
  misc_feature: The sequence is a functional homolog of SEQ ID NO. 502 in the 11/188,298 US application
MGVLRQPLRLDIKRKLAQRSERVKSVDLHPTEPWILSSLYSGSVCVWNYQTQTMVKSFEVTDLPVRSAKFIARKQWVVAGADDMFIRVYNYNTMDKVKVFEAHTDYIRCVAVHPTQPFVLSSSDDMLIKLWDWDKGWVCTQIFEGHSHYVMQVTFNPKDTNTFASASLDRTIKIWSLGSPDPNFTLDGHSKGVNCVDYFTGGDRPYLITGSDDQTAKVWDYQTKSCVQTLEGHAHNVSAVCFHPELPIIITGSEDGTVRMWHSTTYRLENTLNYGLERVWALGYMKGSRRVVIGYDEGTIMIKIGREVPVASMDSSGKIIWAKHNEIQTVNIKSVGADNEIADGDRLPLAVKELGSCDLYPQSLRHNPNGRFVVVCGDGDYIIYTALAWRNKSFGTALEVVWSTDGEYAIRESTSRIKIYTKNFQEKKSIRPSFSAERIFGGVLLAMCTNDFICFYDWVDCRLIRRIDVNVKNLYWADSGDLVTIASDTSFYILKYNRDVVSSHLDGGGSAGEEGVEDAFELLHEINERVRTGLWVGDCFIYNNSSWRLNYCVGGEVTTLFHLDRPMYLLGYLANQSRVYLIDKQFNVVGYTLLLSLIEYKTLVMRGDFDRANDVLSSIPKEQYDSVARFLESRGMLEEALEIATDTNYKFDLAVQLGRLEIAKAIATEVQSESKWKQLGELAMSNGKLEMAEECLLHAMDLSGLLLLYSSLGDADGIKKLASVAKEQGKNNVSFLCFFMLGKLEECLQLLIESNRIPEAALMARSYLPSKVPEIVALWKKDLQKVNPKAAESLADPNEYPNLFEDWQIALNVEAVVAPKRGIYPPAEEYMIHAERSNESLVEAFKNMHVHEEMVPDDNEDTVHEVIEDGGVEESQEDAVEGDAEDDGVEEESQDEAVEVEAEGSTDGAVLVNGNSSEEQWGTKNEEPSA

SEQ ID NO: 10161 - DNA, 1251 bp, Sorghum bicolor
  misc_feature: Ceres ANNOT ID no. 6111435
  misc_feature: Encodes the peptide sequence at SEQ ID NO 10162
atggccgcctctgtcgcctcgtcggcgttcttcccggtgccggcttcggcgcccaagaacgcaccgggcaggtccaaggacaacctggacatgggtggggtcgccgcaaacgtgggcgcggtgaggtcctcctcagcaagggcgcgcgcgcacgccgccgtccccaaggtgaacagcggcgggaaggctgcggtgactgacggtgaggacgatgcgtcccgctcctcggctccggctccggctccgaggacgttctacaaccagctgccggactggagcgtgctgcttgcggccatcacgaccatcttcctggcagccgagcggcagtggacgctggtggactggaagcccaagcggcccgacatgctcatcgacacgttcggcttcaacgggcaggtgttccggcaggacttctccatccgatcctatgagattggggccgacaggacggcatccatagagacgctgatgaatcatttgcaggagacggcccttaatcatgtcaagagtgccgggctgcttggtgatggctttggttcgacaccagagatgagcaaacggaacttgttctgggttgtcagtcagatgcaggtcttggtggagaagtatccatgctggggagatacagttggtatagatacatgggtcagtggtcatggtaaaaacggaatgcgtcgagattggcatttacatgatcgcagcacagggcagactatattgagggctacaagtaaatgggttatgatgcataagcatactagaaaactcgcaaggattcctgatgaagtgaggactgaaatagcaccatatttttttgagctcaccgctattgctgatgaagacagccgcaaacttccaaaattgccagggaatggtgaagctagggctagaaaatacgtccgaaggggtttgactcctcgatggtccgatcttgatctaaaccagcatgtcaacaatgttagatacattgggtggattcttgagagcgctccaatctccatatttgagaatcatgaactggctagcattgtcctagactacaagagggagtgcagtaaggacagtgtgctgcagtcacacaccacagtgttcactgactgcactgatgggttaggagaaacaacctttcagtgtgagcatcttctgtgccttgagtcagggcataccattgtgaaggctcggactatgtggaggccaaagagaacccatgccatgggaatattggctccagtctcagctggcaaattttag

SEQ ID NO: 10162 - protein, 416 aa, Sorghum bicolor
  misc_feature: Ceres ANNOT ID no. 6111435
  misc_feature (131)..(399): Pfam Id: Acyl-ACP_TE Pfam Desc: Acyl-ACP thioesterase
  misc_feature (1)..(414): NCBI GI: 90018255 NCBI Desc: palmitoyl-acp thioesterase [elaeis guineensis]
  misc_feature (1)..(414): NCBI GI: 30962820 NCBI Desc: palmitoyl-acyl carrier protein thioesterase [elaeis guineensis]
  misc_feature (1)..(406): NCBI GI: 119638461 NCBI Desc: acyl-atp thioesterase [brachypodium sylvaticum]
  misc_feature (1)..(328): NCBI GI: 115468772 NCBI Desc: os06g0596300 [oryza sativa (japonica cultivar-group)]
  misc_feature (1)..(410): NCBI GI: 12004037 NCBI Desc: acyl-acp thioesterase [iris germanica]
MAASVASSAFFPVPASAPKNAPGRSKDNLDMGGVAANVGAVRSSSARARAHAAVPKVNSGGKAAVTDGEDDASRSSAPAPAPRTFYNQLPDWSVLLAAITTIFLAAERQWTLVDWKPKRPDMLIDTFGFNGQVFRQDFSIRSYEIGADRTASIETLMNHLQETALNHVKSAGLLGDGFGSTPEMSKRNLFWVVSQMQVLVEKYPCWGDTVGIDTWVSGHGKNGMRRDWHLHDRSTGQTILRATSKWVMMHKHTRKLARIPDEVRTEIAPYFFELTAIADEDSRKLPKLPGNGEARARKYVRRGLTPRWSDLDLNQHVNNVRYIGWILESAPISIFENHELASIVLDYKRECSKDSVLQSHTTVFTDCTDGLGETTFQCEHLLCLESGHTIVKARTMWRPKRTHAMGILAPVSAGKF

SEQ ID NO: 10163 - DNA, 990 bp, Sorghum bicolor
  misc_feature: Ceres ANNOT ID no. 6111440
  misc_feature: Encodes the peptide sequence at SEQ ID NO 10164
atggcggtggacgaggtgaattcggtctacgtcggcggccttccctacgaggccaacgaggagatgcttcgcgacgccttcgggtactacggcaccatcgtctccgtcaaggtgattaatgatcattctgtcaaaggcaagtgttatggttttgttactttcactcaccccagagctgctgagcaagcaattgcaggcatggatggcaagaaattaggcaatcgtattgttcgagtaaatgaagtgcgtacaagaggtccccgagattttggtcgagatggtttcagacgagatccaagaaggtatggtagagatccatactgggacagaagggatagggaacggagctatgatcgtgaaagggatccctaccatgacagggatagtgatagatcccgtgagcatgatagagaaagagattatgagcatggtggctttaatcgagaaattgactatcccatggatcgagatcatgaagtagacgagagacgtcctagagaacatgatcgtgcagctgaaatgcataatatggattcagataatgacaaagatagggagcatggaacaagaaaaaggttcagccgcccgaaaggtcgtgatagcagagatttatcgagttccagtgatgatcttcaaaatgatggaaagcaccagttggataaaactattcagatgcgtgaggaccttgaaaatgaggttaaccagattaaggataaaatatctggaaaagaacagcacattgcagatttgcagaagaaagctcagaaattagaggatgaactggatgccgcgcggaaagtctcttcagaacgacaattagctgttacagacctgtacaaacattttcttcaacttcaagactacaacgatagggtcaaaacggctgaacagaggctgcagtctcttgttgatgctgccatggtcgagcttgacatagccgaagatgctactaccagagatggctcaatgtatgagaatggggtggtctga

SEQ ID NO: 10164 - protein, 329 aa, Sorghum bicolor
  misc_feature: Ceres ANNOT ID no. 6111440
  misc_feature (9)..(79): Pfam Id: RRM_1 Pfam Desc: RNA recognition motif. (a.k.a. RRM, RBD, or RNP domain)
  misc_feature (1)..(309): NCBI GI: 21553602 NCBI Desc: glycine-rich rna-binding protein-like [arabidopsis thaliana]
  misc_feature (225)..(328): NCBI GI: 115444957 NCBI Desc: os02g0208200 [oryza sativa (japonica cultivar-group)]
  misc_feature (4)..(329): NCBI GI: 51703810 NCBI Desc: snrp70-prov protein [xenopus tropicalis]
  misc_feature (4)..(148): NCBI GI: 45544646 NCBI Desc: cold inducible rna binding protein [danio rerio]
  misc_feature (4)..(148): NCBI GI: 94733362 NCBI Desc: cold inducible rna binding protein [danio rerio]
  misc_feature: The plant is abnormally small.
  misc_feature: The sequence is a functional homolog of SEQ ID NO 1039 in the 10/374,780US patent application
  misc_feature: The sequence is a functional homolog of SEQ ID NO 1042 in the 10/374,780US patent application
  misc_feature: The sequence is a functional homolog of SEQ ID NO 849 in the 10/666,642US patent application
  misc_feature: The sequence is a functional homolog of SEQ ID NO 852 in the 10/666,642US patent application
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 12995
  misc_feature: The sequence is a functional homolog of SEQ ID NO 1039 in the 20060162006 US patent application
  misc_feature: The sequence is a functional homolog of SEQ ID NO 1042 in the 20060162006 US patent application
  misc_feature: Useful for making plants with modulated biomass
  misc_feature: Functional homolog of the protein sequence given in SEQ ID NO 12995
  misc_feature: The sequence is a functional homolog of SEQ ID NO. 339 in the 11/188,298 US application
  misc_feature: The sequence is a functional homolog of SEQ ID NO. 458 in the 11/188,298 US application
MAVDEVNSVYVGGLPYEANEEMLRDAFGYYGTIVSVKVINDHSVKGKCYGFVTFTHPRAAEQAIAGMDGKKLGNRIVRVNEVRTRGPRDFGRDGFRRDPRRYGRDPYWDRRDRERSYDRERDPYHDRDSDRSREHDRERDYEHGGFNREIDYPMDRDHEVDERRPREHDRAAEMHNMDSDNDKDREHGTRKRFSRPKGRDSRDLSSSSDDLQNDGKHQLDKTIQMREDLENEVNQIKDKISGKEQHIADLQKKAQKLEDELDAARKVSSERQLAVTDLYKHFLQLQDYNDRVKTAEQRLQSLVDAAMVELDIAEDATTRDGSMYENGVV

SEQ ID NO: 10165 - DNA, 1929 bp, Sorghum bicolor
  misc_feature: Ceres ANNOT ID no. 6111441
  misc_feature: Encodes the peptide sequence at SEQ ID NO 10166
atggagtccggcctcgtcgcaagccaccgcctccgcctcccttccccgtccgcctccgccgggcaccaccaccaccacctcctccgccaccgccacgcccacgccccggcaccgctccgcctcagcctcccgcgccacctcccggggcccgccccgctccgcctgcccgccgcgctcccgctccgcccctacctcccgcccctccgcgcctccgcctccgcctccgccgccgcagcgcccggggatgacgcctccgcggcgtcgcccaagttcctgggcgtggagacgaagacgctgaagaagatcgtgccgctggggctcatgttcttctgcatcctcttcaactacaccatcctgcgggacaccaaggacgtgctcgtcgtcaccgccaagggcagcagcgccgagatcatcccgttcctcaagacctgggtcaacctgcccatggccgtcggcttcatgctcctctacaccaagctcgccgacgtgctctccaaggaggcgctcttctacgccgtcatcttccccttcatcgccttcttcggggccttcgcctacgtgctctaccccatgcgcgacgccatccaccccaccgcgctcgccgaccgactcctcgcctcgctcggccccagcttcctcgggcccgttgccatcctccgcgtctggagcttctgcctcttctacgtcatggccgagctctggggcagcgtcgtcatatccgtcctcttctgggggtttattactacagttgaagaggccaaagagttctacccgctgtttgggcttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttatcatcaccggtatctattggggggtgaacaagtttgttattgataactcatctatgcccgtggtcgagcggaaaaagaaggacaagccaaagctcagcatgggtgagagcatgaaggttctgttgtcatctcggtatgtgagggatcttgccacattggtcgttgcttatggaataagcattaaccttgtggaggtgacatggaaatcaaaattgaaagcacagttcccaagcccaaatgaatattcttcattcatgggcgatttctcaactgccaccggcatagctacctttacaatgatgttgttagggagagtaatcctcagaaagttcgggtggggagttgcagctacgatcacacctgcagtgttacttctcacaggagttgggttcttctcactgattttgtttggtgagccattgactcctcttatgaccaagtttgggatgacacctttgcttgcggcagtctatgttggagcaatgcagaacattttcagtaagagtgcaaagtacagtctgtttgatccttgcaaagagatggcatacattcctttggatgaggatatgaaggttaaaggtaaagcagctattgacgttgtctgcaaccccttggggaaatctggaggtgctttgatccagcagttcatgatcctgtcatttggatctcttgcgaattcgacaccctaccttggtggaatacttctggtgattgttcttgcatggctgggtgctgtaaggtccctcgactcacagttttcaaccctggcaaagcaagatctcgagaaagaaaagatgctgaaagcacaggccgtcgaagtcgaaacaactgccaaagtagtcgggactggaaatggttctctccaagaaactctagctagtgagccatctgcaaatggtgcagctaccaaacagtctcgagaacctgagagtacaaccacggagaaatcaggccaagaacctgagagtacaaccacggagaaatcaggccaacagtctcaataa

SEQ ID NO: 10166 - protein, 642 aa, Sorghum bicolor
  misc_feature: Ceres ANNOT ID no. 6111441
  misc_feature (77)..(561): Pfam Id: TLC Pfam Desc: TLC ATP/ADP transporter
  misc_feature (1)..(628): NCBI GI: 115444955 NCBI Desc: os02g0208100 [oryza sativa (japonica cultivar-group)]
  misc_feature (71)..(610): NCBI GI: 61971467 NCBI Desc: plastid atp/adp transporter [oryza sativa (japonica cultivar-group)]
  misc_feature (62)..(605): NCBI GI: 21063925 NCBI Desc: plastidic atp/adp transporter [citrus hybrid cultivar]
  misc_feature (14)..(624): NCBI GI: 71068360 NCBI Desc: plastid atp/adp transport protein 2 [manihot esculenta]
  misc_feature (14)..(616): NCBI GI: 71068362 NCBI Desc: plastid atp/adp transport protein 2 [manihot esculenta]
  misc_feature: Useful for making plants with atered amino acid content
  misc_feature: Functional homolog of the protein sequence given in SEQ ID NO 13592
MESGLVASHRLRLPSPSASAGHHHHHLLRHRHAHAPAPLRLSLPRHLPGPAPLRLPAALPLRPYLPPLRASASASAAAAPGDDASAASPKFLGVETKTLKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFITTVEEAKEFYPLFGLGANVALIFSGRTVKYFSNMRKNLGPGVDGWAISLKAMMSIVVVLGLIITGIYWGVNKFVIDNSSMPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSTLAKQDLEKEKMLKAQAVEVETTAKVVGTGNGSLQETLASEPSANGAATKQSREPESTTTEKSGQEPESTTTEKSGQQSQ

SEQ ID NO: 10167 - DNA, 1026 bp, Sorghum bicolor
  misc_feature: Ceres ANNOT ID no. 6111461
  misc_feature: Encodes the peptide sequence at SEQ ID NO 10168
atggacaagaagaaggtggcggtgccgacggtgtgccatgggcactcgcgcccggtggtggacctcttctacagccccgtcacgcccgacggctacttcctcatcagcgccagcaaagactcaaatccaatgcttcgcaatggtgaaactggagattggattgggacatttcaaggccacaaaggcgctgtatggagcgcttgccttgacaccaatgctctgcgtgctgcgtctggttctgctgacttttcagcaaaaatatgggatgcactaacaggcgatgtgctccactcctttgaacacaagcatattgtccgtgcatgtgctttttctgaggatacccacatgttgcttacaggaggtttcgagaagattttgcgcatatatgatttgaatcgcccagatgcaactccaagagaaattgacaaatcacctggttctgtcagaactgtcacttggcttcatagtgatcaaactatattaagttcctgcgcggatttaggtggtgtgaggttatgggatgtaaggagtgggaaaattgtccaaacacttgaaaccaaatcacctgtcaccagcgcagaagtaagccaagatggtcggtttatcacgacaactgatggctcaagcgtgaagttttgggatgcaaatcactttggacttgttaagagttataatatgccatgtgcagtggagtcagcttctctcgaaccgaattgtgggaataaatttgtcacaggtggagaagacatgtgggttcgtgtctttgatttcttcactggagaagaattagcatgtaacaaggggcaccatggtccggtccactgcgtacggtttactcctgttggtgaatcttatgcatcaggatccgaagacggaaccatccgaatttggcagttgggtccagctaacagcgacgaacaggaggcagcaagtgcaaatgggaaggcaaaggtcggggtaaatgatgtcgcacgtaagatcgagggtttccacatttctaaggacgggcaggtagagggcacttga

SEQ ID NO: 10168 - protein, 341 aa, Sorghum bicolor
  misc_feature: Ceres ANNOT ID no. 6111461
  misc_feature (51)..(89): Pfam Id: WD40 Pfam Desc: WD domain, G-beta repeat
  misc_feature (92)..(130): Pfam Id: WD40 Pfam Desc: WD domain, G-beta repeat
  misc_feature (260)..(298): Pfam Id: WD40 Pfam Desc: WD domain, G-beta repeat
  misc_feature (1)..(340): NCBI GI: 115468796 NCBI Desc: os06g0598900 [oryza sativa (japonica cultivar-group)]
  misc_feature (9)..(298): NCBI GI: 48122105 NCBI Desc: similar to ensangp00000003345 [apis mellifera]
  misc_feature (9)..(298): NCBI GI: 41053501 NCBI Desc: serine/threonine kinase receptor associated protein [danio rerio]
  misc_feature (9)..(298): NCBI GI: 51895969 NCBI Desc: mgc86380 protein [xenopus laevis]
  misc_feature (9)..(298): NCBI GI: 12667270 NCBI Desc: serine-threonine kinase receptor-associated protein [carassius auratus gibelio]
  misc_feature: The sequence is a functional homolog of SEQ ID NO. 502 in the 11/188,298 US application
  misc_feature: The sequence is a functional homolog of SEQ ID NO. 485 in the 11/188,298 US application
MDKKKVAVPTVCHGHSRPVVDLFYSPVTPDGYFLISASKDSNPMLRNGETGDWIGTFQGHKGAVWSACLDTNALRAASGSADFSAKIWDALTGDVLHSFEHKHIVRACAFSEDTHMLLTGGFEKILRIYDLNRPDATPREIDKSPGSVRTVTWLHSDQTILSSCADLGGVRLWDVRSGKIVQTLETKSPVTSAEVSQDGRFITTTDGSSVKFWDANHFGLVKSYNMPCAVESASLEPNCGNKFVTGGEDMWVRVFDFFTGEELACNKGHHGPVHCVRFTPVGESYASGSEDGTIRIWQLGPANSDEQEAASANGKAKVGVNDVARKIEGFHISKDGQVEGT

SEQ ID NO: 10169 - DNA, 1653 bp, Sorghum bicolor
  misc_feature: Ceres ANNOT ID no. 6111473
  misc_feature: Encodes the peptide sequence at SEQ ID NO 10170
atggaggccgcaaccgccgcgacggcggcgatggtgtggttccggaaggggctgcgcgtgcacgacaacccggcgctcgacgcggcccgccggtacggggccggcgccgcctccgcgcggcggctgtacccggtgttcgtgctcgacccgcggtacctccgcccggaccccgccgcgtcctccccgggctccgcgcgcgccggggtcgcccgcatccgcttcctcctcgagagcctcagcgacctcgacgctcgtctccgacgcctcgggtcccgcctcctcctcctccgtgcccgcgacgacgtcgccgacgcggtctgcgcggccctaaaggattggaacatcggcaagctgtgcttcgagtccgataccgagccgtacgcgctggcccgcgataagaaagtcacggattttgcattggcgtccgggatcgaggtgttcacgcctgtcagccacactctcttcgacccagcagaaatcataaagaagaacggtggtcgtccgcctttgacatatcaatcctttgtctccattgctggggagccgccagatcctatcatggaggaatactctgagctcccaccgcttggagacacaggggagtacgagctgttgcccgtgcctacagttgaggagcttgggtatgtggatatcagcgaggaggagattccaccatttcgtggcggggagacagaagctctgaggagaatgaaagaatcacttcaaaataaggaatgggttgccaaatttgagaaaccaaagggtgacccctctgcctttctgaaaccttccacaactgtcttgtcaccatatctgaagtttgggtgcctgtcttccagatatttttaccactgcattcaggatgtgtacaagagcgtcagaaaccatacaaaaccacctgtttcattgataggacagctgctgtggcgagacttcttctacacagtgtcttatggaactcctaattttgaccgaatgaaaggaaacaaaatatgcaagcagattccatggagcgagaacgaggagctatttgttgcatggagagatggccaaacaggatatccatggatcgatgctatcatgattcagctaaggaagtggggctggatgcatcaccttgcacgccattcggttgcttgttttttgacacgcggtgatatgtttatccactgggaaaaaggacgtgatgtctttgaaaggctactgatagattctgactgggccattaacaatggcaattggatgtggctctcttgctcatccttcttctatcagtaccacagaatttactcccctatcacattcggaaagaagtatgatcctaatgggaactacattaggcatttcatcccagtgctgaaagacatgccaagggaatacatttacgagccttggactgctccccttagcatccagaagaaagccaattgtattattggcaaagactacccgaaaccagtagttgatcatgagactgcaagcaaagagtgtaaaaaaaggatgggagaagcttatgcgtcgagtcgccttgatgccaaccctactaaagggaagacattgaactcgtctcgacgaaaaatgccccatggtgaccaagacacgtctaactcaaccatttccaagctactgaagaggaatagccgagctgaatga

SEQ ID NO: 10170 - protein, 550 aa, Sorghum bicolor
  misc_feature: Ceres ANNOT ID no. 6111473
  misc_feature (227)..(505): Pfam Id: FAD_binding_7 Pfam Desc: FAD binding domain of DNA photolyase
  misc_feature (8)..(194): Pfam Id: DNA_photolyase Pfam Desc: DNA photolyase
  misc_feature (8)..(535): NCBI GI: 18400841 NCBI Desc: 6-4 photolyase (uvr3) [arabidopsis thaliana]
  misc_feature (8)..(535): NCBI GI: 11994334 NCBI Desc: 6-4 photolyase [arabidopsis thaliana]
  misc_feature (8)..(435): NCBI GI: 79313247 NCBI Desc: uvr3 (uv repair defective 4) [arabidopsis thaliana]
  misc_feature (10)..(537): NCBI GI: 61816948 NCBI Desc: 6-4 photolyase [dunaliella salina]
  misc_feature (259)..(523): NCBI GI: 51948352 NCBI Desc: cryptochrome-like protein 1 [ostreococcus tauri]
MEAATAATAAMVWFRKGLRVHDNPALDAARRYGAGAASARRLYPVFVLDPRYLRPDPAASSPGSARAGVARIRFLLESLSDLDARLRRLGSRLLLLRARDDVADAVCAALKDWNIGKLCFESDTEPYALARDKKVTDFALASGIEVFTPVSHTLFDPAEIIKKNGGRPPLTYQSFVSIAGEPPDPIMEEYSELPPLGDTGEYELLPVPTVEELGYVDISEEEIPPFRGGETEALRRMKESLQNKEWVAKFEKPKGDPSAFLKPSTTVLSPYLKFGCLSSRYFYHCIQDVYKSVRNHTKPPVSLIGQLLWRDFFYTVSYGTPNFDRMKGNKICKQIPWSENEELFVAWRDGQTGYPWIDAIMIQLRKWGWMHHLARHSVACFLTRGDMFIHWEKGRDVFERLLIDSDWAINNGNWMWLSCSSFFYQYHRIYSPITFGKKYDPNGNYIRHFIPVLKDMPREYIYEPWTAPLSIQKKANCIIGKDYPKPVVDHETASKECKKRMGEAYASSRLDANPTKGKTLNSSRRKMPHGDQDTSNSTISKLLKRNSRAE

SEQ ID NO: 10171 - DNA, 702 bp, Sorghum bicolor
  misc_feature: Ceres ANNOT ID no. 6111476
  misc_feature: Encodes the peptide sequence at SEQ ID NO 10172
atgccgtccctggcactgggcgcggccggcacctggccggaggccgtcatccagtgcctcctcttcctcctcgccgccgggatgctcgtcgcgctccactccctcccccgccgcgtcgccctccggctgcgccgctccggcgccggcggcgccgggtcctccgcggcccagtcgcgccggcactttgcgcagggcgcccagctcctcgcccgcgcgcgcgccgcggcgcccaaggcccccggcccgctcgcccgcgccgccgtcgccgaggccgaccgcgccatcgccctcgacccgcgcgacgccgccccgctcatcctcaaggccctcgccctcgacctccagggccaccgcctccccgcgctgcgcgccctcgatgccgccctcgcgccgccgctcgcccgctcgctcgagccgcgcgagcgaggggacgcgctcgccaagcgcgccgagatcgcgctcgcgctccaccgccgccgccgcctcgaccaggccgctgccgatctcgcggaggccgtccgcctcagtcccgagaacgcccgcgcccatgcccttctgggcgagtgctacgagaagaaggggctcgccgctgaagctcgggaagccttcaagaccgccgcatccattgacccaaagcttggcgctgcgcttgacgggctccgtcggttagacggaggcaacgaaggagacgagagtgactga

SEQ ID NO: 10172 - protein, 233 aa, Sorghum bicolor
  misc_feature: Ceres ANNOT ID no. 6111476
  misc_feature (180)..(213): Pfam Id: TPR_2 Pfam Desc: Tetratricopeptide repeat
  misc_feature (180)..(213): Pfam Id: TPR_1 Pfam Desc: Tetratricopeptide repeat
  misc_feature (38)..(223): NCBI GI: 121536395 NCBI Desc: mj0042 family finger-like protein [anaeromyxobacter sp. fw109-5]
  misc_feature (36)..(222): NCBI GI: 86158843 NCBI Desc: tetratricopeptide repeat protein [anaeromyxobacter dehalogenans 2cp-c]
  misc_feature (4)..(230): NCBI GI: 121539015 NCBI Desc: tetratricopeptide tpr_2 repeat protein [anaeromyxobacter sp. fw109-5]
  misc_feature (135)..(180): NCBI GI: 38344653 NCBI Desc: osjnbb0072m01.15 [oryza sativa (japonica cultivar-group)]
  misc_feature (40)..(226): NCBI GI: 23006671 NCBI Desc: cog0457: fog: tpr repeat [magnetospirillum magnetotacticum ms-1]
MPSLALGAAGTWPEAVIQCLLFLLAAGMLVALHSLPRRVALRLRRSGAGGAGSSAAQSRRHFAQGAQLLARARAAAPKAPGPLARAAVAEADRAIALDPRDAAPLILKALALDLQGHRLPALRALDAALAPPLARSLEPRERGDALAKRAEIALALHRRRRLDQAAADLAEAVRLSPENARAHALLGECYEKKGLAAEAREAFKTAASIDPKLGAALDGLRRLDGGNEGDESD

SEQ ID NO: 10173 - DNA, 3141 bp, Sorghum bicolor
  misc_feature: Ceres ANNOT ID no. 6111480
  misc_feature: Encodes the peptide sequence at SEQ ID NO 10174
atggacgtggtgcaggtgatcgcctcggcgaccgagctggtctcggcgatggtgtccgcggtcagggcactggagcaggcggcgtcggacctcgcggaggctccgaggaggctgcaggtgctggaggacttcgtgtccgacctcgacgcgctgacggagcagtcgaggcagcggcacgcgaacaagctgcacgccccgcagctggaccgccagttccagagcctgggcaggctcatggaccagctgcgcgggaacatcgccaaggccaggaaggtcctgagcggcagcggcaagggcaaagggaaggggttcgccaggctggtgcggagctccgtgacgggtgacccgctcatgaggtacgtcaggctgatcagggacgacctcaaccagtggctggagctgcagcagctgacccagagcgtcggcaaggtcatagcgtcgaccgccaggagcacgccggcgttggtgagggttaagtcggagcatgggtacccggtgtcgaagaagtgcagctatgtcagggagctgttggagagggacggggctcatcgagtcgtcctcatcgtcggtctctctggtattgggaagtcatgccttgcacggcaaattgcttctgatccgccgtttagttttgtggatggtgcgattgagattggttttgggcggtggtgcagcagggcagcgtgtaatgggagcagaagcgaataccataagcgccttgctaggaagatctgcacgttccttgtgcagattggctccatgactgtcaaggaggaggttggaaaagatcttgatgatgtctgttgcttgctccagacagcattggttggaaggagcatgctgatcctacttgatgatgtttgggagcaagacattgttgaccgcttcacgagactatatgataatgattgccggtatctcgtgacaacaagggatgaagctatctacgagatagcagaagctgaaaaggtagaaatatccaaagatgacatcaaggagatcagcagggaaattcttctctatcacagccttctcagtgtgggagagcttccgcctgttgcagaagttttgctggatcgttgtggtcaccatccccttacagttgctgtcatgggcaaggctctcaggaaggagaccagagtggaaaaatgggagaaagccatatccaacctctcaacatatgccacttgtgcacctggtccagtttcatacgtcaatgagaaagacgtggagactacgttgaccatatttggatcttttgagttcagcctagaagcaatgccagaaaattcaagaaattttttcatggctctcgcagctatctcttgggaagaacctgttccagaggcttgtctggaatccatttggtcagcccttgagcagggcggtctgttctctctcgtggtttcaaaattagtagaaggatcactcattatcaaactggaggaccaaccgttgtatcatatgcatgacatggtttcactttaccttgagaacaaaacaaatgatgttgctcgtgctcttttatctgaatcgatttcttattatgcagcattagtggctccttggctttttgtttttggcaaagagtgtatgaaaaggccagccgaacagaagatgggatcattcttttctctgctagaattcatggagatcgagattttattggtaaacacaactcaagctctcatggcatgcaggtccctatctgaatttgaggcaagcagtcttgggttcagcaaaatacttggccctaggatagcagagataatttcagtagggtcaccagatctcatttttgcagtcactacggcaattacagttatatttttccaagcagactatataaatcttgctcggtcacttgaaacagcaggttccatagataaattaattgatcttcttggtgcctgccaagatacttcaactctagccaacttgtcttctgttctggccaagatatctgagcacgttgatgccacagttgctgatggaattttatcaagaattcccatggatcgaattgcagatctcttgtctgtagaaaatgagcagtggcatgaaattgtgtttacaacacttgcatctctgacaaaggttggaaaattgaaggctgttgagaccatgattgaatcaggaattgacaagaaacttcttgtgcttctgggcaatggatctgagatctcacagcaccacgcaattatcacgctaaaaacattctgtgaacttggtgctccacttcaagggtgcatggggcctgcagtgctgcttcatttgccctggcatgctcggatcagtttggaaagatttgttttatttgacaaaaatgcatctcaatcaccaaagcctcaacaatcacttgaggtgattcttcataagatccttcagagagacaacaaagatatcattgaagacatccaaggtttattatctcttgctgagagggcaaacgatacaagggtgcaagatctccttttgggaagcaatctgtttgataggttggctttgctgctacaacgtaaagaggtcgaaaacaaccaggtgaggtcgcagaccgcctttttggtgatgaaattggcctgcactggaggagagccatacgtccataggttcctggagcttaatattgttcacgagctcattgacatgatgcagtgcaacatcgacgagctccaggattcagcatactacgctctccatcagatcgtctttgcaaagggtggatcccttgtcttgcaaagattcctgcaacttggaaccatagagaaactggtgaacttgctcgaccgcaagtctttgaagaccaaggatctagccatgcaattcctggtggacattgcggaggttggaaccaagccctgcatcgagagaatgctctcttctcaagtcgtcgagaagcttgtggcccttgagaaagctggcgatcctttcggcggcgcagtgtcaaggtacatccagggactgaacatgtgcaagaaactccagactgctgagagggccgtgatgaagcaacatattctgaggaaggtccgatcagcagtgagaggtcataagctggaggccagcctagtagcttctgtggaggcctccatcgctgaaggctccagaggagccagtagtagtagtaggaaaaagaaataa

SEQ ID NO: 10174 - protein, 1046 aa, Sorghum bicolor
  misc_feature: Ceres ANNOT ID no. 6111480
  misc_feature (140)..(462): Pfam Id: NB-ARC Pfam Desc: NB-ARC domain
  misc_feature (1)..(1018): NCBI GI: 115444919 NCBI Desc: os02g0203500 [oryza sativa (japonica cultivar-group)]
  misc_feature (254)..(497): NCBI GI: 106892187 NCBI Desc: wd-40 repeat:nb-arc [roseiflexus sp. rs-1]
  misc_feature (185)..(389): NCBI GI: 77641308 NCBI Desc: i2 [solanum tuberosum]
  misc_feature (185)..(389): NCBI GI: 77641318 NCBI Desc: i2 [solanum tuberosum]
  misc_feature (173)..(516): NCBI GI: 18858279 NCBI Desc: apoptotic protease activating factor [danio rerio]
MDVVQVIASATELVSAMVSAVRALEQAASDLAEAPRRLQVLEDFVSDLDALTEQSRQRHANKLHAPQLDRQFQSLGRLMDQLRGNIAKARKVLSGSGKGKGKGFARLVRSSVTGDPLMRYVRLIRDDLNQWLELQQLTQSVGKVIASTARSTPALVRVKSEHGYPVSKKCSYVRELLERDGAHRVVLIVGLSGIGKSCLARQIASDPPFSFVDGAIEIGFGRWCSRAACNGSRSEYHKRLARKICTFLVQIGSMTVKEEVGKDLDDVCCLLQTALVGRSMLILLDDVWEQDIVDRFTRLYDNDCRYLVTTRDEAIYEIAEAEKVEISKDDIKEISREILLYHSLLSVGELPPVAEVLLDRCGHHPLTVAVMGKALRKETRVEKWEKAISNLSTYATCAPGPVSYVNEKDVETTLTIFGSFEFSLEAMPENSRNFFMALAAISWEEPVPEACLESIWSALEQGGLFSLVVSKLVEGSLIIKLEDQPLYHMHDMVSLYLENKTNDVARALLSESISYYAALVAPWLFVFGKECMKRPAEQKMGSFFSLLEFMEIEILLVNTTQALMACRSLSEFEASSLGFSKILGPRIAEIISVGSPDLIFAVTTAITVIFFQADYINLARSLETAGSIDKLIDLLGACQDTSTLANLSSVLAKISEHVDATVADGILSRIPMDRIADLLSVENEQWHEIVFTTLASLTKVGKLKAVETMIESGIDKKLLVLLGNGSEISQHHAIITLKTFCELGAPLQGCMGPAVLLHLPWHARISLERFVLFDKNASQSPKPQQSLEVILHKILQRDNKDIIEDIQGLLSLAERANDTRVQDLLLGSNLFDRLALLLQRKEVENNQVRSQTAFLVMKLACTGGEPYVHRFLELNIVHELIDMMQCNIDELQDSAYYALHQIVFAKGGSLVLQRFLQLGTIEKLVNLLDRKSLKTKDLAMQFLVDIAEVGTKPCIERMLSSQVVEKLVALEKAGDPFGGAVSRYIQGLNMCKKLQTAERAVMKQHILRKVRSAVRGHKLEASLVASVEASIAEGSRGASSSSRKKK

SEQ ID NO: 10175 - DNA, 339 bp, Sorghum bicolor
  misc_feature: Ceres ANNOT ID no. 6111484
  misc_feature: Encodes the peptide sequence at SEQ ID NO 10176
atgccgtcagagcagacaccaacaccagtccacacgtttggctttgacaccgaccatgtcgtcggcgccaatgcgatgcacgttgttgcggaggccacgggcgatgctttctccttggttggaaacaaggcggcgatgcaagacttgttcgcgtgcatgacacacgtgttgctgtcgcgtgcctgcatcgagacgtctagcgcctatggtagccacgtgggcatcgatggacgcgctgccttcatcgacgttggcgagctctacgatggcgacgaaaggcggttcctggtgctcgtgtacgcaccgggtggctggggacggagggggtcacctgcctag

SEQ ID NO: 10176 - protein, 112 aa, Sorghum bicolor
  misc_feature: Ceres ANNOT ID no. 6111484
  misc_feature (4)..(81): NCBI GI: 40253820 NCBI Desc: histone deacetylase hd2-like protein [oryza sativa (japonica cultivar-group)]
  misc_feature (9)..(102): NCBI GI: 42407699 NCBI Desc: zinc finger (c3hc4-type ring finger) protein family-like [oryza sativa (japonica cultivar-group)]
  misc_feature (9)..(63): NCBI GI: 9759335 NCBI Desc: retroelement pol polyprotein-like [arabidopsis thaliana]
MPSEQTPTPVHTFGFDTDHVVGANAMHVVAEATGDAFSLVGNKAAMQDLFACMTHVLLSRACIETSSAYGSHVGIDGRAAFIDVGELYDGDERRFLVLVYAPGGWGRRGSPA

SEQ ID NO: 10177 - DNA, 855 bp, Sorghum bicolor
  misc_feature: Ceres ANNOT ID no. 6111487
  misc_feature: Encodes the peptide sequence at SEQ ID NO 10178
atgctcgcggcgtcggcgcggcggctgtccgccgccgcctcgtcttcgtcttcttccatgcgcgccagccagctcgccgccgcacggaacccacagaggtggatgcacgacaggaacaagaaggcgatggagctggtggccaagggatggagtgcgctccaggaggttgaccgcgtcatcgactacgccgaccgcaatgacaagcgcctcatcccgcttctaaggggtgctaaggaaaactttgagctggctttggagattgataatgataatacacatgcgaggtattggctgggcaaaatgcatttcaagtatcatgttcctggagcttgtaaggcagttggtgctgctttgttggttgaagctgcaaatatgggtgatccagatgcacagtatgaacttggatgtcgactaagaattgagaatgactatgttcagtcagatcaacaggctttccattacattgagcaagctgttgatcagctgcaccctggcgctttatatcttcttggtgctgtatatctaactggagactgtgttaagagagatatagcttccgcgttgtggtgttttcatagagcttcagaaaagggacatgctggtgctgctgtcgcatatggatccttgcttcttaaaggtgctgaaatacctgaagtgattacgagattcaactcaggcaagagtccatcaactgggaaaatgcggaaaaggaccctgcagcaggatccaataaagctagcgaaagagcagtttcaaatcgcagctgaggcaggctgtgatctcggtttgcggtggttgaagaggcttgaagattatgaaaaccaagaagaaaagctaaagcagatccagcattga

SEQ ID NO: 10178 - protein, 284 aa, Sorghum bicolor
  misc_feature: Ceres ANNOT ID no. 6111487
  misc_feature (164)..(199): Pfam Id: Sel1 Pfam Desc: Sel1 repeat
  misc_feature (96)..(279): NCBI GI: 145329621 NCBI Desc: binding [arabidopsis thaliana]
  misc_feature (121)..(213): NCBI GI: 82409304 NCBI Desc: sel1-like repeat [nitrosospira multiformis atcc 25196]
  misc_feature (118)..(218): NCBI GI: 71037921 NCBI Desc: conserved hypothetcial protein [psychrobacter arcticum 273-4]
  misc_feature (121)..(213): NCBI GI: 119947297 NCBI Desc: sel1 domain protein repeat-containing protein [psychromonas ingrahamii 37]
  misc_feature (63)..(268): NCBI GI: 46201378 NCBI Desc: cog0790: fog: tpr repeat, sel1 subfamily [magnetospirillum magnetotacticum ms-1]
MLAASARRLSAAASSSSSSMRASQLAAARNPQRWMHDRNKKAMELVAKGWSALQEVDRVIDYADRNDKRLIPLLRGAKENFELALEIDNDNTHARYWLGKMHFKYHVPGACKAVGAALLVEAANMGDPDAQYELGCRLRIENDYVQSDQQAFHYIEQAVDQLHPGALYLLGAVYLTGDCVKRDIASALWCFHRASEKGHAGAAVAYGSLLLKGAEIPEVITRFNSGKSPSTGKMRKRTLQQDPIKLAKEQFQIAAEAGCDLGLRWLKRLEDYENQEEKLKQIQH

SEQ ID NO: 10179 - DNA, 426 bp, Sorghum bicolor
  misc_feature: Ceres ANNOT ID no. 6111489
  misc_feature: Encodes the peptide sequence at SEQ ID NO 10180
atggaggaggtcaccgaggccgtgaacaacctcagcatctccggtggaggagccacggccggtgccggtgccggagcggaggggcacaagaagaaccgcatccaggtctccaacaccaagaagcccctcttcttctatgtcaacctcgccaagaggtacatgcagctgcacaacgaagtggagctgtcggccctcggcatggccattgcaacggtggtgacagtagcagaaattctgaaaaataatggccttgctgtcgagaagaagatcatgacatctactgttgatgtcaaagatgaaactaggccccgacctatccagaaggccaagattgaaatattgcttggcaagacggacaaatttgatgagctgatggcagcggctgcagaagagagggaggccaatgaggccgaggaacaaagctga

SEQ ID NO: 10180 - protein, 141 aa, Sorghum bicolor
  misc_feature: Ceres ANNOT ID no. 6111489
  misc_feature (30)..(99): Pfam Id: Alba Pfam Desc: Alba
  misc_feature (2)..(141): NCBI GI: 52696238 NCBI Desc: chain b, x-ray structure of gene product from arabidopsis thaliana at2g34160
  misc_feature (77)..(141): NCBI GI: 115444903 NCBI Desc: os02g0202500 [oryza sativa (japonica cultivar-group)]
  misc_feature: Useful for making plants with modulated nitrogen use efficiency
  misc_feature: GREAT-hit functional homolog of the protein sequence encoded by LOCUS at2g34160
  misc_feature: Useful for making plants with modulated nitrogen use efficiency
  misc_feature: Functional homolog of the protein sequence given in SEQ ID NO 13593
MEEVTEAVNNLSISGGGATAGAGAGAEGHKKNRIQVSNTKKPLFFYVNLAKRYMQLHNEVELSALGMAIATVVTVAEILKNNGLAVEKKIMTSTVDVKDETRPRPIQKAKIEILLGKTDKFDELMAAAAEEREANEAEEQS

SEQ ID NO: 10181 - DNA, 1620 bp, Sorghum bicolor
  misc_feature: Ceres ANNOT ID no. 6111498
  misc_feature: Encodes the peptide sequence at SEQ ID NO 10182
atggagcaaggggagaaccaatcagctggtagttttgttgtttcatcatcggataataatgagttggaagatttgcctgttaaggaaagatgctttgagcagagagaagctcttccaggggagcctcgctgtgttgtgtgtggccgatatggtgaatatatatgtgatcagactgatgatgacatctgcagtgtggaatgcaagacaattcttcttgctcggatcgctgctaaaacaaagccagcagtaaaagctgcaaagcgtgtgaaccttcctttgggcgatgagagcttctgtattaaggacatcaattttccaaatatacctactttagctgacagccggattagttcactgaggactaaacttgacatttgtgtcaagggtgatgctgttcctgatccaatcatgtgtttctctgcctgtggtcttcctgagaagcttgtgcacaatcttgagactgcgggatattgtatgcctactccagtgcagatgcaagttatccctgcatcaatgagtaatagaagcctacttgtttctgctgatactggttcagggaaaactgcatcttttctgattcccataattgctcattgttcacaagtaagatcacaagaatccacaagcaatcaaggaccgttggctatagttcttgctccaactagagagctatgcctgcaggtagaagagcaagcaaaagtgcttggtaaaggtttgcctttcaaaactgctctagttgtcggtggagatccattgcctcagcaaatttacagaattgaaaatggtattgagttaattgttggcacccctgggaggctaattgatcttctcatgaaacacaatgttgaccttacctatgtttctgtattcgttttggatgaggtggactgcttgttggagaggggattcagggatcaggccatgcagatttttcagtcactttcacaaccacaggttatgatgttttcagcaacattacattcggaagttgagaagatgtctaactcactggctaagaatgtgataagtatctcttgtgggaatccaaacagaccaaccaaatcagtcaaacaagtggtcatttgggtggaatctaagaagaagaagcagaagatatttgagataatgaaaagcaagcaacattttaaacctcctgctgttgtgtttgtgagttccagagtcggagctgatctgttgtctgaagcaattactgttgctactggattagaggttgtttctatccatggcgagaagacgatgaaggagagaagagagaatttgagaaggtttttgacaggagaagtatctgtcgttgtttctactggtgtcctggggcgtggaatggatctcctgaaagtacgtcaagtgatattgtttgacataccaaattccatcgatgaatatattcaccaagttggaagggcatcccggatgggtgaggagggtatggctgttgtgtttgtgaatgaggaggatagaaggattttcaaagagcttgttcaggttctgaagactgcaggagcaccgataccccgggaacttgcaaattcaagatatacagctggtgtttatgttggtagcgagaggaagagaaaattgagttctaggtatcgttcttga

SEQ ID NO: 10182 - protein, 539 aa, Sorghum bicolor
  misc_feature: Ceres ANNOT ID no. 6111498
  misc_feature (161)..(333): Pfam Id: DEAD Pfam Desc: DEAD/DEAH box helicase
  misc_feature (403)..(479): Pfam Id: Helicase_C Pfam Desc: Helicase conserved C-terminal domain
  misc_feature (40)..(69): Pfam Id: zf-HIT Pfam Desc: HIT zinc finger
  misc_feature (27)..(516): NCBI GI: 42572227 NCBI Desc: dead/deah box helicase family protein [arabidopsis thaliana]
  misc_feature (16)..(519): NCBI GI: 55959939 NCBI Desc: novel protein [homo sapiens]
  misc_feature (16)..(519): NCBI GI: 72534744 NCBI Desc: dead (asp-glu-ala-asp) box polypeptide 59 isoform 1 [homo sapiens]
  misc_feature (16)..(494): NCBI GI: 119611725 NCBI Desc: dead (asp-glu-ala-asp) box polypeptide 59, isoform cra_b [homo sapiens]
  misc_feature (16)..(371): NCBI GI: 33878506 NCBI Desc: dkfzp564b1023 protein [homo sapiens]
MEQGENQSAGSFVVSSSDNNELEDLPVKERCFEQREALPGEPRCVVCGRYGEYICDQTDDDICSVECKTILLARIAAKTKPAVKAAKRVNLPLGDESFCIKDINFPNIPTLADSRISSLRTKLDICVKGDAVPDPIMCFSACGLPEKLVHNLETAGYCMPTPVQMQVIPASMSNRSLLVSADTGSGKTASFLIPIIAHCSQVRSQESTSNQGPLAIVLAPTRELCLQVEEQAKVLGKGLPFKTALVVGGDPLPQQIYRIENGIELIVGTPGRLIDLLMKHNVDLTYVSVFVLDEVDCLLERGFRDQAMQIFQSLSQPQVMMFSATLHSEVEKMSNSLAKNVISISCGNPNRPTKSVKQVVIWVESKKKKQKIFEIMKSKQHFKPPAVVFVSSRVGADLLSEAITVATGLEVVSIHGEKTMKERRENLRRFLTGEVSVVVSTGVLGRGMDLLKVRQVILFDIPNSIDEYIHQVGRASRMGEEGMAVVFVNEEDRRIFKELVQVLKTAGAPIPRELANSRYTAGVYVGSERKRKLSSRYRS

SEQ ID NO: 10183 - DNA, 1323 bp, Sorghum bicolor
  misc_feature: Ceres ANNOT ID no. 6111505
  misc_feature: Encodes the peptide sequence at SEQ ID NO 10184
atggacgcgaaggacatactagggcttccgaagacccccttctcgtcctcccaggagaagaaatcgcggccgcccaaggagccgcagcgcaagcctgatggcgtctcgcgcgaggtctatgccctcactggaggggtgggaatggccccgctcatgccgaccatcgaggcatcgcacctgaagcggcggcctgctgcggagaaagagaaggtagcatggcagtggttacctttcacatcatcggcacgaactgataaccttcaactctatcactgggttagagttgttaatggtattcagccaactggtgattatcagtttgcaaaatataacaagaaggctgatgttgttaaatatacggatgaggagtacgagaagtatttagttgaccctgattggagcaaggaagaaactgatcagctatttgaattatgtgaacgatttgaccttcgcttcatagtaatagcagataggtttccaactgctcgcagtgtggaagatctgaagagtcgttactattctgcttctcggactcttctaattcatagagccaggtcattcgaagatgtttctgggaatccccttgggaaggatacctatgatgctgctcatgagattgagaggaagcgtgcattatcagcacttctctcccaaacaaagcagcaagaacgaaaggatgctgagactttagcagaagcaaaacgtattatggaatctcgtgctgctaccaaagatgttgatgaagctgtaatgcctccgagctctgataatgctatggttcctgttgatggtgtatctccttcgagcagcactcatccgtctttattacatccaaatacaacagctaacaccttgatacctaatgcactacgaacgcttcgagtgtatttgagaactcatgcgcttgaccaaatggtccaagcagtaggtgcttcagctggcattagagttatcaaaagggttgatcaaacactacaagagctaggggtgaatttgaagcctaaggtcccaacaaaagcagtctgtgtagaacatattgaactgcggaatgagctactcacattgcttaacctacaaaagcagctgcaaagtaaagaggctgaagtttcagctaaccgggaaaattccttcacagaagcaccaagtacacctaagcgttctaatagggacattgatcgtcccttcaaccctgatgcaattgggtttacaggtgaaagagctggcaaacgggaccacaagcggaagaccactggaagatttatagatgcgcctccatcaccaccccagtccaagcggcctagaaaattgaagggatctgactga

SEQ ID NO: 10184 - protein, 440 aa, Sorghum bicolor
  misc_feature: Ceres ANNOT ID no. 6111505
  misc_feature (130)..(176): Pfam Id: Myb_DNA-binding Pfam Desc: Myb-like DNA-binding domain
  misc_feature (1)..(440): NCBI GI: 92885327 NCBI Desc: homeodomain-related [medicago truncatula]
  misc_feature (70)..(247): NCBI GI: 140068490 NCBI Desc: homeodomain-related [medicago truncatula]
  misc_feature (5)..(439): NCBI GI: 51950169 NCBI Desc: mgc82015 protein [xenopus laevis]
  misc_feature (5)..(439): NCBI GI: 49523381 NCBI Desc: dna methyltransferase 1 associated protein 1 [xenopus tropicalis]
  misc_feature (9)..(384): NCBI GI: 7243231 NCBI Desc: kiaa1425 protein [homo sapiens]
MDAKDILGLPKTPFSSSQEKKSRPPKEPQRKPDGVSREVYALTGGVGMAPLMPTIEASHLKRRPAAEKEKVAWQWLPFTSSARTDNLQLYHWVRVVNGIQPTGDYQFAKYNKKADVVKYTDEEYEKYLVDPDWSKEETDQLFELCERFDLRFIVIADRFPTARSVEDLKSRYYSASRTLLIHRARSFEDVSGNPLGKDTYDAAHEIERKRALSALLSQTKQQERKDAETLAEAKRIMESRAATKDVDEAVMPPSSDNAMVPVDGVSPSSSTHPSLLHPNTTANTLIPNALRTLRVYLRTHALDQMVQAVGASAGIRVIKRVDQTLQELGVNLKPKVPTKAVCVEHIELRNELLTLLNLQKQLQSKEAEVSANRENSFTEAPSTPKRSNRDIDRPFNPDAIGFTGERAGKRDHKRKTTGRFIDAPPSPPQSKRPRKLKGSD

SEQ ID NO: 10185 - DNA, 1152 bp, Sorghum bicolor
  misc_feature: Ceres ANNOT ID no. 6111525
  misc_feature: Encodes the peptide sequence at SEQ ID NO 10186
atgtcctttactgggtccgcccctgccagtgggaagcccgcaatgcctagcttagggggccagggtgaggaagagcatggggagaagggcaatgaggacaactcaggggagagcgaggtgatcaacccgccagaagaggctagcggggaggccacctcgcctatggagggcaggaagcctcgccttggactttccaaggggaatcaaagccatggacctaaggctatcaaatccaagagcccaaggagtggagatgaaggtcaggcaaggagaaaaggggtgaattcttctcttcctaaggcacccattgtccaggtgtcccatggtgacgctggtgtcggcagtaataaagctggcaagaatgaatctcgctcatctcccatggatgcaacattgctggatgactccaaggagaaaaggaaaactcaaaagccatcagcacagctctcttccatcaaaagagatgaagaacagtcaaatggtgagagtgcaaaacctcgaaaagttggcagcactccatcatatggtttcaccttcaagtgtgacgagagatctgaaaaaagaagagagttctattcgaagcttgaggagaagattcaagcaagagagttagaaataagcaatttgcaagagaaatcaaaggaaactgaagaagcagaactcaaaatgttgagaaagagtttgaatttcaaggcaacaccaatgccaagcttctataaggaaccaactcctgccaaggttgaattgaaaaagacccccccaaccagagctaaatcaccaaagcttggtcgttctaaaaacaagtccacaccagagactgaagaaaatactactatggaccaatctgcccgtctgagccttgaggaaaaggtttctcaaaatggtgtgaaaaaatcaaccccgttgaattcagcaaagaagccccagaggaagtcactccccagactgccatctgaagaaactggtccgctcgatgccacctcaaggcagctaaagaacaccaaactgaatgcagttaatactcaggagacaggatctgctacagaacaggtacaaggaagtgagacgaaaacagattctgttcaggggccaattgaagctggagctaatcctgatgaacaagacgtcgccgaacagagtgtcgtttactga

SEQ ID NO: 10186 - protein, 383 aa, Sorghum bicolor
  misc_feature: Ceres ANNOT ID no. 6111525
  misc_feature (179)..(235): Pfam Id: TPX2 Pfam Desc: Targeting protein for Xklp2 (TPX2)
  misc_feature (53)..(377): NCBI GI: 42733498 NCBI Desc: bri1-kd interacting protein 118 [oryza sativa (japonica cultivar-group)]
  misc_feature (209)..(363): NCBI GI: 51091379 NCBI Desc: bri1-kd interacting protein 118-like [oryza sativa (japonica cultivar-group)]
  misc_feature (9)..(251): NCBI GI: 140057127 NCBI Desc: targeting for xklp2 [medicago truncatula]
  misc_feature (38)..(305): NCBI GI: 92874845 NCBI Desc: targeting for xklp2 [medicago truncatula]
  misc_feature (79)..(314): NCBI GI: 42733494 NCBI Desc: bri1-kd interacting protein 116 [oryza sativa (japonica cultivar-group)]
MSFTGSAPASGKPAMPSLGGQGEEEHGEKGNEDNSGESEVINPPEEASGEATSPMEGRKPRLGLSKGNQSHGPKAIKSKSPRSGDEGQARRKGVNSSLPKAPIVQVSHGDAGVGSNKAGKNESRSSPMDATLLDDSKEKRKTQKPSAQLSSIKRDEEQSNGESAKPRKVGSTPSYGFTFKCDERSEKRREFYSKLEEKIQARELEISNLQEKSKETEEAELKMLRKSLNFKATPMPSFYKEPTPAKVELKKTPPTRAKSPKLGRSKNKSTPETEENTTMDQSARLSLEEKVSQNGVKKSTPLNSAKKPQRKSLPRLPSEETGPLDATSRQLKNTKLNAVNTQETGSATEQVQGSETKTDSVQGPIEAGANPDEQDVAEQSVVY

SEQ ID NO: 10187 - DNA, 960 bp, Sorghum bicolor
  misc_feature: Ceres ANNOT ID no. 6111528
  misc_feature: Encodes the peptide sequence at SEQ ID NO 10188
atggaggatgggagcattatgaagcagaatcaaatattcctatcccagtttggaggatttatttccaagctaaactttcagaatatgcaccagggctatctcaaagaaactctggtgcgtttccttaaggctagagagtggaatgtatcaaaggctcataaaatgattgtagattctttgaattggaggattcaaaatgaaattgatagtgtgctggagagacctatagtcccagtagatttgtacagatcaatacgtgattcacaacttattggcctgtcaggatacacaaaggagggtctcccagtttttggcattggtgttggacatagcacatatgacaaagcttcggtccactactatgtgcaatcacatatccagattaatgagtaccgtgatcgtataattttgcctaggctgacacaacagtttaggcggcctgttacccagtgtataaaagttctggatatgactggtttgaagctatcagcactgagccaaataaagatcttgacttccatatcaacagttgatgatctgaattaccctgaaaagacagagacctattatgtagtcaatgttccgtacatattttctgcttgttggaaggagaggacaaaaaagaaggttaaagttttgactggctgtgggagagatgaacttctgaagattatggactactcagcacttccccatttctgccgccacgagggctctggatcatcaaagcattcatctactgacgtcgacaactgcttctcccctgaccatccattccacaaagaactttatgatcatatcaaagagcaagcctcgcgcagggagctcatcaagatgggatcattgcacgtcagcattcccgagccagacccagatgacgcgaagatcgtcgaggtcatccaggctgagttccagaagatcggcgagcaggatgagtccccgaacggccacaaggactag

SEQ ID NO: 10188 - protein, 319 aa, Sorghum bicolor
  misc_feature: Ceres ANNOT ID no. 6111528
  misc_feature (90)..(269): Pfam Id: CRAL_TRIO Pfam Desc: CRAL/TRIO domain
  misc_feature (23)..(68): Pfam Id: CRAL_TRIO_N Pfam Desc: CRAL/TRIO, N-terminus
  misc_feature (7)..(306): NCBI GI: 87162791 NCBI Desc: cellular retinaldehyde binding/alpha-tocopherol transport; cellular retinaldehyde-binding/triple function, n-terminal [medicago truncatula]
  misc_feature (7)..(316): NCBI GI: 2739044 NCBI Desc: polyphosphoinositide binding protein ssh1p [glycine max]
  misc_feature (18)..(312): NCBI GI: 8778303 NCBI Desc: f14j16.8 [arabidopsis thaliana]
  misc_feature (25)..(312): NCBI GI: 19310517 NCBI Desc: at1g55840/f14j16_2 [arabidopsis thaliana]
  misc_feature (28)..(312): NCBI GI: 145325439 NCBI Desc: sec14 cytosolic factor (sec14) / phosphoglyceride transfer protein [arabidopsis thaliana]
MEDGSIMKQNQIFLSQFGGFISKLNFQNMHQGYLKETLVRFLKAREWNVSKAHKMIVDSLNWRIQNEIDSVLERPIVPVDLYRSIRDSQLIGLSGYTKEGLPVFGIGVGHSTYDKASVHYYVQSHIQINEYRDRIILPRLTQQFRRPVTQCIKVLDMTGLKLSALSQIKILTSISTVDDLNYPEKTETYYVVNVPYIFSACWKERTKKKVKVLTGCGRDELLKIMDYSALPHFCRHEGSGSSKHSSTDVDNCFSPDHPFHKELYDHIKEQASRRELIKMGSLHVSIPEPDPDDAKIVEVIQAEFQKIGEQDESPNGHKD

SEQ ID NO: 10189 - DNA, 3252 bp, Sorghum bicolor
  misc_feature: Ceres ANNOT ID no. 6111534
  misc_feature: Encodes the peptide sequence at SEQ ID NO 10190
atggcgaggccatcatcgggcccgccgggtggtcccccggagcccggtcgccacgacgcgccgatgctgctgcgcgtgcacgtgatcgaggcgcggggcctgccggccatctacctcaacggttccagcgacccctacgtgcggctgcagctggggcggcgccgcccgcgggccaccacggtggtgaagcgcagcctcagccccgtgtgggacgaggagttcgggttcctcgtcggcgacgtcgccgaggagctcgtcgtctccgtgctcaacgaggaccgcttcttcggcgccgagttcctgggccgggtgagggtgcccctcaccgccatcatggagacggacgacctctcgcttggcaccaggtggtaccagctccagcccaggaccggcggcggcgccaagttcaggaagaaaaggcgcggtgaaatttgcctgagagtatacttatcggttagggccaccctttgtgatgacgcacatcaagctccacagcaacttattgatgatatatcatgcagctcacacaggtcaattgaaactaatgactcctcattatcagctactgctagtagcctggatatgtcagcctgtgccagcattgatcgagcatccctcaaaagtttggatggcttcaaccaaagcataatggaggtccgaggccctataagcacagggccaccatcttgtgtcagcacagagcaatccattcttctagagcctgaagaagatgatggtagtgctgatacatccacagtagtggaggtcatgtctcgatacttccggaaaactgctgacactacacattctgtagcatcagatcctgtttccacagaccagtttcgaaacacacaaatgaattccgagtgtcgtgaaaatggcgagggttgcacactgcctgaggtcagtcttgatgaactactgaaaagtatggagtccaaagaccaagcttgtgaaatgccggcaaacttgcctggtggtgtactagtggaccaatcttacattattgcaccagcagaactgaattcattgttgttttctggaacttcagatttctggccagaagtttctgaacttcaaggaacaagtggatttcaaattgagccctggaggcatgacaatagtgagaattgtttaaaaagaacaatatcttatacaaaagctgctagcaaattagttaaatctgtaaaagccacagaagagcagaaatacttgaaggcaaatggaagttcttttgcagttttgtctagcgttagcactcctgatgttccttgtggtaattgtttcaaggtggagatattgtatcgtatagtatctggttcccagctgccattagaggaacaggccacacaacttactgtaagttggcgtctgaactttgttcagagtacgatgctgaaaggaatgatagagaatggagcgaaacaaggccttgcagagggttattcacatttctctgaggtactgtcccggaaaattaaagtagctgaacttgacgatgctaattccaaagataagattttagcatcactgcagacgcagaaagaatcaaactggaagctggttgcccgcttccttggaagctttgcattcatatgctctctcagtacagcactgtatatcatgacacatcttcatctagcaaagcctaatgtggtgcatggcggtcttgaatattttggtattgatcttccagattccgttggagagattgtattttgtcttattttgatcattcaggggcataatatcatcaaagtagggcgacgttttttgcaagcctggaaacaacgtggtagtgatcatggggtcaaagctcatggagacggttggttgttgactattgcacttattgagggaagcggtgtagtaagtgcagtttttatgtgcaacggaaagaggaaaaccagctcagtcaaataccacacttctgaaccaaaatggaatgaaatatttgaatttgatgcgatggatgacccgccagcgagattggacgtggttgtgcatgattcagatggaccaagcaatgaaactcctattggtcaaacagaagtcaactttgtgaaaaacaatttgtcagatttgggtgacatgtggcttcctcttgatggaaggtttccccaagggcaccagcctaaattgcatctgcgtatctttttgaacaattcacgggggactgaagttgttatggattatctggaaaaaatggggaaagaagttggcaagaagatgcaattgcgctcatctcagacaaattctgcattccgtaagctcttcagccttcctcctgaagaatttctcattgacgatttcacctgccatctaaaacggaaaatgccacttcaggggcgcctctttctttccccaagaataactggattctattccaatatatttggccggaaaaccaagtttttcttcctttgggaagatgtcgatgacatccaggttgttccaccgaaactagcaacagtcggcagtccatcattgatgatcatccttcgcaaggacagaggtcttgaagccaggcatggcgccaaagcactggatcctcaagggagactgaagttccattttcagacatttgtttcattcaatgatgctcacagaattattatggcaatttggaaaatgcggtcaccaggtctggaacaaaaaggtgagatgatcgataaagaacctgaactgaaagagaacccgtatgaagaaggttctctattggccaatgaagatgtaaaaatgtcagaagtttattcggcagttctttctgtcgatgtcagtgccttaatggagatgttctctggaggtccactggaacacaaagtgatggagagagccggttgtgttgactactcagctacagaatgggagctgctaaaccgtaatgtataccaacgtcgtataagctttcggtttgacaaaagcttgtcaaaatatggaggagaagcaacgacaactcagcaaaagtataacttaacgaaccaaaatgaatggattgtcgaggaggtgatgaccctccaaggtgtccaacatgaagactactccagtatccaattgaagtaccacatgactagcacacccttgagaccaaacagctgcagaatcaaggtgttgttagggattgcctggttgaaaggcactaaacatcagaagaaggctgcaaagaatgtcatgatgaattccgccaacaggctgagggagatcttttcagaagttgagaaggaggtcacatcaaggaaaggttcaagctaa

SEQ ID NO: 10190 - protein, 1083 aa, Sorghum bicolor
  misc_feature: Ceres ANNOT ID no. 6111534
  misc_feature (24)..(105): Pfam Id: C2 Pfam Desc: C2 domain
  misc_feature (574)..(684): Pfam Id: C2 Pfam Desc: C2 domain
  misc_feature (753)..(819): Pfam Id: GRAM Pfam Desc: GRAM domain
  misc_feature (20)..(1083): NCBI GI: 51814441 NCBI Desc: no pollen; osnop [oryza sativa (japonica cultivar-group)]
  misc_feature (299)..(1076): NCBI GI: 38344486 NCBI Desc: osjnba0022h21.21 [oryza sativa (japonica cultivar-group)]
  misc_feature (299)..(1076): NCBI GI: 116310301 NCBI Desc: osigba0106g07.15 [oryza sativa (indica cultivar-group)]
  misc_feature (615)..(1080): NCBI GI: 15218791 NCBI Desc: c2 domain-containing protein / gram domain-containing protein [arabidopsis thaliana]
  misc_feature (730)..(1083): NCBI GI: 51090353 NCBI Desc: c2 domain-containing protein-like [oryza sativa (japonica cultivar-group)]
MARPSSGPPGGPPEPGRHDAPMLLRVHVIEARGLPAIYLNGSSDPYVRLQLGRRRPRATTVVKRSLSPVWDEEFGFLVGDVAEELVVSVLNEDRFFGAEFLGRVRVPLTAIMETDDLSLGTRWYQLQPRTGGGAKFRKKRRGEICLRVYLSVRATLCDDAHQAPQQLIDDISCSSHRSIETNDSSLSATASSLDMSACASIDRASLKSLDGFNQSIMEVRGPISTGPPSCVSTEQSILLEPEEDDGSADTSTVVEVMSRYFRKTADTTHSVASDPVSTDQFRNTQMNSECRENGEGCTLPEVSLDELLKSMESKDQACEMPANLPGGVLVDQSYIIAPAELNSLLFSGTSDFWPEVSELQGTSGFQIEPWRHDNSENCLKRTISYTKAASKLVKSVKATEEQKYLKANGSSFAVLSSVSTPDVPCGNCFKVEILYRIVSGSQLPLEEQATQLTVSWRLNFVQSTMLKGMIENGAKQGLAEGYSHFSEVLSRKIKVAELDDANSKDKILASLQTQKESNWKLVARFLGSFAFICSLSTALYIMTHLHLAKPNVVHGGLEYFGIDLPDSVGEIVFCLILIIQGHNIIKVGRRFLQAWKQRGSDHGVKAHGDGWLLTIALIEGSGVVSAVFMCNGKRKTSSVKYHTSEPKWNEIFEFDAMDDPPARLDVVVHDSDGPSNETPIGQTEVNFVKNNLSDLGDMWLPLDGRFPQGHQPKLHLRIFLNNSRGTEVVMDYLEKMGKEVGKKMQLRSSQTNSAFRKLFSLPPEEFLIDDFTCHLKRKMPLQGRLFLSPRITGFYSNIFGRKTKFFFLWEDVDDIQVVPPKLATVGSPSLMIILRKDRGLEARHGAKALDPQGRLKFHFQTFVSFNDAHRIIMAIWKMRSPGLEQKGEMIDKEPELKENPYEEGSLLANEDVKMSEVYSAVLSVDVSALMEMFSGGPLEHKVMERAGCVDYSATEWELLNRNVYQRRISFRFDKSLSKYGGEATTTQQKYNLTNQNEWIVEEVMTLQGVQHEDYSSIQLKYHMTSTPLRPNSCRIKVLLGIAWLKGTKHQKKAAKNVMMNSANRLREIFSEVEKEVTSRKGSS

SEQ ID NO: 10191 - DNA, 582 bp, Sorghum bicolor
  misc_feature: Ceres ANNOT ID no. 6111543
  misc_feature: Encodes the peptide sequence at SEQ ID NO 10192
atgtatcatggagattggagatgcaggtgtccgtcggaaccgaagaagatccggccggcacgccgcagtaaggcttcgtctctgaaggcaacctgtgcgctctctaggcggagggcagtttcagagctggtggttctcggtgctgtggccctctccatgccggcgcaagcagcaatgttggagcctgatatcatcaggtaccggaagctggacagcggagtcatactcgaagatgtcgtcgacggggaggggcctgaagcacaggatggggatctggtgcagttcaactacgtctgccgccgcgcaaacggttatttcgtgcatagcacggtggaccagttcagcggtgagagcaagccggtaacacttgcacttggtggagaagagatgattcgaggcctgaaagacgtcataattgggatgaaggccggaggcaagaggagggctctgattcctcctgaagtaggctacatcagtgagacattgaagcccataccagaagagtttggaccgcggcgaagtctgctgtctcatgccaaggagccactggtgtttgaggttcagctgctgaaggtcctgtga

SEQ ID NO: 10192 - protein, 193 aa, Sorghum bicolor
  misc_feature: Ceres ANNOT ID no. 6111543
  misc_feature (82)..(190): Pfam Id: FKBP_C Pfam Desc: FKBP-type peptidyl-prolyl cis-trans isomerase
  misc_feature (8)..(193): NCBI GI: 49388364 NCBI Desc: immunophilin / fkbp-type peptidyl-prolyl cis-trans isomerase-like protein [oryza sativa (japonica cultivar-group)]
  misc_feature (66)..(191): NCBI GI: 145351598 NCBI Desc: peptidyl-prolyl cis-trans isomerase, fkbp-type [ostreococcus lucimarinus cce9901]
  misc_feature (68)..(192): NCBI GI: 78779773 NCBI Desc: peptidylprolyl isomerase [prochlorococcus marinus str. mit 9312]
  misc_feature (68)..(192): NCBI GI: 33861849 NCBI Desc: fkbp-type peptidyl-prolyl cis-trans isomerase (ppiase) [prochlorococcus marinus subsp. pastoris str. ccmp1986]
  misc_feature (54)..(192): NCBI GI: 123969024 NCBI Desc: fkbp-type peptidyl-prolyl cis-trans isomerase (ppiase) [prochlorococcus marinus str. as9601]
MYHGDWRCRCPSEPKKIRPARRSKASSLKATCALSRRRAVSELVVLGAVALSMPAQAAMLEPDIIRYRKLDSGVILEDVVDGEGPEAQDGDLVQFNYVCRRANGYFVHSTVDQFSGESKPVTLALGGEEMIRGLKDVIIGMKAGGKRRALIPPEVGYISETLKPIPEEFGPRRSLLSHAKEPLVFEVQLLKVL

SEQ ID NO: 10193 - DNA, 1494 bp, Sorghum bicolor
  misc_feature: Ceres ANNOT ID no. 6111568
  misc_feature: Encodes the peptide sequence at SEQ ID NO 10194
atggacaatttgaaatttccaatggaggctgagatcattatgagattaaggatagatagttactggtcagaatataatccagatcagtatctatgggaggaagattttatccttgcaggacgtaaatacaaacgactagacttggagcttacaaatgcaagaggctatattttaaaatgcagccactatgttcctgcttttatcccagagaacactgccctcccatgtgtggtctactgccacggaaatagcggatgtcgagcagatgcaaatgaagccgctgtaatacttcttccttcaaatatcactgttttcacacttgacttttctgggtcaggtctatcgggtggggattatgtcagcttgggttggcatgagaaagaggacctcaaatgtgcagtgtcatgtcttcgggacaacaaacaagtttccactataggcctttgggggcgatcaatgggtgctgttacatgcctactctatggagcagaggacccctctattgctggcatggtaatggatagtgctttcactaacctatatgacttgatgatggaacttgttgacgtttacaaaattcgagttcctaaattcacggttaagatggttgtacagtacatgcggcgaatcattcagaaaagagctaagtttgacataatggatcttaatgttttaaagttggctcccaagatgtttatccctgcattatttggacatggtttgaatgatatgtttattcagcctcaccattgtgatcgtattcaccaggcatatgggggggataaaaatataattaaatttgatggtgatcataattccccaagacctcaatcatattatgattcagtttctatattcttctataaaactttgcgtcctcctatgctgcctacaacacgatcaaagcttcatgtgggcgcatttaaagttggtagcataaccaatgagagtttcttctttgaaatcatcaatggtctacggtcagcaaacactgcagcctgcagttcatcaagagatgcacctaacatcccacatgttgaattgttgtctagcatgaatcaactgtccattaagaatgagaatgacttggactttcttttagatgaaaactgcagcctgtcagagattgatggggatagcgttggatcacgtttgcaggataaaacaagtaggcgcaatgaggagtcatgttcattcacaagctctaacagagaaagttggggcagatgttcatctttaggagcagccagtgatgaatcattctcaaatttgacagtgaaggctttggctacgcctctaagacaaaaccagagacaaagccagcggaaaccgatggagaaatctaagcagaagaagattcaagcgttgtggaagaagattaagcgcgagaaggtggagatgggggatagcctatcttcgcgtttgaagatgtgcctggggcaatctccgcggcacaagaggagtagatcgtctggagggattacaacttcatag

SEQ ID NO: 10194 - protein, 497 aa, Sorghum bicolor
  misc_feature: Ceres ANNOT ID no. 6111568
  misc_feature (23)..(446): NCBI GI: 79474471 NCBI Desc: catalytic [arabidopsis thaliana]
  misc_feature (23)..(294): NCBI GI: 79415968 NCBI Desc: catalytic [arabidopsis thaliana]
  misc_feature (41)..(293): NCBI GI: 28828687 NCBI Desc: similar to dictyostelium discoideum (slime mold). random slug cdna-11 (fragment)
  misc_feature (130)..(383): NCBI GI: 115453097 NCBI Desc: os03g0359000 [oryza sativa (japonica cultivar-group)]
  misc_feature (36)..(303): NCBI GI: 67624169 NCBI Desc: random slug cdna-11 (fragment) [cryptosporidium hominis]
MDNLKFPMEAEIIMRLRIDSYWSEYNPDQYLWEEDFILAGRKYKRLDLELTNARGYILKCSHYVPAFIPENTALPCVVYCHGNSGCRADANEAAVILLPSNITVFTLDFSGSGLSGGDYVSLGWHEKEDLKCAVSCLRDNKQVSTIGLWGRSMGAVTCLLYGAEDPSIAGMVMDSAFTNLYDLMMELVDVYKIRVPKFTVKMVVQYMRRIIQKRAKFDIMDLNVLKLAPKMFIPALFGHGLNDMFIQPHHCDRIHQAYGGDKNIIKFDGDHNSPRPQSYYDSVSIFFYKTLRPPMLPTTRSKLHVGAFKVGSITNESFFFEIINGLRSANTAACSSSRDAPNIPHVELLSSMNQLSIKNENDLDFLLDENCSLSEIDGDSVGSRLQDKTSRRNEESCSFTSSNRESWGRCSSLGAASDESFSNLTVKALATPLRQNQRQSQRKPMEKSKQKKIQALWKKIKREKVEMGDSLSSRLKMCLGQSPRHKRSRSSGGITTS

SEQ ID NO: 10195 - DNA, 1341 bp, Sorghum bicolor
  misc_feature: Ceres ANNOT ID no. 6111573
  misc_feature: Encodes the peptide sequence at SEQ ID NO 10196
atgagctgcctccgccgcgctccccgcctcatccggggcctctcttcctcctcggcggcggaggcggaggggaagacgctcccgccgccgcgcccctctgctggccgccgcgtggtcgtgacggggctgggcgccgtcacgccgctggcgcgcggcgtgggcgccacctgggaccgcctcgtcgcggggagatgcgccgtccgctcgctcgccgcagaggacctccgacttccggaggaagcagcggggaggacgctcgagcagctcccgtccagggtggtcgccgccgtgccgcgcgggaagggcgaggacgagttcgacgaggacgcgtggaccaaggataaatctatatcaggatttatatcctatgctctgtgtgcagctgatgaggctttaagagatgcaaattggttgccttccgaagatgagaagaaggaaagaacgggagtctctattggtggagggatcggaagcatctcagatattttagatcgtttacgtcgcctcagcccatacttcatccccaagattttgatcaacatggcatcaggtcatatcagcatgagatatggtttccagggtccaaaccatgctgctgtgacagcttgtgccactggtgctcactctattggcgatgctactaggatgatccaatttggagatgctgatgtgatggtggctggtggaactgagtccagtattgatgctttgtctatagctggattttctaggcaaacgctaagggcattgtctacaaaatataattcgtctccactttcagcttcaagaccttttgattgcggtagagatggatttgcacttgatcatgcaaaggaacggggtgcaaaaatttatgctgaagttcgaggctacggaatgtctggtgatgcacatcacataactcagccacaaaatggtggtagaggtgctatcttagccataaagcgggctttggatcagtcaggtcttcatgcaaatgaaattgattatgtgaatgcgcatgccacgtcaactcctcttggtgatgctgtggaggcgagcgcgatcaaatctgtctttggcgaccacgcagcatctggtggtctcgcattatcctcaacaaagggagcaattggtcatctgctaggggctgccggatcggtggaagcaatcttcactgtgctagcaattcaccacggagttgcgccgcccacgcttaacctagagcagccagacccgctgttcgagggggcgttcacgccactatctgcgcccaagaaggcgctgatacgagcagccatctccaactctttcgggtttggtggaactaacacgtcgctgctgttctcctgcccgccctag

SEQ ID NO: 10196 - protein, 446 aa, Sorghum bicolor
  misc_feature: Ceres ANNOT ID no. 6111573
  misc_feature (285)..(402): Pfam Id: Ketoacyl-synt_C Pfam Desc: Beta-ketoacyl synthase, C-terminal domain
  misc_feature (36)..(282): Pfam Id: ketoacyl-synt Pfam Desc: Beta-ketoacyl synthase, N-terminal domain
  misc_feature (165)..(443): NCBI GI: 56966611 NCBI Desc: chain b, arabidopsis thaliana mitochondrial kas
  misc_feature (165)..(443): NCBI GI: 4587598 NCBI Desc: 3-oxoacyl carrier protein synthase [arabidopsis thaliana]
  misc_feature (26)..(441): NCBI GI: 82946048 NCBI Desc: 3-oxoacyl-(acyl-carrier-protein) synthase [magnetospirillum magneticum amb-1]
  misc_feature (36)..(446): NCBI GI: 83591758 NCBI Desc: beta-ketoacyl synthase [rhodospirillum rubrum atcc 11170]
  misc_feature (36)..(446): NCBI GI: 144899050 NCBI Desc: 3-oxoacyl-[acyl-carrier-protein] synthase ii [magnetospirillum gryphiswaldense msr-1]
  misc_feature (165)..(443): SWISSPROT Homolog: EC 2.3.1.41 3-oxoacyl-[acyl-carrier-protein] synthase, mitochondrial precursor
MSCLRRAPRLIRGLSSSSAAEAEGKTLPPPRPSAGRRVVVTGLGAVTPLARGVGATWDRLVAGRCAVRSLAAEDLRLPEEAAGRTLEQLPSRVVAAVPRGKGEDEFDEDAWTKDKSISGFISYALCAADEALRDANWLPSEDEKKERTGVSIGGGIGSISDILDRLRRLSPYFIPKILINMASGHISMRYGFQGPNHAAVTACATGAHSIGDATRMIQFGDADVMVAGGTESSIDALSIAGFSRQTLRALSTKYNSSPLSASRPFDCGRDGFALDHAKERGAKIYAEVRGYGMSGDAHHITQPQNGGRGAILAIKRALDQSGLHANEIDYVNAHATSTPLGDAVEASAIKSVFGDHAASGGLALSSTKGAIGHLLGAAGSVEAIFTVLAIHHGVAPPTLNLEQPDPLFEGAFTPLSAPKKALIRAAISNSFGFGGTNTSLLFSCPP

SEQ ID NO: 10197 - DNA, 1299 bp, Sorghum bicolor
  misc_feature: Ceres ANNOT ID no. 6111574
  misc_feature: Encodes the peptide sequence at SEQ ID NO 10198
atggcggagccgagccagcagctgctgcggtcgttcgtggaggtgccggcgggctcgcacttccccatccagaacctgcccttcggggtcttccgccgccaggggtcggctcaggcgcaggcgcaggcgccgcgccccgccgtggccatcggggacttcgcgctcgacctcgccgccgtcgccgacgcggggctcttcgacgggcccgtgctctccggctccccgtgctttcaccaggagacgctcaacatgttcttggggatgggccgcccggcgtggagggaggctcgcgccacgctacagaaaattctctcagctgacgagccagtcttgcgtgacaacgaggccctgaggaacaagtgtctggtaccaatgagtgatatcgagatggttctaccaatcacggttggaggttacacagacttcttttgttctgtgcaccatgcaaggaactgcggattcatcttccgagggccgcagactccagtcatgccaaattggttttatcttccaataggatacaatggacgagcatcatctatagttgtgtctggaaccgatgtcattagacccagaggacaaggacatccaacaggaaactcttctgctccttattttggcccctctcagaagcttgattttgaacttgagatggctgccattgttggtccggggaatgaattaggcaaacctattgatattaatgacgctgaagaacatatttttggcctaactttgatgaatgattggagtgccagagatatccaggcttgggagactatacctcttggacctttccttgggaaaagcttcagtaccaccatatcaccatggattgttactctagatgctttgaagcctttcatgtgtgatgctcctaagcaggaacccgagcctttaccgtacctagctgaaaagaaccacataaactatgacattcctcttgaagtctgggttaagcccaaaggtcaaaatgatgcatcagttgtcacaaaaactaatttcaagcatctgtattggacggtgacgcagcagctaacacaccacactatcaatggatgcaacatgagtccaggggatatatttgcaactggcacactcagtggacctgaaccagagtccctcggatgtctgctggagctaacatggaacgggcagaatgagataccggtggggaattcaacccgcaagtatctagaagacggggatgaggtcatcttgacaggatgctgcaagggtgaaggctacaacgttggttttggaacctgcaccgggaaggttctgccggcacttccctga

SEQ ID NO: 10198 - protein, 432 aa, Sorghum bicolor
  misc_feature: Ceres ANNOT ID no. 6111574
  misc_feature (164)..(375): Pfam Id: FAA_hydrolase Pfam Desc: Fumarylacetoacetate (FAA) hydrolase family
  misc_feature (8)..(432): NCBI GI: 87241152 NCBI Desc: fumarylacetoacetase [medicago truncatula]
  misc_feature (8)..(317): NCBI GI: 3157928 NCBI Desc: similar to fumarylacetoacetate hydrolase, gbl41670 from emericella nidulans. [arabidopsis thaliana]
  misc_feature (11)..(431): NCBI GI: 8393349 NCBI Desc: fumarylacetoacetate hydrolase [rattus norvegicus]
  misc_feature (11)..(431): NCBI GI: 14789698 NCBI Desc: fumarylacetoacetate hydrolase [mus musculus]
  misc_feature (11)..(431): NCBI GI: 13399973 NCBI Desc: chain b, crystal structure of fumarylacetoacetate hydrolase complexed with 4-(hydroxymethylphosphinoyl)-3-oxo-butanoic acid
  misc_feature (11)..(431): SWISSPROT Homolog: EC 3.7.1.2 Fumarylacetoacetase
MAEPSQQLLRSFVEVPAGSHFPIQNLPFGVFRRQGSAQAQAQAPRPAVAIGDFALDLAAVADAGLFDGPVLSGSPCFHQETLNMFLGMGRPAWREARATLQKILSADEPVLRDNEALRNKCLVPMSDIEMVLPITVGGYTDFFCSVHHARNCGFIFRGPQTPVMPNWFYLPIGYNGRASSIVVSGTDVIRPRGQGHPTGNSSAPYFGPSQKLDFELEMAAIVGPGNELGKPIDINDAEEHIFGLTLMNDWSARDIQAWETIPLGPFLGKSFSTTISPWIVTLDALKPFMCDAPKQEPEPLPYLAEKNHINYDIPLEVWVKPKGQNDASVVTKTNFKHLYWTVTQQLTHHTINGCNMSPGDIFATGTLSGPEPESLGCLLELTWNGQNEIPVGNSTRKYLEDGDEVILTGCCKGEGYNVGFGTCTGKVLPALP

SEQ ID NO: 10199 - DNA, 834 bp, Sorghum bicolor
  misc_feature: Ceres ANNOT ID no. 6111580
  misc_feature: Encodes the peptide sequence at SEQ ID NO 10200
atggagcagcaggtcttctacagggcgctcgggctctcgctcgtcggcggcctcagcaccgccctcggtgcgctgtttgtggttttgaatcctgcccctaaccttaaagtgctcgggcttctacagggttttgctgctggacttatgctcagcatttcctttctagacttggcacacaatgccctgaattctattggcttcttgaaggggaacctctggttttttgcaggagttcttttctttggtttcattattaagtttattccagagccaaatttttcgccaccagctgatccaagcgagaaaaaggctgatgatgctggaacaggtaaagatataatgagaaaacatcgccggcaagtgtttttcagtggtattatcactgctgttggaattgtcttgcataatattccagagggaatggctgtatttcttggatctgtcaagggtcttcatgtgggtctgaacttggctgttgctattgctttacataacataccagagggggttgctgtagctcttccaatctattttgctaccaaaagcaaaaagcaggcatttgttgtggcagccggctctggtttggccgagccactaggggttattgctgtagctttcttgtttccaagcagtttgaatcctgacattcttgaaggcctacttggatctgttggtggtgtcatggctttcctcactttgcatgaaatgctacctcttgcatttgactattgtggccagaagcaagctgtcaaagctgtttttgtgggcatggcctgcatgtctgcaagcttgtacttcttggaagtcagcttaccaaaggagataagcttgtag

SEQ ID NO: 10200 - protein, 277 aa, Sorghum bicolor
  misc_feature: Ceres ANNOT ID no. 6111580
  misc_feature (10)..(264): Pfam Id: Zip Pfam Desc: ZIP Zinc transporter
  misc_feature (1)..(277): NCBI GI: 71044449 NCBI Desc: branchy [setaria italica]
  misc_feature (1)..(277): NCBI GI: 30102464 NCBI Desc: at3g20870/moe17_16 [arabidopsis thaliana]
  misc_feature (6)..(267): NCBI GI: 119357264 NCBI Desc: zinc/iron permease [chlorobium phaeobacteroides dsm 266]
  misc_feature (9)..(264): NCBI GI: 124008465 NCBI Desc: zinc transporter [microscilla marina atcc 23134]
  misc_feature (12)..(267): NCBI GI: 21227701 NCBI Desc: integral membrane protein [methanosarcina mazei go1]
MEQQVFYRALGLSLVGGLSTALGALFVVLNPAPNLKVLGLLQGFAAGLMLSISFLDLAHNALNSIGFLKGNLWFFAGVLFFGFIIKFIPEPNFSPPADPSEKKADDAGTGKDIMRKHRRQVFFSGIITAVGIVLHNIPEGMAVFLGSVKGLHVGLNLAVAIALHNIPEGVAVALPIYFATKSKKQAFVVAAGSGLAEPLGVIAVAFLFPSSLNPDILEGLLGSVGGVMAFLTLHEMLPLAFDYCGQKQAVKAVFVGMACMSASLYFLEVSLPKEISL

SEQ ID NO: 10201 - DNA, 231 bp, Sorghum bicolor
  misc_feature: Ceres ANNOT ID no. 6111581
  misc_feature: Encodes the peptide sequence at SEQ ID NO 10202
atggagatgaagaaggtcctcgtcgccgcgctcgtcgccgccgcctcggccaccgccgtgctggcctcggtcgccaccgaggcgaccgcgccctccgaggcaggcgcggcaggcgcgcccgccggcgcggccggcggtgcggctggccctggcgccagcggtgccaccgccgccgccgtgcccgccgccggggcgctcgtcgcctccttccttgcctactacctccactga

SEQ ID NO: 10202 - protein, 76 aa, Sorghum bicolor
  misc_feature: Ceres ANNOT ID no. 6111581
  misc_feature (1)..(76): NCBI GI: 33308676 NCBI Desc: anther-specific protein asg3 [malus x domestica]
  misc_feature (3)..(68): NCBI GI: 89901534 NCBI Desc: protein tyrosine phosphatase, receptor type, f-like [rhodoferax ferrireducens dsm 15236]
  misc_feature (10)..(69): NCBI GI: 68231596 NCBI Desc: squalene/phytoene synthase [frankia sp. ean1pec]
  misc_feature (1)..(76): NCBI GI: 20279095 NCBI Desc: arabinogalactan-peptide agp23 [arabidopsis thaliana]
  misc_feature (1)..(76): NCBI GI: 33308670 NCBI Desc: anther-specific protein asg1 [malus x domestica]
  misc_feature: Useful for making plants with altered cell wall content and/or composition
  misc_feature: Functional homolog of the protein sequence encoded by LOCUS at3g57690
MEMKKVLVAALVAAASATAVLASVATEATAPSEAGAAGAPAGAAGGAAGPGASGATAAAVPAAGALVASFLAYYLH

SEQ ID NO: 10203 - DNA, 858 bp, Sorghum bicolor
  misc_feature: Ceres ANNOT ID no. 6111584
  misc_feature: Encodes the peptide sequence at SEQ ID NO 10204
atgggccgcaagggtcgcaaggctagggtttcgcgcgacgccgacgccgacggcagcgaggatgagagggccgccgccgccgctcctgccgccactgcgggcaagagcctctacgagatcctgggagttgagaagactgcttcacaacaagaaataaagaaggcatatcacaaattggcgttgcgcctccacccagataagaatcctggggatgaggaagccaatgagaagtttcagcagctgcagaaggttatatccattcttggtgatgcagagaaaagagctttatatgatgagactggcatcactgatgatgacgcactggtgggagcagctgcagacaatcttcaggagtacttcagaacaatgtacaagaaggtcaccgaggctgacattgaagaatttgaagctaaatacagagggtcagattctgagaaaaaggatttgaaggagctctacacaaaatataagggcaacatgaacaggcttttctgctcaatgatttgctcagaaccaaagcttgactcccaccgcttcaaggatataattgatgaggcaattgctgaaggtgagctgaagtcaactaaggcgtatgagaaatgggctaaaaagatctcagagatggagccaccaacaaatccgttagagaggagagtgaagaagaagaagaatagtgagaatgatctgatcctggccatctcacagcgcagggctgagcggaaaaaccagttcaattccatcctttcgaacatcatgtccaagtgcgactccaaggcaagcagctcggagcccacggaagaggagtttgagcgggcgcgacagaggcttgagagcaaaagggccaagaggcgcaagtga

SEQ ID NO: 10204 - protein, 285 aa, Sorghum bicolor
  misc_feature: Ceres ANNOT ID no. 6111584
  misc_feature (36)..(98): Pfam Id: DnaJ Pfam Desc: DnaJ domain
  misc_feature (35)..(284): NCBI GI: 92897598 NCBI Desc: heat shock protein dnaj [medicago truncatula]
  misc_feature (1)..(285): NCBI GI: 2689720 NCBI Desc: dnaj homologue [arabidopsis thaliana]
  misc_feature (36)..(263): NCBI GI: 50539934 NCBI Desc: zgc:92648 [danio rerio]
  misc_feature (37)..(284): NCBI GI: 32398706 NCBI Desc: dnaj protein-like, possible [cryptosporidium parvum]
  misc_feature (37)..(263): NCBI GI: 89269529 NCBI Desc: dnaj (hsp40) homolog, subfamily c, member 9 [xenopus tropicalis]
MGRKGRKARVSRDADADGSEDERAAAAAPAATAGKSLYEILGVEKTASQQEIKKAYHKLALRLHPDKNPGDEEANEKFQQLQKVISILGDAEKRALYDETGITDDDALVGAAADNLQEYFRTMYKKVTEADIEEFEAKYRGSDSEKKDLKELYTKYKGNMNRLFCSMICSEPKLDSHRFKDIIDEAIAEGELKSTKAYEKWAKKISEMEPPTNPLERRVKKKKNSENDLILAISQRRAERKNQFNSILSNIMSKCDSKASSSEPTEEEFERARQRLESKRAKRRK

SEQ ID NO: 10205 - DNA, 2754 bp, Sorghum bicolor
  misc_feature: Ceres ANNOT ID no. 6111593
  misc_feature: Encodes the peptide sequence at SEQ ID NO 10206
  misc_feature: Up-regulated in shoot tissues in response to methyl jasmonate treatment
  misc_feature: Up-regulated in shoot tissues in response to salicylic acid treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
atgattaacctgaacctgaagcagcctctcatgctgcccgcgcaccagagcaatgtcgtcgtcggctcgcgcctggcgtcgtcgccctcagcggcggccgtcagcaggcctcggaggggcggtgctggcgtgtcctcctcctcctcccgctcccggtcctcgtcccggcggcacacgcggctgccgaggatcagctgcagcgccaccgaggaggtcagcggcgccgtggcggccgtcaccgtggagccgccgcagatgctgacggtgacggccacggtggaagcgtcgccggccatcgggcagatgtacttcgagcgcgccctcgacgacgtcggcgacctcctcggcaagacgctgctcttggagctcgtcagctccgagctcgacgcaaagtctggcctggagaagccgcgggtggcggcgttcgcgcacaagacgcttcgcgagggccactacgaggcggagttcaagttgccggcgtcgttcggtccggtgggcgccgtgctggtggagaacgagcaccacaaggagatcttcatcagggagatcaagctcgtcaccggcggcgacaccagcaccgccgtcaccttcgactgcaactcctgggtgcactccaagttcgacaaccccaacaagcgcatcttcttcaccctcaagtcctacttgccctctgacacgcccaagggcctggaggagctgaggaagaaagacctacaggcgctgcgcggcgacgggagcggcgagcgcaggctgttcgagcgcgtctacgactacgacgtgtacaacgacctgggcgacccggacaagcaccccacccaccagcgtcccatcctcggcggcagcaagcggttcccctacccgcgccggtgccgcaccggccgccccaggaccaagagcgacccgcagacggagaagcgcgacggccggcaccactacgtgccccgcgacgagcagttctcggaggtgaagcagctcacgttcggcgccaccacgctgcggtccggcctccacgcgctgctgccggcgatcaggccgctgctccaaaacaggaaggagctccggttccctcacttcccgtccatcgacggcctctacagcgacggcatcccgctgccggcgcagaccggtttcgacgccatccgcagcgtcgtccctcgcgtcgtcaagctcgtcggcgaaaccaccgatcacgtcctccgcttcgaggtccccgagatgattgagagggaccggttctcgtggttcaaagacgaggagttcgcgaggcagacgatcgcggggctgaacccggtgtgcatccagctcctgagggagttccccatcaggagcaagctggacgaggaggtgtacggtccggcggagtccgccatcaccaaggagatcctggagaagcagatgaacggcgccatgacggtggagcaggcggtggcggcgaagcggctcttcatcctggactaccacgacgtgttcctgccctacgtgcacaaggtgcgggagctgccggacacgacgctctacggctcccgcaccgtcttcttcctcacggacctgggcacgctcatgccgctggccatcgagctgacgcgccccaagtcgccgaccaagccgcagtggaagcgggtgttcacgcacggcccggacgccaccgacgcctggctgtggaagctggccaaggcgcacgtgctcacccacgacacggggtaccaccagctggtcagccactggctgcgcacgcactgctgcgtggagccctacatcatcgccgccaaccggcagctgagccggctgcacccggtgtaccgcctgctgcacccgcacttccgctacaccatggagatcaacgcgctggccagggaggcgctcatcaacgccgacggcatcatcgaggagtccttctggcccgggaagtacgccgtcgagctcagctcagtggcgtacggcgcgacgtggcagttcgacacggaggcgctgcccaacgacctcgtcaagcgagggctcgccgtgcgccgggacggcgacggcgacggcgagctggagctcaccatcaaggactacccctacgcccacgacgggctcatgatctggaactccatcaagcagtgggtgaccgactacgtcggcgtctactacaagtccgacgaggccgtcgccggcgacacggagctgaaggcgttctgggacgaggtgcggaacgtggggcacggcgacaagaaggacgagccgtggtggcccgtgctcaacacccgggacagcctcgtggagacgctcaccaccatcatgtgggtcacctccggccaccactcggccgtcaacttcgggcagtaccactacggcggctacttcccgaaccggccgaccaccatacggaagaacatgccggtggaggagggccgggacgaggagatgaggaaattcctctcgcagccggagacgacgctgctggacatgatgccgacgcagatgcaggccatcaggatcatgacgacgctggacatcctgtcgtcgcactcgcccgacgaggagtacatgggggagttcgcggagccgtcgtggctggtggaacccatggtgaaggcggcgttcgagaagttcagcggcaggatgaaggagatcgagggattcatcgacgagtgcaacaacaacccggagaacaagaaccggtttggagccgggatcgtgccgtacgagctgctcaagcccttctccaagccgggagtcaccgggaggggcatcccctacagcatctctatctga

SEQ ID NO: 10206 - protein, 917 aa, Sorghum bicolor
  misc_feature: Ceres ANNOT ID no. 6111593
  misc_feature (227)..(901): Pfam Id: Lipoxygenase Pfam Desc: Lipoxygenase
  misc_feature (119)..(215): Pfam Id: PLAT Pfam Desc: PLAT/LH2 domain
  misc_feature (1)..(917): NCBI GI: 93211180 NCBI Desc: lipoxygenase [zea mays]
  misc_feature (1)..(917): NCBI GI: 84626297 NCBI Desc: lipoxygenase [zea mays]
  misc_feature (1)..(917): NCBI GI: 84626299 NCBI Desc: lipoxygenase [zea mays]
  misc_feature (1)..(917): NCBI GI: 93211182 NCBI Desc: lipoxygenase [zea mays]
  misc_feature (4)..(917): NCBI GI: 34922538 NCBI Desc: lipoxygenase 2.3, chloroplast precursor (lox2:hv:3)
  misc_feature (4)..(917): SWISSPROT Homolog: EC 1.13.11.12 Lipoxygenase 2.3, chloroplast precursor
  misc_feature: Up-regulated in shoot tissues in response to methyl jasmonate treatment
  misc_feature: Up-regulated in shoot tissues in response to salicylic acid treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
MINLNLKQPLMLPAHQSNVVVGSRLASSPSAAAVSRPRRGGAGVSSSSSRSRSSSRRHTRLPRISCSATEEVSGAVAAVTVEPPQMLTVTATVEASPAIGQMYFERALDDVGDLLGKTLLLELVSSELDAKSGLEKPRVAAFAHKTLREGHYEAEFKLPASFGPVGAVLVENEHHKEIFIREIKLVTGGDTSTAVTFDCNSWVHSKFDNPNKRIFFTLKSYLPSDTPKGLEELRKKDLQALRGDGSGERRLFERVYDYDVYNDLGDPDKHPTHQRPILGGSKRFPYPRRCRTGRPRTKSDPQTEKRDGRHHYVPRDEQFSEVKQLTFGATTLRSGLHALLPAIRPLLQNRKELRFPHFPSIDGLYSDGIPLPAQTGFDAIRSVVPRVVKLVGETTDHVLRFEVPEMIERDRFSWFKDEEFARQTIAGLNPVCIQLLREFPIRSKLDEEVYGPAESAITKEILEKQMNGAMTVEQAVAAKRLFILDYHDVFLPYVHKVRELPDTTLYGSRTVFFLTDLGTLMPLAIELTRPKSPTKPQWKRVFTHGPDATDAWLWKLAKAHVLTHDTGYHQLVSHWLRTHCCVEPYIIAANRQLSRLHPVYRLLHPHFRYTMEINALAREALINADGIIEESFWPGKYAVELSSVAYGATWQFDTEALPNDLVKRGLAVRRDGDGDGELELTIKDYPYAHDGLMIWNSIKQWVTDYVGVYYKSDEAVAGDTELKAFWDEVRNVGHGDKKDEPWWPVLNTRDSLVETLTTIMWVTSGHHSAVNFGQYHYGGYFPNRPTTIRKNMPVEEGRDEEMRKFLSQPETTLLDMMPTQMQAIRIMTTLDILSSHSPDEEYMGEFAEPSWLVEPMVKAAFEKFSGRMKEIEGFIDECNNNPENKNRFGAGIVPYELLKPFSKPGVTGRGIPYSISI

SEQ ID NO: 10207 - DNA, 888 bp, Sorghum bicolor
  misc_feature: Ceres ANNOT ID no. 6111600
  misc_feature: Encodes the peptide sequence at SEQ ID NO 10208
atggacggcggccgcaagagggggaaggccgacggcgccaaaggggcctccgccggcgcgaagcggtcgcgagaatcggagtcatttcaaagtggcgtaggaagcaaatcgaagccatgcaccaattttttcagtacttctggttgtccctttggtgagggctgccattttctccattacttccccggtggctaccaggcagtttcaaaaatgaccaatctgggtggcacaacaattgcatctcctggaagaatgacgatggacgggccacctacacccaccgtgaagactcgcttgtgcaacaagtacaacactgcagagggatgcaaatggggtgacaaatgccactttgcacatggtgaaaaggagcttggcaagcctaagttgatgggcagctatatgccacctcccatggggccaagacccactggtcattttgcacctccaccaatggccagccctggcttggccactccagctagcttcggcgcttctgccacagccaagatcagtgttgatgcatcccttgcaggtggcatcatcgggaggggtggagtaaacacaaaacagatatcccgagtcaccggggcaaagctggccatccgggaccatgaatcagacaccagcttgaaaaacattgagcttgagggcacctttgatcagatcaggaatgctagtgctatggtcagtgagcttattgtcagcatcagtggcaatgcccctccacaggccaagaacccagctggcggtactcatcgtggtggacgcacaggaagcaacttcaagaccaagatgtgtgagaacttcgcaaaagggtcgtgttcgtttggcgacaagtgtcactttgcccatggtgacaatgagctgcgcaagcctgctgctgcttga

SEQ ID NO: 10208 - protein, 295 aa, Sorghum bicolor
  misc_feature: Ceres ANNOT ID no. 6111600
  misc_feature (95)..(121): Pfam Id: zf-CCCH Pfam Desc: Zinc finger C-x8-C-x5-C-x3-H type (and similar)
  misc_feature (261)..(286): Pfam Id: zf-CCCH Pfam Desc: Zinc finger C-x8-C-x5-C-x3-H type (and similar)
  misc_feature (167)..(229): Pfam Id: KH_1 Pfam Desc: KH domain
  misc_feature (3)..(295): NCBI GI: 51090454 NCBI Desc: kh domain-containing protein / zinc finger protein-like [oryza sativa (japonica cultivar-group)]
  misc_feature (5)..(294): NCBI GI: 32488659 NCBI Desc: osjnba0087o24.9 [oryza sativa (japonica cultivar-group)]
  misc_feature (5)..(294): NCBI GI: 116308845 NCBI Desc: h1005f08.11 [oryza sativa (indica cultivar-group)]
  misc_feature (45)..(295): NCBI GI: 115468968 NCBI Desc: os06g0618100 [oryza sativa (japonica cultivar-group)]
  misc_feature (10)..(126): NCBI GI: 92081526 NCBI Desc: zinc finger protein [ciona intestinalis]
  misc_feature: Useful for making plants with altered alkaloid content
  misc_feature: Useful for making plants with altered terpenoid content
  misc_feature: Functional homolog of the protein sequence given in SEQ ID NO 12965
  misc_feature: Functional homolog of the protein sequence given in SEQ ID NO 13274
  misc_feature: Useful for making plants with altered alkaloid content
  misc_feature: Functional homolog of the protein sequence given in SEQ ID NO 13274
  misc_feature: The sequence is a functional homolog of SEQ ID NO. 291 in the 11/188,298 US application
MDGGRKRGKADGAKGASAGAKRSRESESFQSGVGSKSKPCTNFFSTSGCPFGEGCHFLHYFPGGYQAVSKMTNLGGTTIASPGRMTMDGPPTPTVKTRLCNKYNTAEGCKWGDKCHFAHGEKELGKPKLMGSYMPPPMGPRPTGHFAPPPMASPGLATPASFGASATAKISVDASLAGGIIGRGGVNTKQISRVTGAKLAIRDHESDTSLKNIELEGTFDQIRNASAMVSELIVSISGNAPPQAKNPAGGTHRGGRTGSNFKTKMCENFAKGSCSFGDKCHFAHGDNELRKPAAA

SEQ ID NO: 10209 - DNA, 1113 bp, Sorghum bicolor
  misc_feature: Ceres ANNOT ID no. 6111603
  misc_feature: Encodes the peptide sequence at SEQ ID NO 10210
atgccaaagaaggggactaaatctaaggaggtggacaatgcacccaatcaacaagaaaacaagcttccagactacctggaggtccagcgcacacgtgttgtctgcaatgctgatgcccccattcatactcaaggttaccaatactcgggtacatttgctgctatgggagttgataatagcgtgtcagtggagaagttttgcaagaacttcaaaattgaaataaatcgtctcactgaagatgatatggagtttgatatgattggtattgatgcatcaatagctaatgctttccggagaatcctcatcgcagaggttcctactatggcaattgagaaaatcttcatggttgacaacacctcagttatagcagatgaggttctttcacatagactaggacttattccacttcgtgcagatccaaggctttttgattacatctcagaaaatgatgtcccaaatgaaaggaatactgttgtttataaactgcatgtttcatgtccaaagggttctcaacgaattacagtgaaatctagtgaactagagtggttacctgaaggtagccaattaagcatggcagcccctgcgcagtctggggacaaacagaagactttcacatccttcagtcaaagccaaaaggagatcttagaagagcctcttggtgtgaagtttaaagatattactattgccaggcttgggccaggacaggctattgagcttgaggcacatgctgttaagggagttgggaaagttcatgccaagtggtctccagttgctacagcctggtacagaatgctccctgaggttgttattctcaaagatattgaaggtgatgatgcagaggagctagtaaagaagtgcccagttaatgtttttgacattgaagacctgggtaatggtggaaagagggcagttgttgcaaaaccaagggcatgcacactctgtagagaatgtgtcatgggaccaaatgggaatcaagttgaactacggcgtgtcagggaccacttcatattcaccatcgagtctaccggagctctgcccccagaggtgctgttcacagaagccgtcaagattttggaagagaaatgtgagagggtcatatctgaactatcctga

SEQ ID NO: 10210 - protein, 370 aa, Sorghum bicolor
  misc_feature: Ceres ANNOT ID no. 6111603
  misc_feature (80)..(367): Pfam Id: RNA_pol_L Pfam Desc: RNA polymerase Rpb3/Rpb11 dimerisation domain
  misc_feature (113)..(255): Pfam Id: RNA_pol_A_bac Pfam Desc: RNA polymerase Rpb3/RpoA insert domain
  misc_feature (22)..(370): NCBI GI: 92888293 NCBI Desc: rna polymerase, dimerisation [medicago truncatula]
  misc_feature (3)..(365): NCBI GI: 21592304 NCBI Desc: rna polymerase subunit [arabidopsis thaliana]
  misc_feature (3)..(365): NCBI GI: 514322 NCBI Desc: rna polymerase subunit
  misc_feature (41)..(369): NCBI GI: 49618929 NCBI Desc: rna polymerase i 140 kda subunit [danio rerio]
  misc_feature (41)..(369): NCBI GI: 41056007 NCBI Desc: rna polymerase 1-1 [danio rerio]
MPKKGTKSKEVDNAPNQQENKLPDYLEVQRTRVVCNADAPIHTQGYQYSGTFAAMGVDNSVSVEKFCKNFKIEINRLTEDDMEFDMIGIDASIANAFRRILIAEVPTMAIEKIFMVDNTSVIADEVLSHRLGLIPLRADPRLFDYISENDVPNERNTVVYKLHVSCPKGSQRITVKSSELEWLPEGSQLSMAAPAQSGDKQKTFTSFSQSQKEILEEPLGVKFKDITIARLGPGQAIELEAHAVKGVGKVHAKWSPVATAWYRMLPEVVILKDIEGDDAEELVKKCPVNVFDIEDLGNGGKRAVVAKPRACTLCRECVMGPNGNQVELRRVRDHFIFTIESTGALPPEVLFTEAVKILEEKCERVISELS

SEQ ID NO: 10211 - DNA, 1497 bp, Sorghum bicolor
  misc_feature: Ceres ANNOT ID no. 6111604
  misc_feature: Encodes the peptide sequence at SEQ ID NO 10212
atggccacaacggcgacaacgacggcgacggtgacggcgccggcggccacagccaacttcgtacctacaccaacgcctccgcatccacgccccgccgcgccacctgctctccgggcgccttccaccttgggtcctgtcaagtcagaggcccctcccaccccctcgtcctctaccgccaccaccgccgcggccgcagccgccgtagcggaggatccatcctacatcatcaccgtccctagttattcagcgtggttctcgttcgactccatccacgacacggagcgccgcctcctgccggagttcttcgagggagaggccgcggcggcgtccgggtgccggggcccgcacgcgtacaagtattaccgcgactccctgatacggaggttccgggcgcggccgggtcgacggctcacactcacggaagccaggagggggcttgttggtgacgtcggctcagtccgccgcgtcttcgacttccttgaggaatgggggctcatcaactacggtgctttgccatcggggtcaaagcaagcgaaagagaagagggaagaggctgcgcaacagtcaacgttgccttctggggcaactgtacccaggaagctctgtactggatgccgcaccgtgtgtgggcttgcttacttcgcctgcgacaaggcagatataagtctttgtactagatgctatgtaaataataactaccggccgggtctgtctcctgctaacttcaagagagttgaaattactgaagattcaaaagcagattggacagacaaagaaactcttcacttgcttgaggctgtcttgcattatggcgaagactggaaaaaggtgtctgaacatgttggtagtcggtcagaaaaagactgtattgcaagatttatacggttacctttcggagaacagttcatgggacccagggaggatagaatgggatttgagaacaatgatgacaatactgatgagcctggagcagatgtctcaaaacgactacatctcactccactagcagatgcaagcaatccgattatggctcaggttgcatttttatcagctattgtgggtcccgatgttgcctcagctgcagcgcaagcagctatttctgcacaatcccgtgttgacctaaatgacagcgagattgaaacttcaataaatagcaccaaggaagaagaatcatctcacacaaatgggctctcagtcaacgatttactgaaagaggcggctgctaatgcacgggcacaacttgagaaggaacgaaacagcatagagcaatctttatcaaacatagtagatgtccagatgatggaaatccaagataaaatatgccggtttgaacagaaggagatgctgatggagaaagagcgacagcagctgaattgtctaagggatatacttttcacagatcaattggcagttatgcaacatcaacaaaggactccagctgtagtcacagagtgcaaaggtgatgagaagccaaagcccctggcaaacatgagttga

SEQ ID NO: 10212 - protein, 498 aa, Sorghum bicolor
  misc_feature: Ceres ANNOT ID no. 6111604
  misc_feature (76)..(168): Pfam Id: SWIRM Pfam Desc: SWIRM domain
  misc_feature (252)..(297): Pfam Id: Myb_DNA-binding Pfam Desc: Myb-like DNA-binding domain
  misc_feature (23)..(479): NCBI GI: 92874312 NCBI Desc: swirm; lambda integrase-like, n-terminal; homeodomain-related [medicago truncatula]
  misc_feature (68)..(424): NCBI GI: 37718972 NCBI Desc: riken cdna 5930405j04 [mus musculus]
  misc_feature (68)..(424): NCBI GI: 57012941 NCBI Desc: swi/snf-related matrix-associated actin-dependent regulator of chromatin subfamily c member 2 (swi/snf complex 170 kda subunit) (brg1-associated factor 170)
  misc_feature (221)..(490): NCBI GI: 60471048 NCBI Desc: myb domain-containing protein [dictyostelium discoideum]
  misc_feature (221)..(490): NCBI GI: 42733731 NCBI Desc: similar to homo sapiens (human). similar to swi/snf related, matrix associated, actin dependent regulator of chromatin, subfamily c, member 1 (fragment) [dictyostelium
  misc_feature (221)..(490): NCBI GI: 42733731 (continued) discoideum]
  misc_feature: The sequence is a functional homolog of SEQ ID NO. 492 in the 11/188,298 US application
MATTATTTATVTAPAATANFVPTPTPPHPRPAAPPALRAPSTLGPVKSEAPPTPSSSTATTAAAAAAVAEDPSYIITVPSYSAWFSFDSIHDTERRLLPEFFEGEAAAASGCRGPHAYKYYRDSLIRRFRARPGRRLTLTEARRGLVGDVGSVRRVFDFLEEWGLINYGALPSGSKQAKEKREEAAQQSTLPSGATVPRKLCTGCRTVCGLAYFACDKADISLCTRCYVNNNYRPGLSPANFKRVEITEDSKADWTDKETLHLLEAVLHYGEDWKKVSEHVGSRSEKDCIARFIRLPFGEQFMGPREDRMGFENNDDNTDEPGADVSKRLHLTPLADASNPIMAQVAFLSAIVGPDVASAAAQAAISAQSRVDLNDSEIETSINSTKEEESSHTNGLSVNDLLKEAAANARAQLEKERNSIEQSLSNIVDVQMMEIQDKICRFEQKEMLMEKERQQLNCLRDILFTDQLAVMQHQQRTPAVVTECKGDEKPKPLANMS

SEQ ID NO: 10213 - DNA, 906 bp, Sorghum bicolor
  misc_feature: Ceres ANNOT ID no. 6111605
  misc_feature: Encodes the peptide sequence at SEQ ID NO 10214
atggcagcggcggggattggggccgggggaggagaggaccacgaccttcccctcgaggaggtcgacgccgtcctggcctccttctccggcgaccccgccgccgccttcgccccgctgccggcaccggaggcggcggcgtcgcgggagccggtggtggttgctggtgagagcctacgggaggggctgggggacgtcgagaagttccttatgcaggactacgaggacgaggcaccgttggacggggttgatgagttcttgaacggcatcctcgttggggacagcgagggcgagggtagccccaagctcactggtgagaagagcgcggatagggcgtgcgcgggggaggatgaggtggtggtgggtgtggattgcggcgatgattccaacagccagaagaagtggagacaaatgaggaatagggattctgccatgaaatctagggagaagaagaaattgtatgtaaaagatctggagatcaagagcaagtatctggaggcagagtgctgccgcctaagctatgccctccagtgttgcactgccgagaacatggtgcttcgccagagtttgctgaaggataggcatgccggtgctcccacagccatgcaggagtctgccgaactctcggaaaccctgccgctggtttccctgctttggctagtgagcatcttgtgcctattcctggtggacgacatgcccaacagaagcctggtggctccaagaagcctcgaaagagatcttgtaaagctagccaggacatcaataaacggtgtaaagatgaccagaatgacaaacaacagtgacaatcctggggctttgggactcatccgccttggaagacgctgcagaggcacaagggcgaggatcaagtcaccttgggttccttggcatgcagtagctgcttgctaa

SEQ ID NO: 10214 - protein, 301 aa, Sorghum bicolor
  misc_feature: Ceres ANNOT ID no. 6111605
  misc_feature (127)..(181): Pfam Id: bZIP_2 Pfam Desc: Basic region leucine zipper
  misc_feature (127)..(190): Pfam Id: bZIP_1 Pfam Desc: bZIP transcription factor
  misc_feature (13)..(301): NCBI GI: 51090849 NCBI Desc: bzip transcription factor-like [oryza sativa (japonica cultivar-group)]
  misc_feature (64)..(289): NCBI GI: 60459369 NCBI Desc: bzip transcription factor protein [capsicum annuum]
  misc_feature (62)..(240): NCBI GI: 113367186 NCBI Desc: bzip transcription factor bzip68 [glycine max]
  misc_feature (130)..(171): NCBI GI: 116739260 NCBI Desc: at1g42990-like protein [arabidopsis halleri subsp. halleri]
  misc_feature (130)..(171): NCBI GI: 116739262 NCBI Desc: at1g42990-like protein [arabidopsis lyrata subsp. lyrata]
  misc_feature: Useful for making plants with modulated nitrogen use efficiency
  misc_feature: Functional homolog of the protein sequence encoded by LOCUS at1g42990
MAAAGIGAGGGEDHDLPLEEVDAVLASFSGDPAAAFAPLPAPEAAASREPVVVAGESLREGLGDVEKFLMQDYEDEAPLDGVDEFLNGILVGDSEGEGSPKLTGEKSADRACAGEDEVVVGVDCGDDSNSQKKWRQMRNRDSAMKSREKKKLYVKDLEIKSKYLEAECCRLSYALQCCTAENMVLRQSLLKDRHAGAPTAMQESAELSETLPLVSLLWLVSILCLFLVDDMPNRSLVAPRSLERDLVKLARTSINGVKMTRMTNNSDNPGALGLIRLGRRCRGTRARIKSPWVPWHAVAAC

SEQ ID NO: 10215 - DNA, 5088 bp, Sorghum bicolor
  misc_feature: Ceres ANNOT ID no. 6111608
  misc_feature: Encodes the peptide sequence at SEQ ID NO 10216
atgtcgacccccacggcgccactcggcggcgcgtctccgtcgggccgcgttctgggcccagcgctggaccggatcatcaaaaacgccgcgtggcggaagcattcggcgctcgtggccgcggcaaaggcggcactcgacctcctctcctcatcgccggcatgcccgtcgccggaccctacctcgccgcaatcctcgccgctgctcggcctgccctccgccgccgccgacgcgtccctccacgcgctgctgctcgctctcgagtccgcttcgcccaaggtcgccgaccccgctctcgattgcgtcaccaagctcctttatcaccgcctcctcctcggcgacctcggctgcgccggcgccggcgacgatccctctgcccccacctccaggctcctcaatgccgtcctcacctgtggcgcgctctctgatgatgcaatggagcttgccaccctccgtgtcatagtcgccgcagcgcggtgccccaccgtcgccatccgcggggagggcctcggccaggtgctcaggacctgctacaacatatacctcagcagcagcagtggtgccaatcagctctgcgccaagcttgcgctggcgcaggtgctggtgattgtgtttgcacgcgtggaggtggattccatggacgtgcacgttcggacggtgtcgatcacggacatgttggacgtgtctgaccgcaacctgaacgactccagcatcgtgcaggtggctcaggggtttataaacgaggctatggaggggggtgatgccccagagccaggggcacatttggagccaactgaggtggatggaaaggaggatgttgggatgagcaagaccagagaggatgggcttgcgctcttcaagaacctgtgcaagctatcaatgaagttctcgacaccagataaccctgaggatcagatgttgctgcggggcaaggtgttgtctcttgagttgctgaaaatggttatcgacaatgcaggccctttctggagaacaaatgaaaagtaccttggagcaatcaagcagtatctttgtttgtccttattgaagaacagtgctttgtcagcaatgagtattttccagttgttgtgctccatatttgtgggcttactgtcaaggtttagatctgggctgaaagaagaaattggaatattctttccaatgcttgtcctaagggttcttgagaatgtccatcaacctagctttctacaaaaaatgacagttctaaacttgctagaaaagatctgtaaagaatctcaggttcttattgatatctttgtgaactatgattgcgatgtagatgcgccaaatatttttgaaagggttgtcaatggacttttaaaaactgctttaggtgttcctccaggatctacaacaacattaactacagcccaagaccaaacatttcggattgagtcagtgaagtgccttgcaaccataatcaagtcaatgggttcatggatggaccaacaactgaaaattggtgatttttcaccaaaaatttctgaagcttctttaagttctttaagttcaatagacattcctaacatccttattggagaagatggcagtggagttgattatgaactgcaatctgactctggtagcccagatgtatctggtgctccctcccttgagcaacgtcgtgctttcaaaatagaacttcagaaaggaatatccttgtttaaccgaaaaccttccaagggaattaattttcttgttaaaagcaagaagatagggcatacgccagaagatgttgcttgtttcttgaggaacactgctggtttaaatgcaacaatgattggagactatttgggtgaaagagatgaattccctatcaaagttatgcatgcgtatgttgatgcactgaacttcgaaggtatggacttcggtgaagctattaggtattatttgcgaggcttcaggttgcctggtgaagcacagaaaattgatcggatcatggaaaagtttgctgaacgatactgcaaatgcaatccaaactcctttaccagtgcagatactgcatatgttcttgcttattctgtaatcatgctcaacactgatgctcacaatactatggttaaggataagatgtctaaatctgacttcattcgcaataaccgaggaatagatgatgggaaggacttgccagaagtttatctgggtacactgtatgaccaaattgtcaaaaatgagatcaaaatgagtgctgattcatcaattccacaaaacaagcaacctagtagtgtgatgaagctattaggtttggacaacattatcagctttgttaactggaaacaggctgatgacagggtagttggagcaaatgacctgctcataaaaaacatacaagagaaatttaaactaaagagtggaaagtcagagtctgtgttttctattatcactgatacaacaattttaagattcatgatggaggtttgttgggcccctatgatggctgcattcagtgtgacacttgatcagagtgatgataaggccgccacgtcacagtgtttgcagggattcaggtctgctgtgcatgttacctctgttatgtgcatgcagacacagagagatgcctttgtgacatctgtagcaaaattcacatatctgcattgtgctgctgatatgaaacaaaagaatgtggatgctgtgaaggctataatatccattgcaatcgaagatggtgattatttgcaggaagcttgggagcatgtactaacatgcctttcacggtttgaacatttacatcttcttggagagggggcacctactgatgcttcatttctcacagtaccactggttaactcagaagataaaacacagaagtctacctctatgtcatcaaagagaactaatgcacttcagaatccagcggtaatggctgctgttagaggaggttcttatgacagcacaacagcaaaaaataaagtgtcaccgttggttactcctgaacagattaataattttatatcaaacataaacctgctagaccagattggcattttcgagttaaatcacatatttgctcatagcccaagattaaatagtgatgctattgttgcttttgtgaatgctctttgcaaagtttcaatgacagagttgcagtctcctacagatcctcgtatcttctgcctaacaaagattgttgagattgcgcattacaatatgaaccgcatacgtttggtttggtcccgtatttggaaagttctgtcagatttttttgtttctgttgggttgtcagagaatctttcagttgcaatatttgttatggactctttgaggcagctagctatgaagtttctggaaagagaagaactggcaaattataatttccaaaatgaattcctgcaaccttttgcggttgttatgcagaagagcaatgcttcagaagtacgtgaacttatagttcgatgtgtctcccaaatggttctgagtcgtgtcaacaatataaaatctggatggaaaagtgtttttacggtttttactgcagctgctgctgatgatcggaaaaatattgttctgttggcatttgaaaccatggaaaagattgttcgggactatttcccttacataactgaaactgaaaccacaacgtttactgattgtgttaaatgccttatcacattcacaagtagtaaatttagcagtgatgccagtcttaatgccattgcatttcttcggttttgtgccgtcaaactcgctgaggaaggatttattagtcatgagaaggatactgaccagcaaccaagtaacttagattcatcagatgggaacagcacggtgcataaggatgatcatgtttacttctgggttcctttgcttgctggtctagctagattgacaactgactcaagaccaactatcagaaaaggttctgtggaagtgctctttgacatcttgcaagatcatgggcacctcttttctcagtccttctgggctaatatctttgaatcagttatttatcccctatttagcagtgaaagctttgcaccaaatggccaaatttcaagtgtaaatagtaccgaggatgattcttggaattttgaaactaaaatggtggctctaaaatgtttagcagatttgtatgttacgttttttgaagtgatgcgtccagaactttctagagttacttctgttattacgaatttcatcggaagcccttataaacaatcagctaccacaagtatatcagtttttcagcgtttaacagaaggacttgcgagcaagctctccaatgatgagtgggggatgatcttgttgtgtttcaaagaatcagcagcacatacatttgtcgtgtttgacaaaatagttaggatgatgaaaggcattgaaattccagatagaaatgaatcttactctgaagctgagcaatattcagatcatgacatatacaatgatgatgaagaggaagctaatatggaaacagcatcttatgctgttgtcagaatgaagaatcatatggctttgcaactcttaattgttgagggcatcattaaattgtatgaggtgaacagaagctttctttgtgctgagcatataggcataatgttggagatgctatctgccattgcatcacatgcaagtgaagtgaactctgaatctaacttgcacattaaactacatatagcatgttccattttggaggtatctgagccagcggtcatccatttcgagagcgagtcctaccagagctacctcaaacttctccaagctcttcttcatgataacccatctttgtcagaaaatatgaatgtggagtcacagattatgcttgtctgcgagaaaatattgcgattgtatctgacctgtgcaggacatgaaccatctaatgatgtttctggtagagatccagctttacatcggctgcctctggttactgctaaaaaagaggaactggatgctagaacttcattggtccttcatgtgatgcggttattgggcagtttagagaagaattgctttaggagaaacttgcccctctttttccccttattggctaatcttattcgctgtgagcatagttctcgagaagttcaagttgcactgtatgatatattccaatcatcaataggccccataatatcagcatag

SEQ ID NO: 10216 - protein, 1695 aa, Sorghum bicolor
  misc_feature: Ceres ANNOT ID no. 6111608
  misc_feature (546)..(731): Pfam Id: Sec7 Pfam Desc: Sec7 domain
  misc_feature (8)..(1693): NCBI GI: 15233734 NCBI Desc: guanine nucleotide exchange family protein [arabidopsis thaliana]
  misc_feature (1)..(1694): NCBI GI: 42567412 NCBI Desc: guanine nucleotide exchange family protein [arabidopsis thaliana]
  misc_feature (223)..(1693): NCBI GI: 19879878 NCBI Desc: guanine nucleotide-exchange protein gep2 [oryza sativa]
  misc_feature (218)..(1693): NCBI GI: 8570447 NCBI Desc: contains similarity to a guanine nucleotide exchange factor from homo sapiens gbaf111162 and contains a sec7 pf01369 domain. [arabidopsis thaliana]
  misc_feature (216)..(1338): NCBI GI: 7329696 NCBI Desc: guanine nucleotide exchange factor-like protein [arabidopsis thaliana]
MSTPTAPLGGASPSGRVLGPALDRIIKNAAWRKHSALVAAAKAALDLLSSSPACPSPDPTSPQSSPLLGLPSAAADASLHALLLALESASPKVADPALDCVTKLLYHRLLLGDLGCAGAGDDPSAPTSRLLNAVLTCGALSDDAMELATLRVIVAAARCPTVAIRGEGLGQVLRTCYNIYLSSSSGANQLCAKLALAQVLVIVFARVEVDSMDVHVRTVSITDMLDVSDRNLNDSSIVQVAQGFINEAMEGGDAPEPGAHLEPTEVDGKEDVGMSKTREDGLALFKNLCKLSMKFSTPDNPEDQMLLRGKVLSLELLKMVIDNAGPFWRTNEKYLGAIKQYLCLSLLKNSALSAMSIFQLLCSIFVGLLSRFRSGLKEEIGIFFPMLVLRVLENVHQPSFLQKMTVLNLLEKICKESQVLIDIFVNYDCDVDAPNIFERVVNGLLKTALGVPPGSTTTLTTAQDQTFRIESVKCLATIIKSMGSWMDQQLKIGDFSPKISEASLSSLSSIDIPNILIGEDGSGVDYELQSDSGSPDVSGAPSLEQRRAFKIELQKGISLFNRKPSKGINFLVKSKKIGHTPEDVACFLRNTAGLNATMIGDYLGERDEFPIKVMHAYVDALNFEGMDFGEAIRYYLRGFRLPGEAQKIDRIMEKFAERYCKCNPNSFTSADTAYVLAYSVIMLNTDAHNTMVKDKMSKSDFIRNNRGIDDGKDLPEVYLGTLYDQIVKNEIKMSADSSIPQNKQPSSVMKLLGLDNIISFVNWKQADDRVVGANDLLIKNIQEKFKLKSGKSESVFSIITDTTILRFMMEVCWAPMMAAFSVTLDQSDDKAATSQCLQGFRSAVHVTSVMCMQTQRDAFVTSVAKFTYLHCAADMKQKNVDAVKAIISIAIEDGDYLQEAWEHVLTCLSRFEHLHLLGEGAPTDASFLTVPLVNSEDKTQKSTSMSSKRTNALQNPAVMAAVRGGSYDSTTAKNKVSPLVTPEQINNFISNINLLDQIGIFELNHIFAHSPRLNSDAIVAFVNALCKVSMTELQSPTDPRIFCLTKIVEIAHYNMNRIRLVWSRIWKVLSDFFVSVGLSENLSVAIFVMDSLRQLAMKFLEREELANYNFQNEFLQPFAVVMQKSNASEVRELIVRCVSQMVLSRVNNIKSGWKSVFTVFTAAAADDRKNIVLLAFETMEKIVRDYFPYITETETTTFTDCVKCLITFTSSKFSSDASLNAIAFLRFCAVKLAEEGFISHEKDTDQQPSNLDSSDGNSTVHKDDHVYFWVPLLAGLARLTTDSRPTIRKGSVEVLFDILQDHGHLFSQSFWANIFESVIYPLFSSESFAPNGQISSVNSTEDDSWNFETKMVALKCLADLYVTFFEVMRPELSRVTSVITNFIGSPYKQSATTSISVFQRLTEGLASKLSNDEWGMILLCFKESAAHTFVVFDKIVRMMKGIEIPDRNESYSEAEQYSDHDIYNDDEEEANMETASYAVVRMKNHMALQLLIVEGIIKLYEVNRSFLCAEHIGIMLEMLSAIASHASEVNSESNLHIKLHIACSILEVSEPAVIHFESESYQSYLKLLQALLHDNPSLSENMNVESQIMLVCEKILRLYLTCAGHEPSNDVSGRDPALHRLPLVTAKKEELDARTSLVLHVMRLLGSLEKNCFRRNLPLFFPLLANLIRCEHSSREVQVALYDIFQSSIGPIISA

SEQ ID NO: 10217 - DNA, 696 bp, Sorghum bicolor
  misc_feature: Ceres ANNOT ID no. 6111639
  misc_feature: Encodes the peptide sequence at SEQ ID NO 10218
atggccaccaccaccaccacggcgacagcgtccctcaccaccctgtcccccgccggcgtcggcaagcggttcgtcctctcgtccccgcccctctcattctcctctcaccgcctgaccgccggcctccgccaccgccaccgcggcggcgcggcgtcgaggacggcgaggaggcgggcggcgtcggcgtccccggtggtggcgaccatcgcggtgggcgacaagctccccgacgcgacgctgtcctacttcgacccgtccgacggggagctgaagacggtgacggtggcggagctgacggcgggcaagaaggccatcctcttcgcggtgcccggcgcgttcacgcccacgtgctcgcagaagcacctgccggggttcgtggagaaggccggcgagctcaaggccaagggcgtggagaccgtggcgtgcgtgtcggtgaacgacgcgttcgtgatgaaggcgtggaaggaggcgctggggctcggcgaggatgtgacgttgctgtcggacggcaacctggagctgacacgcgcgctgggcgtcgagatggacctctccgataagcccgtcgggctcggcgtccggtccaggaggtacgcgctcctggccgaggacggcgtcgtcaaggtgctcaacctcgaggacggcggcgccttcaccaccagcagcgccgaggagatgctcaaggtgctcggctga

SEQ ID NO: 10218 - protein, 231 aa, Sorghum bicolor
  misc_feature: Ceres ANNOT ID no. 6111639
  misc_feature (70)..(230): Pfam Id: Redoxin Pfam Desc: Redoxin
  misc_feature (71)..(210): Pfam Id: AhpC-TSA Pfam Desc: AhpC/TSA family
  misc_feature (101)..(230): NCBI GI: 42565527 NCBI Desc: peroxiredoxin [hyacinthus orientalis]
  misc_feature (66)..(230): NCBI GI: 52851172 NCBI Desc: thioredoxin-dependent peroxidase [plantago major]
  misc_feature (66)..(230): NCBI GI: 30841938 NCBI Desc: thioredoxin peroxidase 1 [lycopersicon esculentum]
  misc_feature (66)..(230): NCBI GI: 18654477 NCBI Desc: thioredoxin peroxidase [capsicum annuum]
  misc_feature (66)..(230): NCBI GI: 66360174 NCBI Desc: chain d, prx d (type ii) from populus tremula
  misc_feature (1)..(230): SWISSPROT Homolog: EC 1.11.1.15 Peroxiredoxin-2E-2, chloroplast precursor
MATTTTTATASLTTLSPAGVGKRFVLSSPPLSFSSHRLTAGLRHRHRGGAASRTARRRAASASPVVATIAVGDKLPDATLSYFDPSDGELKTVTVAELTAGKKAILFAVPGAFTPTCSQKHLPGFVEKAGELKAKGVETVACVSVNDAFVMKAWKEALGLGEDVTLLSDGNLELTRALGVEMDLSDKPVGLGVRSRRYALLAEDGVVKVLNLEDGGAFTTSSAEEMLKVLG

SEQ ID NO: 10219 - DNA, 2715 bp, Sorghum bicolor
  misc_feature: Ceres ANNOT ID no. 6111644
  misc_feature: Encodes the peptide sequence at SEQ ID NO 10220
atggttgctgcactgtctgagagttttgagtcattgtataaggcagaggtacaagaccttgttgagaaatttgacaaatatctaagcaatgaaaatggtaactcagaaatccaccaggagctacaagatgctctcacgacagcaaacaataagctgcccaaagcaccatgggaggatggtgtctgcaaagtctgtggaatcgatcgagatgacgagagcgtccttctttgtgatacttgtgactctgaataccacacttattgcctgaacccgccactggcacgcataccacttggaaactggtattgcccgtcatgtactgcccaaactcatgtttcagtgcaagaacaaaagaagtgccttggggaggaagctcatgtttttatcgagaaactcaacaagttagctgttgcgatggatgagaaagagtactgggagcttagcgtagccgagagaatatatttgctaaaatttctatgtgacgaattgcacaacacagctctcatcagggaacatctagatcagtgttcagacaggtcaaatgatctccagcagaaattacgtcatctgaattatgaactgaaagagttgaagtatcgggtagaaacaaaaacttcgtatgctacacaaagtagatggatgaaaaatgaccaaataggcaatagttcaggacttgtggagaatcagcagcgtgctatgcccacagcatcagagcatcttgaagaggctgaacaggttaatgttggagttaacctcagcaaccctgctgaaggggttcctgctgggcaattgaatgtgggtaaaccttgcagtactgacaatggcatatccagcacatctgtcattgaaggaagtaaatctttgggactttcaaaacaaccatcagagatagttactgaccggactgatcgggactctattggtgaaggatccaaaaggtttgagaaatcattaggtggcaaaagtggtacttgtgataacttgaatgtgggagagactcattctgctacagttatcattgcaccaattggagatttgcctgatgaaaatgctagggcatcgtcccaagacaatatggaaacatcgacatctaaattggttgaccatgatgctgataacaatgaatcaaataatttattggagaggatttcacagttgcaggattcaattagcacagtagaatcacagctgagtatggcatccttgagaagagactgcctgggtagggattctgttggtcgattgtattgggttacaggaagacctagtaagcgtcctcgtcttgttgcagatggaagcatgctgatacccaaggacagagacattagcatggttacaagccattctcagtcaacatttgataaaggatggaattcggcatcgcttgttatgtatgaatctgatgaagaaatcaagtctcttgttgactggctaagagacattgatccaagggagaaggacctgaaagactctatcttgcactggcaaaagtctctttatcaccaggctagttttcccatcactgatcctccagtgtccaagtcttcaaagagtgaaccacctatggaacttccaaacacaaaggcttttatagttttggagcaaaagtatggtccgcaattggatcaggacactagtgagctatccaaaaggagaggaagtaagtcaaagtcgggttctgaagaaagagtatatcgctgtgactgtttagagcctctgttgccttttcgacaccattgcttaaattgtcatgaaacatacctcacattgacggaatatgaagggcataatggtgtaaaatgcaacagcagtaacgactgtcctactgaaagtaaagaaaatgatgagccaaaactgaagggtaccaaagatcctgtagatcataattgttccattgaaccatctaacagtggaaaattggagtcatgcccttatgactttgaagaaatttgtagaaaatttatcacaaatgattcaaacaaggagacggtgaaggagattgggctacttggatcaaatggaattccatcttttgtgccttcacctgcatatttccttgacccgccagctctgctaaatgaaaataaaagaaatgacgataaaccaaatgattggacttcctcattggaggaatgccaagctatgtctgccaaaatgtctgggccggagggatcccaagttggtcaagatttttctggcaatgcaggtgatgggcagatgccaaaatctaagaagcctgttagggatggtacttcagccaaggaagcaccttcaacagacaaaccaacaagattgctaactgttaatgggggcttggttccagagtcatcactgatgcctgtgataggcaggaattttcatatcctgaagcagctaaagataaacttgcttgatgtagaagcagctttgcctgaggaagcattcagagcctccaagtctcagcaaataagaagacgttcatggcgtgcttttgtgaaggatgcagaattagtatcatatagcatgataaaagccgaattcctgaagaaagattggtggtactggtcctccttcactgcagctatcaagacaacaaccgtatcgtcgcttgcgctcaggatctacaccctcgacgattgcatcatgtacacaaaggatccttctctaaaccccgagccagctgacaatgcaaggtctggaaacaaggggaagaggaagaaagatgcggattcatga

SEQ ID NO: 10220 - protein, 904 aa, Sorghum bicolor
  misc_feature: Ceres ANNOT ID no. 6111644
  misc_feature (61)..(109): Pfam Id: PHD Pfam Desc: PHD-finger
  misc_feature (1)..(904): NCBI GI: 50726413 NCBI Desc: phd finger-like protein [oryza sativa (japonica cultivar-group)]
  misc_feature (58)..(143): NCBI GI: 76155653 NCBI Desc: sjchgc07786 protein [schistosoma japonicum]
  misc_feature (50)..(106): NCBI GI: 46226407 NCBI Desc: 2x phd domain containing protein [cryptosporidium parvum]
  misc_feature (50)..(106): NCBI GI: 67590829 NCBI Desc: kiaa1453 protein [cryptosporidium hominis]
  misc_feature (50)..(106): NCBI GI: 54656232 NCBI Desc: kiaa1453 protein [cryptosporidium hominis]
MVAALSESFESLYKAEVQDLVEKFDKYLSNENGNSEIHQELQDALTTANNKLPKAPWEDGVCKVCGIDRDDESVLLCDTCDSEYHTYCLNPPLARIPLGNWYCPSCTAQTHVSVQEQKKCLGEEAHVFIEKLNKLAVAMDEKEYWELSVAERIYLLKFLCDELHNTALIREHLDQCSDRSNDLQQKLRHLNYELKELKYRVETKTSYATQSRWMKNDQIGNSSGLVENQQRAMPTASEHLEEAEQVNVGVNLSNPAEGVPAGQLNVGKPCSTDNGISSTSVIEGSKSLGLSKQPSEIVTDRTDRDSIGEGSKRFEKSLGGKSGTCDNLNVGETHSATVIIAPIGDLPDENARASSQDNMETSTSKLVDHDADNNESNNLLERISQLQDSISTVESQLSMASLRRDCLGRDSVGRLYWVTGRPSKRPRLVADGSMLIPKDRDISMVTSHSQSTFDKGWNSASLVMYESDEEIKSLVDWLRDIDPREKDLKDSILHWQKSLYHQASFPITDPPVSKSSKSEPPMELPNTKAFIVLEQKYGPQLDQDTSELSKRRGSKSKSGSEERVYRCDCLEPLLPFRHHCLNCHETYLTLTEYEGHNGVKCNSSNDCPTESKENDEPKLKGTKDPVDHNCSIEPSNSGKLESCPYDFEEICRKFITNDSNKETVKEIGLLGSNGIPSFVPSPAYFLDPPALLNENKRNDDKPNDWTSSLEECQAMSAKMSGPEGSQVGQDFSGNAGDGQMPKSKKPVRDGTSAKEAPSTDKPTRLLTVNGGLVPESSLMPVIGRNFHILKQLKINLLDVEAALPEEAFRASKSQQIRRRSWRAFVKDAELVSYSMIKAEFLKKDWWYWSSFTAAIKTTTVSSLALRIYTLDDCIMYTKDPSLNPEPADNARSGNKGKRKKDADS

SEQ ID NO: 10221 - DNA, 798 bp, Sorghum bicolor
  misc_feature: Ceres ANNOT ID no. 6111646
  misc_feature: Encodes the peptide sequence at SEQ ID NO 10222
atggatcggccgccgcatctcgtcatcgacctcaacgaggccccgtcgccgccgccgagcgacaccccaccggcgcaggccccgtcgccgccgcgggagttggctccgccggtccaagccccgccgccgccgccgcagcagcagcttcctcctctgctgccgccgcagccgcagccgcagccgcccctgggtgcgcccaaccaacaggcgcggctccagcaggaggctctcgagggggtgcttcgggtccaccgccccctcgagctgaggaatactccctttgggcccgtagggaacgtgcccgcgggcttgttccctggtctggggctgccgctgctcccgctgccgccgccggcgcctcacccgggggaggcgggttggggcaacccggtgcccccctgctcgtcctgcggcctcccggagattctggggggaaccttggtctgcgacgcgtgtgagagggggttccatcccagctgcgtccgcgtctggccgcctctccttcccccgcccccgccacccgggccccctggcgcgcggcggccccgtgccgcggccaacgaggactggatctgccctgaatgcgagaggcgtggcgctcgctccacccgctggaaacttggtgcagttcagcttgacatcaacgctgctccgcccgaggaccccgtcgcagtcatcaccaacgacatccgcaggcagttgctcgagctctttttaattatttctattattgattatattgatagtatattattggccatcgaactccttattcttagaggctatgagtctgagtaa

SEQ ID NO: 10222 - protein, 265 aa, Sorghum bicolor
  misc_feature: Ceres ANNOT ID no. 6111646
  misc_feature (133)..(198): Pfam Id: PHD Pfam Desc: PHD-finger
  misc_feature (4)..(182): NCBI GI: 119627579 NCBI Desc: hcg1793893 [homo sapiens]
  misc_feature (4)..(185): NCBI GI: 60678627 NCBI Desc: plus agglutinin [chlamydomonas incerta]
  misc_feature (14)..(187): NCBI GI: 12018147 NCBI Desc: vegetative cell wall protein gp1 [chlamydomonas reinhardtii]
  misc_feature (15)..(185): NCBI GI: 15145795 NCBI Desc: basic proline-rich protein [sus scrofa]
  misc_feature (14)..(187): NCBI GI: 117606933 NCBI Desc: vegetative cell wall protein [chlamydomonas incerta]
MDRPPHLVIDLNEAPSPPPSDTPPAQAPSPPRELAPPVQAPPPPPQQQLPPLLPPQPQPQPPLGAPNQQARLQQEALEGVLRVHRPLELRNTPFGPVGNVPAGLFPGLGLPLLPLPPPAPHPGEAGWGNPVPPCSSCGLPEILGGTLVCDACERGFHPSCVRVWPPLLPPPPPPGPPGARRPRAAANEDWICPECERRGARSTRWKLGAVQLDINAAPPEDPVAVITNDIRRQLLELFLIISIIDYIDSILLAIELLILRGYESE

SEQ ID NO: 10223 - DNA, 1542 bp, Sorghum bicolor
  misc_feature: Ceres ANNOT ID no. 6111662
  misc_feature: Encodes the peptide sequence at SEQ ID NO 10224
atggtggaggcgccggcgccggcggatctgagcgcggcggcgcaggtgcccgcgctgccgctgcaggtggatctcctgcagctgccgccggaggtgccggccccgggtgcccccgcgctgcgcggcgtcctcgaccgcctcttcgcgcactggctctcgctcccggacaccgccgcgctgctcgccagcctcgtgcacaaggccaaggccagcggcggcggtggcgccgcggccgcgatgctgccctccatgatgctgcaggggggagccgccgtgccgccgctctcaccgaggtccccgcgcctctcgcggaggcccagcagcctcggcgccggccagcccaaccgctccgcgtcgccgctccgcccgccagccgcgcgccccgccaaggaggtcataccgcagttttattttcaagatggacggccaccgccgtacgaggtgaagaagcaatgcatatcgacagttgatcagctcttcgccggccactcaaatggtcttcgggctccagaatttcggatggttaccagggaactctgcaaactaccgacattctttaccactgttatcttcgataagatagacaaggagagcacgggattcgtgacaagggatgccttcattgatttctgggtgaatagcaatttgatgagtatggatagtgcaacccaagtgttcacaattctgaagcaacagaaccgcaattacctcacaaagactgagactgtcgtatatagaatattctattccttgaatcgaattgggagtggacatctgacactcagggagctgaagcgtggaaatctactcaatgcactcaggcatgctgatgatgaagaggatatcaataaagttttaaggtatttttcatatgagcatttctatgtgatatattgcaagttctgggagctggacacagaccacgacttctttattgacaaagaaaatcttattaagtatggaaatcatgcactgacatataggattgtagatagaattttttcagaggttcctaggaaatttacaagtaaggttgaagggaaaatgggctatgaagatttcgtccattttatattgtctgaagaggacaaatcatcagcgccaagccaagaatattggttcaaatgtatagatttggatggcaatggcatacttacacacattgaactacagttcttttttgaggagcaacttcatcgcatggagtgcatggcccaggaacctgttctatttgaggacatcttgtgtcagctcattgatatgattggacctgagaatgataaatatttgacattgaaagacttccgaaggtgcaaactgtctgggcatttcttcaacattctctttaatctgaacaaatttatggcatttgaagctagggatccattcctcatccgccaaatgcgtgaagagccatcattaacagactgggatcgttttgcacgaagagagtatgtaagattggcgatggaagaagatggtgaagatgcttccaatgcaagtggagatgtttgggatgagtcacttgaatctcctttctag

SEQ ID NO: 10224 - protein, 513 aa, Sorghum bicolor
  misc_feature: Ceres ANNOT ID no. 6111662
  misc_feature (72)..(513): NCBI GI: 115444759 NCBI Desc: os02g0191700 [oryza sativa (japonica cultivar-group)]
  misc_feature (187)..(513): NCBI GI: 42740922 NCBI Desc: protein phosphatase 2a beta [arabidopsis thaliana]
  misc_feature (241)..(513): NCBI GI: 4585988 NCBI Desc: similar to phosphoprotein phosphatase 2a regulatory subunit [arabidopsis thaliana]
  misc_feature (241)..(513): NCBI GI: 4204293 NCBI Desc: highly similar to protein phosphatase 2a regulatory subunit [arabidopsis thaliana]
  misc_feature (241)..(513): NCBI GI: 42571333 NCBI Desc: calcium-binding ef hand family protein [arabidopsis thaliana]
MVEAPAPADLSAAAQVPALPLQVDLLQLPPEVPAPGAPALRGVLDRLFAHWLSLPDTAALLASLVHKAKASGGGGAAAAMLPSMMLQGGAAVPPLSPRSPRLSRRPSSLGAGQPNRSASPLRPPAARPAKEVIPQFYFQDGRPPPYEVKKQCISTVDQLFAGHSNGLRAPEFRMVTRELCKLPTFFTTVIFDKIDKESTGFVTRDAFIDFWVNSNLMSMDSATQVFTILKQQNRNYLTKTETVVYRIFYSLNRIGSGHLTLRELKRGNLLNALRHADDEEDINKVLRYFSYEHFYVIYCKFWELDTDHDFFIDKENLIKYGNHALTYRIVDRIFSEVPRKFTSKVEGKMGYEDFVHFILSEEDKSSAPSQEYWFKCIDLDGNGILTHIELQFFFEEQLHRMECMAQEPVLFEDILCQLIDMIGPENDKYLTLKDFRRCKLSGHFFNILFNLNKFMAFEARDPFLIRQMREEPSLTDWDRFARREYVRLAMEEDGEDASNASGDVWDESLESPF

SEQ ID NO: 10225 - DNA, 534 bp, Sorghum bicolor
  misc_feature: Ceres ANNOT ID no. 6111664
  misc_feature: Encodes the peptide sequence at SEQ ID NO 10226
atgcagcaaaactgtgcagccaatttagcatgcctccctggcttcgacttggccagccttttcctaccacagattcagaatgatcctatctatgatttcagctcgttcgacatggtcgatctcgatccatacccatacacatacagctgcaatggcagcgtcgccaccaccgtgagctcggtttctgccgcggcggcggcggcggacgaccaccaggagaggcgtggcaacgacgagaggaagaagagacggctagcgtcgaaccgtgagtccgcgcggaggtcgcgcgtgaggaagcagaggcgcctggacgagctctcattgcaggtcgccgagctcctgggcaccaaccacaggcttcttgttgagctcaaccacgtgatcgccaagcatgctgccgtggttcgtgagaacgccaagctcagagacgaagctgctggcctgcagagaaagctcagcgagatggaagtgggaggagtgggagaagctgaagctggagctggagctggagcagggacacctgagatggcttag

SEQ ID NO: 10226 - protein, 177 aa, Sorghum bicolor
  misc_feature: Ceres ANNOT ID no. 6111664
  misc_feature (76)..(139): Pfam Id: bZIP_1 Pfam Desc: bZIP transcription factor
  misc_feature (76)..(133): Pfam Id: bZIP_2 Pfam Desc: Basic region leucine zipper
  misc_feature (59)..(158): NCBI GI: 113367166 NCBI Desc: bzip transcription factor bzip35 [glycine max]
  misc_feature (60)..(158): NCBI GI: 13430400 NCBI Desc: bzip transcription factor [phaseolus vulgaris]
  misc_feature (60)..(158): NCBI GI: 12829956 NCBI Desc: bzip [phaseolus acutifolius]
  misc_feature (44)..(157): NCBI GI: 92889024 NCBI Desc: camp response element binding (creb) protein [medicago truncatula]
  misc_feature (55)..(157): NCBI GI: 113367190 NCBI Desc: bzip transcription factor bzip73b [glycine max]
  misc_feature: The sequence is a functional homolog of SEQ ID NO 1342 in the 10/374,780US patent application
  misc_feature: The sequence is a functional homolog of SEQ ID NO 1343 in the 10/374,780US patent application
  misc_feature: Useful for making plants with modulated growth and phenotype characteristics
  misc_feature: The sequence is a functional homolog of SEQ ID NO 1342 in the 20060162006 US patent application
  misc_feature: The sequence is a functional homolog of SEQ ID NO 1343 in the 20060162006 US patent application
MQQNCAANLACLPGFDLASLFLPQIQNDPIYDFSSFDMVDLDPYPYTYSCNGSVATTVSSVSAAAAAADDHQERRGNDERKKRRLASNRESARRSRVRKQRRLDELSLQVAELLGTNHRLLVELNHVIAKHAAVVRENAKLRDEAAGLQRKLSEMEVGGVGEAEAGAGAGAGTPEMA

SEQ ID NO: 10227 - DNA, 1131 bp, Sorghum bicolor
  misc_feature: Ceres ANNOT ID no. 6111665
  misc_feature: Encodes the peptide sequence at SEQ ID NO 10228
atggcgggtttcaccggcgacgaccccttcggcttcgactacgacttcggggacgacggcgacaacggcccgttctgctacgacccattcgaagactacggtgtcggtggggacgaaggcgaggggctaatcggcggccccttcgcgctcgactacggagacggcggggagtactgcatctcaggtttcgccttacgcgacggcgatgaagacgacggaggccacgtcctcgtgggagaggaacaggggcaggcgcgcctgtcctcccacgacgaacccattctcgaaaccctaggccgctcattcgactccgacggaggcctcagccaattctacccccaccttgtttccgcattggaactcgtcgaggatacctccgaggaggaggaggaggaggcgatgatctccggaaatgcccggggcggtggagggtctgaattcgagcggggggcggtcgttgaggagcctgccgacgacgacgacggtgggatcgggctcgtgcttggccgcctgggcgggttgaccctcgatccgcggccggtcgttggtggcttcgagggcctggtggacgccgttgaggaggccaccagcgaggacgacatgggcgaggtgggtcatgtgggtgggctcatgctcagcgggttcgacctcgtcgcgccacaggccgtcacgcggcccttccggatggtggtgggtggcgaggacaccgactctgacgacgccgactggaacctcgtcgatgtgctcgcggggcgcgtcggggaggctgcacggcggctgccggcatcccgtgcggtggtggacggcttaccggaggttgcgctcagcgatgaggaggcctcgcacggctgcgctgtgtgcaaggatggcattgctgcggggcagagtgtcctcaggctcccctgcaggcactacttccatggagagtgcatccgcccgtggcttgccatcaggaacacttgccctgtgtgccgatttgagctcccaacgggtgatgctgatcatgattggcgacggagcaggactggtgtggtgtctgtggcgcaacagagcgcaccagcgcaggcagacttttctacagtgcgtcttgtaattgaaagggggtttgaaggaacgggtgacaatttctag

SEQ ID NO: 10228 - protein, 376 aa, Sorghum bicolor
  misc_feature: Ceres ANNOT ID no. 6111665
  misc_feature (284)..(324): Pfam Id: zf-C3HC4 Pfam Desc: Zinc finger, C3HC4 type (RING finger)
  misc_feature (247)..(355): NCBI GI: 115469064 NCBI Desc: os06g0633500 [oryza sativa (japonica cultivar-group)]
  misc_feature (232)..(341): NCBI GI: 46390610 NCBI Desc: zinc finger -like [oryza sativa (japonica cultivar-group)]
  misc_feature (241)..(341): NCBI GI: 42408255 NCBI Desc: zinc finger protein family-like [oryza sativa (japonica cultivar-group)]
  misc_feature (247)..(336): NCBI GI: 4651204 NCBI Desc: ring finger protein [cicer arietinum]
  misc_feature (244)..(362): NCBI GI: 61211690 NCBI Desc: ubiquitin ligase protein cip8 (cop1-interacting protein 8)
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MAGFTGDDPFGFDYDFGDDGDNGPFCYDPFEDYGVGGDEGEGLIGGPFALDYGDGGEYCISGFALRDGDEDDGGHVLVGEEQGQARLSSHDEPILETLGRSFDSDGGLSQFYPHLVSALELVEDTSEEEEEEAMISGNARGGGGSEFERGAVVEEPADDDDGGIGLVLGRLGGLTLDPRPVVGGFEGLVDAVEEATSEDDMGEVGHVGGLMLSGFDLVAPQAVTRPFRMVVGGEDTDSDDADWNLVDVLAGRVGEAARRLPASRAVVDGLPEVALSDEEASHGCAVCKDGIAAGQSVLRLPCRHYFHGECIRPWLAIRNTCPVCRFELPTGDADHDWRRSRTGVVSVAQQSAPAQADFSTVRLVIERGFEGTGDNF

SEQ ID NO: 10229 - DNA, 1230 bp, Sorghum bicolor
  misc_feature: Ceres ANNOT ID no. 6111669
  misc_feature: Encodes the peptide sequence at SEQ ID NO 10230
atgggcgccgtcacctcgacggtcgcggcgcgcttcgccttcttcccgccgagcccgccgtcgtacggggtggagctgccgcagccgccacaaccgccggcgccggccccggcctctgccgcccccgagccggcgccgaaggcgggagaggagaagggcggaggaggcgcggtggtggagctgacgggcgtcccgcggaggggcaacgtggaggcgcgggcgctgcggacgaagcggggcacggaggtggtcgcgatgcacgtgcgccaggcgggggccaagctcacgctgctctactcccacggcaacgccgccgacctcggccagatgtacgagctcttcgtcgagctcagcgcccacctcaacgtcaacctcatgggctatgactattctggttatgggcaatccactgggaagcctagtgaacaaaacacttatgctgacatagaagctgtatacagatgcctcatagaaacctatggagctgctgaggataatatcattctttatggtcaatcagtgggcagtggtcctactttggatttagcatcccgattaactcgtttgagagcggttgttctacatagcccaattttgtctggattaagagttatgtatcctgtaaaacatacatactggtttgacatatacaagaacatcgacaaaattccattagtcaggtgtcccgtgctagtgatacatggtacagctgatgaggttgttgactgttcccacgggcggtcactgtgggagctcgcggaagtgaagtacgagccgctgtggatcaaaggcggaaaccactgcaacctagaactgtacccggaatacatcaaacacctgaagaagtttgtcggagccatagagagatcgccacccccacctccaatcgatgagtccacagagagttcaggcccgtcgggccgcaccgtgacgacggagcccgaatgtaattcatcggaggactcatcaaggaagagcacggactgcagggacaaaacacggccgagcatcgaccagagacacagcacggaccggcgggagaagccgaggggcagcacggataggcgggacaagacgaggaagagcgtggaccatcccgacaagccgcgggctagcgtcgatcagtcggatcggccgaggaaaagcatcgaccggtttggaggcatgatgaagtcggtgaggctgtgcaatatcgactgcttcaaagtgacagcaacctctgggagctga

SEQ ID NO: 10230 - protein, 409 aa, Sorghum bicolor
  misc_feature: Ceres ANNOT ID no. 6111669
  misc_feature (29)..(409): NCBI GI: 51535771 NCBI Desc: cgi67 serine protease-like [oryza sativa (japonica cultivar-group)]
  misc_feature (1)..(380): NCBI GI: 124359459 NCBI Desc: esterase/lipase/thioesterase [medicago truncatula]
  misc_feature (1)..(361): NCBI GI: 56784467 NCBI Desc: cgi67 serine protease-like [oryza sativa (japonica cultivar-group)]
  misc_feature (1)..(361): NCBI GI: 115439289 NCBI Desc: os01g0689800 [oryza sativa (japonica cultivar-group)]
  misc_feature (42)..(289): NCBI GI: 140067578 NCBI Desc: c2; esterase/lipase/thioesterase [medicago truncatula]
MGAVTSTVAARFAFFPPSPPSYGVELPQPPQPPAPAPASAAPEPAPKAGEEKGGGGAVVELTGVPRRGNVEARALRTKRGTEVVAMHVRQAGAKLTLLYSHGNAADLGQMYELFVELSAHLNVNLMGYDYSGYGQSTGKPSEQNTYADIEAVYRCLIETYGAAEDNIILYGQSVGSGPTLDLASRLTRLRAVVLHSPILSGLRVMYPVKHTYWFDIYKNIDKIPLVRCPVLVIHGTADEVVDCSHGRSLWELAEVKYEPLWIKGGNHCNLELYPEYIKHLKKFVGAIERSPPPPPIDESTESSGPSGRTVTTEPECNSSEDSSRKSTDCRDKTRPSIDQRHSTDRREKPRGSTDRRDKTRKSVDHPDKPRASVDQSDRPRKSIDRFGGMMKSVRLCNIDCFKVTATSGS

SEQ ID NO: 10231 - DNA, 1479 bp, Sorghum bicolor
  misc_feature: Ceres ANNOT ID no. 6111671
  misc_feature: Encodes the peptide sequence at SEQ ID NO 10232
atggccgccaccgcgctcgaattcctccgcacccaccaccagccctgcaagccgccgccgccgcccgtgccgcgcgcatccgtactctgccgcgccgcggcggggacggcggggccggcgtcggcggcggcgctgcggtccctggccccgcccacgcggccggagctgctgtccctcgacctgccccgctacgacccggcgcgcgcccgccccgtggacctcgccgtggtgggcggcgggcccgcgggcctcgccgtggcgcagcgcgtggcggaggcgggcctgtcggtgtgcgccatcgacccgtcacccgcggtggtgtggcccaacaactacggcgtgtgggtggacgagttcgaggccatgggcctctcccactgcctcgacaccgtctggccctccgcctccgtcttcatcggcgacggccgcgccaagtcgctcgaccgcccctacgcccgcgtcgcgcgccgcaagctcaagtccaccatgatggaccgctgcgtcgccaacggcgtcgtcttccaccaggccaaggtcgccaaggccgtccactacgacgcctcctccctcctcatctgcgacgacggcgtcgccgtcccggccagcgtcgtgctcgacgccacgggcttctcgcgctgcctcgtgcagtacgacaagccgtacaacccggggtaccaggtcgcctacggcatcctcgccgaggtggacggccacccgttcgacatcgacaagatgctcttcatggactggcgcgactcccacctccccgaggggacggagatcagggagcgcaaccgccgcatccccacgttcctctacgccatgcccttctcccccaccaggatcttcctcgaggagacgtccctggtcgcgcgcccggggctcgccatggacgacatccaggagcgcatggccgcgcgcctcaggcacctggggatacgcgtccggagcgtcgaggaggacgagcgctgcgtcatcccgatgggagggccgctgcccgtcctgccgcagagggtggtcggcatcggcggcacggccgggatggtgcacccgtcaacgggctacatggtggcgcgcacgcttgccaccgcgcccatcgtggcggacgccatcgtgaggttcctcgacaccggcaacggcatgggcggcctggcaggggacgcgctctccgccgaggtgtggaagcagctgtggccagccaacaggcggcggcagagggagttcttctgcttcggcatggacatcctgctcaagctggacctcgagggaacgcgccggttcttcgacgccttcttcgacctggagccgcactactggcacggtttcctgtcatccagactgttcctgccggagctcttgatgttcggcctcgcactgttcgggaacgcctccaacacgtcgaggctggagatcatggccaagggcaccgtgcctcttggcaagatgattggcaacttgatacaggacagagatgggtga

SEQ ID NO: 10232 - protein, 492 aa, Sorghum bicolor
  misc_feature: Ceres ANNOT ID no. 6111671
  misc_feature (73)..(469): Pfam Id: Lycopene_cycl Pfam Desc: Lycopene cyclase protein
  misc_feature (73)..(360): Pfam Id: DAO Pfam Desc: FAD dependent oxidoreductase
  misc_feature (1)..(492): NCBI GI: 27728515 NCBI Desc: lycopene beta-cyclase [zea mays]
  misc_feature (1)..(491): NCBI GI: 115444743 NCBI Desc: os02g0190600 [oryza sativa (japonica cultivar-group)]
  misc_feature (40)..(491): NCBI GI: 90186657 NCBI Desc: lycopene beta-cyclase [carica papaya]
  misc_feature (19)..(491): NCBI GI: 735882 NCBI Desc: lycopene cyclase
  misc_feature (40)..(491): NCBI GI: 19569782 NCBI Desc: beta-lycopene cyclase [sandersonia aurantiaca]
  misc_feature (48)..(486): SWISSPROT Homolog: EC 5.3.99.8 Capsanthin/capsorubin synthase, chromoplast precursor
MAATALEFLRTHHQPCKPPPPPVPRASVLCRAAAGTAGPASAAALRSLAPPTRPELLSLDLPRYDPARARPVDLAVVGGGPAGLAVAQRVAEAGLSVCAIDPSPAVVWPNNYGVWVDEFEAMGLSHCLDTVWPSASVFIGDGRAKSLDRPYARVARRKLKSTMMDRCVANGVVFHQAKVAKAVHYDASSLLICDDGVAVPASVVLDATGFSRCLVQYDKPYNPGYQVAYGILAEVDGHPFDIDKMLFMDWRDSHLPEGTEIRERNRRIPTFLYAMPFSPTRIFLEETSLVARPGLAMDDIQERMAARLRHLGIRVRSVEEDERCVIPMGGPLPVLPQRVVGIGGTAGMVHPSTGYMVARTLATAPIVADAIVRFLDTGNGMGGLAGDALSAEVWKQLWPANRRRQREFFCFGMDILLKLDLEGTRRFFDAFFDLEPHYWHGFLSSRLFLPELLMFGLALFGNASNTSRLEIMAKGTVPLGKMIGNLIQDRDG

SEQ ID NO: 10233 - DNA, 3714 bp, Sorghum bicolor
  misc_feature: Ceres ANNOT ID no. 6111678
  misc_feature: Encodes the peptide sequence at SEQ ID NO 10234
atggcgaagacagcgccggttctgaggtcattcgcgctgttgttcatgcacgcagacgcggtggacgtggcgctgatggcgctgggcctgctgggcgccatcggcgacggcatgtccatgccggtaatgctaactatcatgagccacgtcttcaacgatgcaggcagcggccctgatcgcctccagcagttcagctccaagatgaatcagaacgcgaggaataccctcttcctggctgccgcatgctttgtcatggcgttcctagaggggtactgctggacgcggacggcggagcggcaggcgtcgcggatgcggctgcgttaccttcgggcggtgctccggcaggacgtggagtacttcgacctcaaggccggctgcacgtcgccggaggtggtcaccggcatctccaacgacagcctggtggtgcaggacgcgctgagcgagaagctgcccaacttcgtggtgagcgtcaccacgttcgtgggcagctacgccgtcgggttcgcgctgcagtggcggctcacggtggtggcgctgccgtccgtgctgctgctcgtcatccccggcttgctctacagccgagtccagctcggcctggcgcgccggatcagggagcagtacaggcgcccgagcgccatcgccgagcaggcgatctcgtcggtgcgcaccgtgtactcgttcgtcgcggagaggagcaccgcggcgcggttctccgccgcgctggaggagctggtaccgctcggcctgaagcaggggctcgccaagggcgtcgccgtcggcagcaacggcatcacctatgccatcttcgccttcaacatttggtacggcagccggctcatcatgcaccacggctacaggggcggcaccgtctacatcgcctctgtcgtcactgtacacggaggcgtagcgctagggtcggcactgtcgaacatcaagtacttctcggaggcaagcgcggcggcggagaggatcacggagctgatcaagcgagtgcccaagatagactcggagagtggcgccggcgacgtgctggagaacgtcaccggcgaggtggagttcaggaacgtggatttctgctacccttcgcggccggagacccctatcttcgtcaacttcagcctgcatgtgccggccgggcgatcggtggcgctggtgggcgccagtgggtcagggaagtcgacggtgatcgcgctgctggagcggttctacgacccgtcggccggagaggtgaccctggacggtgtcgacatccggcgactgcggctcaagtggctgcgcgcgcagatggggctcgtcagccaggagccggcgctgttcgcgacgtcgatcagggagaacatactgttcggcaaggaggacgccacggaggaggagatcgtagctgcggcgatggcggccgacgcccacaacttcatctcgacgttgccgcagggctacgacacgcaggtgggtgagcgtggtatccaaatgtctggaggacagaagcaaaggattgctattgccagagcaatcctaagatcgcctaagatccttcttcttgatgaagccactagtgcactagacacgaattcagaacgtgttgtgcatgaggcacttgagttagcctccatgggacgaactactattgttgtcgcacatcgtctctccactgttcgaaatgccaatattattgttgtcatgcaggctggtgaggttaaagaattgggatcacatggtgatctcatcgccaacgagaatggcctctattcatctcttgtccaccttcagcagaccagagattcaatagacaccaataaggttggtggaactacaagccaaattatgagcagggctttcactacagctagtaggacaagatcaacatggtcaatttgtgatacaaaacatgatgacaacaaagataattcaaatattcctgttccatccttcatgacaatgcttatgcttaatgcgccagagtggaagcaagcgttgataggaagcttcagtgcaattgtgattggaggcatacaaccaatatttgcatattccattggaagcatgatgtttgtctacttttcaactaatcatgaagagatcaaggagaaaacaagggcttttgcacttatttccatcagccttgcagttatttcattcttaactagtattgggcaacattataactttgctgccatgggggaattcctaaccaagagggttagagaacaaatgtttgcaaaatttctcactttcgagattgggtggtttgactgtgataagaactctactggttccatatgctcacaacttaccagagactccaacaatgtgaggtcactcctgggtgatcgaatgtctctggtcatccagacagtttctgcggttgtaactacctacttgatgggtctggttatagcttggcgtatggccctcgtcatgatagcattacaaccccttaccattgtttgcttttatgcccgccgtgtcttactgaagagcatgtccaagaaatcaaaaaatgcacaacataaatgtagtaagctagcttctgaggctatctctaatcttcggaccataactgctttctcatcccagaaccatgtcttgtgcctcttcgaccaagcacaagatggtccacgcaaggaaagcatccgacagtcctggtttgcaggtatcatccttggcacctctatgggccttttgaaatgcacatgggcactcaccttgtggtatagtggtatgctcatggctaggcactacattacagcaaaggcattcttccaaaccttcttgattctagtaaccacaggacgtgtgattgcagaagcaggtagtgttacaacagatcttgctaagggtgctgatgcagttgcttcagtgtttggcattcttcatcgagaaacaaaaatggatcctgacaaccctgagggttataaaccagagaagctcaaaggtgaggtgcacattagaggagttgattttgtatatccatcaagaccagatgtgatcatcttcaaaggattctccttgagcatccaaccaggcaagtcaacggcacttgttgggaaaagtggttctggaaagtcaactattattggacttatagaaaggttctacgatccaactaatggggtagtagagattgaccttaaagacatcaaaacatacaatcttcgtgccttgcgacaacatattggactggttagccaagagccaacactatttgcaggtaccattagggagaacattgtgtacggcacagaagcagctagtgacgaagaaattgagaatgcagcaaggtcagcaaatgcacatggcttcattagtaacctcaaggatggatatgagacaaggtgtggtgagcaaggtgttcaactgtcaggaggacagaagcagcgcattgcaatcgctcgtgcaatattgaagaaccctactatcttgctattagatgaagctactagtgcattagacaaccagtcggagaaggtggtccaagaggcattggaccggatgttggtcagaaggacaagtgtagtggtggcacacaggttgaccactattcagaactgtgacatgattattgtgcttgataaaggagttgctgtggagacaggcacacatgcatccctcatggccaagggtcctgccggaacatattttggattggttaatttgcagcaaggatgcaacaatttgcatgaaaacacattagttccagatttgcaactctgttga

SEQ ID NO: 10234 - protein, 1237 aa, Sorghum bicolor
  misc_feature: Ceres ANNOT ID no. 6111678
  misc_feature (379)..(563): Pfam Id: ABC_tran Pfam Desc: ABC transporter
  misc_feature (1008)..(1192): Pfam Id: ABC_tran Pfam Desc: ABC transporter
  misc_feature (22)..(304): Pfam Id: ABC_membrane Pfam Desc: ABC transporter transmembrane region
  misc_feature (654)..(933): Pfam Id: ABC_membrane Pfam Desc: ABC transporter transmembrane region
  misc_feature (14)..(1219): NCBI GI: 15229473 NCBI Desc: abc transporter family protein [arabidopsis thaliana]
  misc_feature (10)..(1220): NCBI GI: 9294571 NCBI Desc: multidrug resistance p-glycoprotein; abc transporter-like protein [arabidopsis thaliana]
  misc_feature (76)..(1220): NCBI GI: 15232975 NCBI Desc: abc transporter family protein [arabidopsis thaliana]
  misc_feature (66)..(1215): NCBI GI: 124360622 NCBI Desc: cyclic peptide transporter [medicago truncatula]
  misc_feature (9)..(1220): NCBI GI: 2292907 NCBI Desc: p-glycoprotein homologue [hordeum vulgare subsp. vulgare]
MAKTAPVLRSFALLFMHADAVDVALMALGLLGAIGDGMSMPVMLTIMSHVFNDAGSGPDRLQQFSSKMNQNARNTLFLAAACFVMAFLEGYCWTRTAERQASRMRLRYLRAVLRQDVEYFDLKAGCTSPEVVTGISNDSLVVQDALSEKLPNFVVSVTTFVGSYAVGFALQWRLTVVALPSVLLLVIPGLLYSRVQLGLARRIREQYRRPSAIAEQAISSVRTVYSFVAERSTAARFSAALEELVPLGLKQGLAKGVAVGSNGITYAIFAFNIWYGSRLIMHHGYRGGTVYIASVVTVHGGVALGSALSNIKYFSEASAAAERITELIKRVPKIDSESGAGDVLENVTGEVEFRNVDFCYPSRPETPIFVNFSLHVPAGRSVALVGASGSGKSTVIALLERFYDPSAGEVTLDGVDIRRLRLKWLRAQMGLVSQEPALFATSIRENILFGKEDATEEEIVAAAMAADAHNFISTLPQGYDTQVGERGIQMSGGQKQRIAIARAILRSPKILLLDEATSALDTNSERVVHEALELASMGRTTIVVAHRLSTVRNANIIVVMQAGEVKELGSHGDLIANENGLYSSLVHLQQTRDSIDTNKVGGTTSQIMSRAFTTASRTRSTWSICDTKHDDNKDNSNIPVPSFMTMLMLNAPEWKQALIGSFSAIVIGGIQPIFAYSIGSMMFVYFSTNHEEIKEKTRAFALISISLAVISFLTSIGQHYNFAAMGEFLTKRVREQMFAKFLTFEIGWFDCDKNSTGSICSQLTRDSNNVRSLLGDRMSLVIQTVSAVVTTYLMGLVIAWRMALVMIALQPLTIVCFYARRVLLKSMSKKSKNAQHKCSKLASEAISNLRTITAFSSQNHVLCLFDQAQDGPRKESIRQSWFAGIILGTSMGLLKCTWALTLWYSGMLMARHYITAKAFFQTFLILVTTGRVIAEAGSVTTDLAKGADAVASVFGILHRETKMDPDNPEGYKPEKLKGEVHIRGVDFVYPSRPDVIIFKGFSLSIQPGKSTALVGKSGSGKSTIIGLIERFYDPTNGVVEIDLKDIKTYNLRALRQHIGLVSQEPTLFAGTIRENIVYGTEAASDEEIENAARSANAHGFISNLKDGYETRCGEQGVQLSGGQKQRIAIARAILKNPTILLLDEATSALDNQSEKVVQEALDRMLVRRTSVVVAHRLTTIQNCDMIIVLDKGVAVETGTHASLMAKGPAGTYFGLVNLQQGCNNLHENTLVPDLQLC

SEQ ID NO: 10235 - DNA, 3756 bp, Sorghum bicolor
  misc_feature: Ceres ANNOT ID no. 6111681
  misc_feature: Encodes the peptide sequence at SEQ ID NO 10236
atgttgacgacgaagttcgccttggtgttcaagcacgcagatgcagtggacgtggcgctaatggtggtgggcttagtgggcgccattggcgacggcatgtccacgccggtgatgctggccatcaccagccgcgtcttcgacgacgctggcagcggccctgatcatctccagcagttcgtccccaagatgaatgagaacgtgaggtacaccctctacttggctgccgcacacgggatcacggcgttcctagagggatactgctggacgcggacggcggagcggcaggcaaagcggatgcggctgcgataccttcgggcggtgctccggcaggacgtggagtacttcgacctcaagaccggcggctccacgtcgtcggaggtgatcaccagcgtctccaacgacagcctcgccgtgcaggacgtgctgagcgagaagctgcccaacttcttgacgaacgtcgccgcgttcgtggccagctacgccgtcgcgttcctcctgatgtggcggctcacgctggtggcgctgccatccgtgctgctgctcatcatccccggcttcctctacagccgcgtcctcatcagcctggcgcgccggatcagggagctgcacacgcgcccgggcgccatcgccgagcaggcgatctcgtcggtgcgcaccgtctactcgttcgtcgcggagagatccaccgcggcgcggttcgccgccgcgctggacgagtcggtgcggctcgggctcaagcaggggctcgccaagggcgtcgccctcggcaccggtggcatccgcatcgccatcttggccttcaccgtctggtacggcagccgcctcgtcatgtaccatggctacagaggcggcaccgtctacaacgtcgccctcatcatcgtattcggaggcggagcactggggacggcgctgtcaaacatcaagtacttgtcagaggcgacctcggcggcggagaggatcatggagctgatcaggcgggtgcccaagatagactcagagagtagcgccggcgacgtgctggacaacgtcgccggcgaggtggagttcaggaacgtggagttctgctacccgtcgcgacccaagagccccatcttcgtcaacttcaacctgcacgtgccggccgggcgcacggtggcgctggtcggcgagagtgggtcagggaagtcgacggtgatcgcgctgcttgagcgcttctacgacccgtcggccggggaggtgaccctggacggcgtggacatccggcggctgcggctcaagtggctgcgcgcgcagatggggctcgtcagccaggagccggcgctgttcgcgacgtcgatccgggagaacatcctgctcggcaaggaggacgccacggaggaggaggtcgtcgccgcggcaaacgcggccaacgcccacagcttcatctcgcagttgccgcggggatacgacacgcaggtaggtgagcgtggaatccaaatgtctggagggcagaagcaaaggattgctattgctagagcaatcctaaagtcacccaagatccttctccttgatgaagctactagtgcattagacactaattcagagcatgtggtccaggaggcacttgacctggcctccatgggtcgaactactattatcattgcacatcggctctctaccatacgaaatgctcatttgattgctttcatgaagtctggtgaggttaaggagttgggctcccatgatgacctcattgccaatgagaatggcctttactcaactcttgtccaccttcaacagaccagagatccaactgagactaccgaggtttgtgagactaggaatgcatatgttatgttgcaatcaaacaagcaaagtaggggtttctctacagcaagtaggtcgatcacaacaaggtcaatgggtgatacaaaagacaatggtaacatagagaatccaaagcttcctgtgccatccttcaagaggctactaatgctcaatgcaccagagtggaagcaggggttgttggggagctttagtgcaattgtctctggaggcatacaacctgcgttttgctatatcatgggcagcatgatttcgatctacttctctacagatcatgaagagatcaaggagaaaacaaggacttatgcacttatctccatcggccttgcaatgctcacgttcatggttaatattgggcaacactacaattttgcttccacgggggaatacctcaccaagagggtcagagaacaaatgctcgctaaatatctcactttcgagattgggtggtttgaccaagatgacaactctagtagttccatatgctcacggcttaccactgatgccaacattgtgaggtcgcttgtgggtgatcgaatgtctctagtgatccatacagtttcagctgttctaactgcctacatcatgggtctggtgattgcttggcgtttagcaattttgatgattgcagtgcagccatttagcattatctgctattatactcgctatgtcttattaaagagcatgtctgagaaatcaacacaagcacaagctgaatgtagtaagctagctgctgaggccgtctctaatcttcgaaccataagtgctttctcatcccagaatcgcatcatgtgcctatttgaccaagcacaagaaggcccatgcaaggaaagcataagacagtcctggtttgcaggtattggccttggcacctccacaagccttttgagatgcacatgggcactcaccttctggtatactggcatactcctagatgggcaccacattactgcaaaggcctttttccaaacctttctaattctaataagcacaacattggtgatagcagatgcaggcagtatgacagcagatcttgctaagggtgctgatgcagttgcttcagtgtttgccattcttgacagggaaacgaaaatagatcctgacaaccctgagggatataaaccagaaaagctcaaaggcgaagtggacattagaggagttgattttgcatatccatcaagaccagatgtgatcatctttaagagattctccttgagcatccaaccagctaagtcaacagcacttgttgggcaaagtggttcaggcaaatcaaccatcattgggcttatagagaggttctatgacccaactagtggggtagtagagatcgattgtaaagacatcaaagcatacaatcttcggtccttacgacagcacattgggctagttagccaagagccaacactgtttgcaggtaccattagagagaacattgtgtatggcacagaagcagctagtgaggaagaaattgagaatgcggcaaggtcagcaaatgcacatggcttcattagcaacctcaaggatggatatgagacaaggtgtggtgagcaaggtgttcaattgtctggaggacagaagcagcgcattgcaatcgctcgtgcaatattgaagaaccctgctatcttgctactagatgaagctactagtgcattggacagccagtctgagaatgtggtccaagaggcattggaccgactcatggtcggcaggacaagtatagtggtggcacacaggctgagcactattcaaaactgcaacatgattgttgtgcttgagaaaggagttgttgtggagacaggaacacatgcatccctcatgaccaagggtcctgccggaacatactttggattagttaatttgcagcaaggaggcaaccaggtgaacaacgctatggctttgcaagagaacccatcaattccagatttgcagcctaaaatcaccactttggattaa

SEQ ID NO: 10236 - protein, 1251 aa, Sorghum bicolor
  misc_feature: Ceres ANNOT ID no. 6111681
  misc_feature (375)..(559): Pfam Id: ABC_tran Pfam Desc: ABC transporter
  misc_feature (1011)..(1195): Pfam Id: ABC_tran Pfam Desc: ABC transporter
  misc_feature (17)..(300): Pfam Id: ABC_membrane Pfam Desc: ABC transporter transmembrane region
  misc_feature (660)..(936): Pfam Id: ABC_membrane Pfam Desc: ABC transporter transmembrane region
  misc_feature (9)..(1222): NCBI GI: 15229473 NCBI Desc: abc transporter family protein [arabidopsis thaliana]
  misc_feature (9)..(1223): NCBI GI: 9294571 NCBI Desc: multidrug resistance p-glycoprotein; abc transporter-like protein [arabidopsis thaliana]
  misc_feature (84)..(1218): NCBI GI: 124360622 NCBI Desc: cyclic peptide transporter [medicago truncatula]
  misc_feature (71)..(1223): NCBI GI: 15232975 NCBI Desc: abc transporter family protein [arabidopsis thaliana]
  misc_feature (9)..(1223): NCBI GI: 2292907 NCBI Desc: p-glycoprotein homologue [hordeum vulgare subsp. vulgare]
MLTTKFALVFKHADAVDVALMVVGLVGAIGDGMSTPVMLAITSRVFDDAGSGPDHLQQFVPKMNENVRYTLYLAAAHGITAFLEGYCWTRTAERQAKRMRLRYLRAVLRQDVEYFDLKTGGSTSSEVITSVSNDSLAVQDVLSEKLPNFLTNVAAFVASYAVAFLLMWRLTLVALPSVLLLIIPGFLYSRVLISLARRIRELHTRPGAIAEQAISSVRTVYSFVAERSTAARFAAALDESVRLGLKQGLAKGVALGTGGIRIAILAFTVWYGSRLVMYHGYRGGTVYNVALIIVFGGGALGTALSNIKYLSEATSAAERIMELIRRVPKIDSESSAGDVLDNVAGEVEFRNVEFCYPSRPKSPIFVNFNLHVPAGRTVALVGESGSGKSTVIALLERFYDPSAGEVTLDGVDIRRLRLKWLRAQMGLVSQEPALFATSIRENILLGKEDATEEEVVAAANAANAHSFISQLPRGYDTQVGERGIQMSGGQKQRIAIARAILKSPKILLLDEATSALDTNSEHVVQEALDLASMGRTTIIIAHRLSTIRNAHLIAFMKSGEVKELGSHDDLIANENGLYSTLVHLQQTRDPTETTEVCETRNAYVMLQSNKQSRGFSTASRSITTRSMGDTKDNGNIENPKLPVPSFKRLLMLNAPEWKQGLLGSFSAIVSGGIQPAFCYIMGSMISIYFSTDHEEIKEKTRTYALISIGLAMLTFMVNIGQHYNFASTGEYLTKRVREQMLAKYLTFEIGWFDQDDNSSSSICSRLTTDANIVRSLVGDRMSLVIHTVSAVLTAYIMGLVIAWRLAILMIAVQPFSIICYYTRYVLLKSMSEKSTQAQAECSKLAAEAVSNLRTISAFSSQNRIMCLFDQAQEGPCKESIRQSWFAGIGLGTSTSLLRCTWALTFWYTGILLDGHHITAKAFFQTFLILISTTLVIADAGSMTADLAKGADAVASVFAILDRETKIDPDNPEGYKPEKLKGEVDIRGVDFAYPSRPDVIIFKRFSLSIQPAKSTALVGQSGSGKSTIIGLIERFYDPTSGVVEIDCKDIKAYNLRSLRQHIGLVSQEPTLFAGTIRENIVYGTEAASEEEIENAARSANAHGFISNLKDGYETRCGEQGVQLSGGQKQRIAIARAILKNPAILLLDEATSALDSQSENVVQEALDRLMVGRTSIVVAHRLSTIQNCNMIVVLEKGVVVETGTHASLMTKGPAGTYFGLVNLQQGGNQVNNAMALQENPSIPDLQPKITTLD

SEQ ID NO: 10237 - DNA, 645 bp, Sorghum bicolor
  misc_feature: Ceres ANNOT ID no. 6111686
  misc_feature: Encodes the peptide sequence at SEQ ID NO 10238
atgcggcgcggcggcggcgtggcggcggcggcggaggcggacggtgacgtggagtcacggttccgcggcgtgcggaagcggccgtggggccgctacgccgcggagatccgtgacccggcgaagaaggcccgcgtctggctcggcacattcgactccgccgaggacgccgctcgcgcctacgacgccgctgcgcggatgctgcgcgggcccaaggccaggaccaacttcccgctccccgccgcagccgcccaccaccaccttcacatgcccgccgccgccgccgcagcagcagcgccgtacacgacgtatcccaacgccacgggcgtctcgacgccgccggtcgctaggccggcttgcagcagcctaagctccaccgtggagtccttcggcggcgcgcggccgcggcccgtgctcccgccgcggcctcttccgccgccgatccccgacggcgactgccgcagcgactgcggctcctcggcctcggtcgtcgacgacgactgcacggacgcggcggcctctccgtcgtgcccggtcccgctcccgttcgacctcaaccttccccctggcggcggcggctgcggagccggcgtcgggttgtacgctgatgaggaggatgagctcaggctcacggcgctgcggctgtga

SEQ ID NO: 10238 - protein, 214 aa, Sorghum bicolor
  misc_feature: Ceres ANNOT ID no. 6111686
  misc_feature (19)..(70): Pfam Id: AP2 Pfam Desc: AP2 domain
  misc_feature (1)..(198): NCBI GI: 56384582 NCBI Desc: at-rich element binding factor 2 [pisum sativum]
  misc_feature (1)..(195): NCBI GI: 4587373 NCBI Desc: ethylene responsive element binding factor [nicotiana tabacum]
  misc_feature (1)..(214): NCBI GI: 12322345 NCBI Desc: ethylene responsive element binding factor 3 (erf3) [arabidopsis thaliana]
  misc_feature (4)..(188): NCBI GI: 90399245 NCBI Desc: b0811b10.20 [oryza sativa (indica cultivar-group)]
  misc_feature (4)..(188): NCBI GI: 32488388 NCBI Desc: osjnba0043a12.18 [oryza sativa (japonica cultivar-group)]
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1000 in the 10/412,699US patent application
  misc_feature: The sequence is a functional homolog of SEQ ID NO 124 in the 11/479,226US patent application
  misc_feature: The sequence is a functional homolog of SEQ ID NO 1419 in the 11/479,226US patent application
  misc_feature: The sequence is a functional homolog of SEQ ID NO 243 in the 11/479,226US patent application
  misc_feature: The sequence is a functional homolog of SEQ ID NO 501 in the 10/374,780US patent application
  misc_feature: The sequence is a functional homolog of SEQ ID NO 668 in the 10/412,699US patent application
  misc_feature: Useful for biocontainment applications
  misc_feature: Useful for making plants with altered Lignin content
  misc_feature: Useful for making plants with altered cell wall content and/or composition
  misc_feature: Useful for making plants with altered sterol content
  misc_feature: Useful for making plants with modulated cold sensitivity
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12919
  misc_feature: Functional homolog of the protein sequence given in SEQ ID NO 13218
  misc_feature: Functional homolog of the protein sequence given in SEQ ID NO 13219
  misc_feature: Functional homolog of the protein sequence given in SEQ ID NO 13435
  misc_feature: Functional homolog of the protein sequence given in SEQ ID NO 13439
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 1000 in the 20040045049 US patent application
  misc_feature: The sequence is a functional homolog of SEQ ID NO 668 in the 20040045049 US patent application
  misc_feature: Useful for making plants with altered lignin content
  misc_feature: Functional homolog of the protein sequence given in SEQ ID NO 13219
MRRGGGVAAAAEADGDVESRFRGVRKRPWGRYAAEIRDPAKKARVWLGTFDSAEDAARAYDAAARMLRGPKARTNFPLPAAAAHHHLHMPAAAAAAAAPYTTYPNATGVSTPPVARPACSSLSSTVESFGGARPRPVLPPRPLPPPIPDGDCRSDCGSSASVVDDDCTDAAASPSCPVPLPFDLNLPPGGGGCGAGVGLYADEEDELRLTALRL

SEQ ID NO: 10239 - DNA, 1092 bp, Sorghum bicolor
  misc_feature: Ceres ANNOT ID no. 6111689
  misc_feature: Encodes the peptide sequence at SEQ ID NO 10240
atggcgccgccgacctgccgttccggggccgaagcggcgctgctgctgctgcttctgctgctgacgacgacgagcagcgtcgcgcgggccgcggcgccgcgggtgccggcggtgatcgtgttcggggactcgacggtggacacgggcaacaacaaccagatccccaccccgctgcgcgccgacttcccgccctacggccgcgacatgccgggcgggccgcgcgccaccggccggttcggcaacgggcggctgcccccggacctcatctccgaggcgctcggcctgccgccgctcgtgccggcctaccttgaccgggcctacggcatcgacgacttcgcgcgcggcgtctgcttcgcgtccgcgggcaccggcatcgacaacgccaccgccggagtcctggtattgatcccgctgtggaaggaggtggagtactacgaggagtaccagcgccgtctccgcgcgcgcgtgggttcgtcccgcgccgcggccatcgtccgcggcgcgctccacgtggtgagcatcggcaccaacgacttcctggagaactacttcctgccgctggccacggggcggttcgcgcagttcacgccgcccgagttcgaggacttcctcgtcgccggcgcgcggcagttcctggcgcggatccaccgcctcggcgcgcgcagggtcaccttcgcggggctcgccgccatcggctgcctgccgctcgagcgcaccaccaacgcgctccgcggcggcggctgcgtcgaggagtacaacgacgtggctaggagcttcaacgccaagctgcaggccatggtgcgcggcctgagggacgagttccccaggctcaggctcgcatacatctccgtctacgagaacttcctcgacctcatcacaaacccggaaaagtttgggctggagaacgtggaggaggggtgctgcgcgacaggtaggttcgagatggggttcatgtgcaacgacgacgcgccgctcacctgcgacgacgccagcaagtaccttttctgggacgccttccaccccacggagaaagtgaacaggctcatggccaaccacaccctccaagtgtgctaccaacaaggcgtcctgtaa

SEQ ID NO: 10240 - protein, 363 aa, Sorghum bicolor
  misc_feature: Ceres ANNOT ID no. 6111689
  misc_feature (38)..(353): Pfam Id: Lipase_GDSL Pfam Desc: GDSL-like Lipase/Acylhydrolase
  misc_feature (27)..(360): NCBI GI: 51535564 NCBI Desc: anter-specific proline-rich protein apg precursor-like [oryza sativa (japonica cultivar-group)]
  misc_feature (14)..(356): NCBI GI: 50726533 NCBI Desc: gdsl-motif lipase/hydrolase-like [oryza sativa (japonica cultivar-group)]
  misc_feature (19)..(351): NCBI GI: 115478062 NCBI Desc: os09g0132200 [oryza sativa (japonica cultivar-group)]
  misc_feature (7)..(351): NCBI GI: 48716709 NCBI Desc: lipase sil1-like protein [oryza sativa (japonica cultivar-group)]
  misc_feature (14)..(355): NCBI GI: 140061185 NCBI Desc: lipolytic enzyme, g-d-s-l [medicago truncatula]
MAPPTCRSGAEAALLLLLLLLTTTSSVARAAAPRVPAVIVFGDSTVDTGNNNQIPTPLRADFPPYGRDMPGGPRATGRFGNGRLPPDLISEALGLPPLVPAYLDRAYGIDDFARGVCFASAGTGIDNATAGVLVLIPLWKEVEYYEEYQRRLRARVGSSRAAAIVRGALHVVSIGTNDFLENYFLPLATGRFAQFTPPEFEDFLVAGARQFLARIHRLGARRVTFAGLAAIGCLPLERTTNALRGGGCVEEYNDVARSFNAKLQAMVRGLRDEFPRLRLAYISVYENFLDLITNPEKFGLENVEEGCCATGRFEMGFMCNDDAPLTCDDASKYLFWDAFHPTEKVNRLMANHTLQVCYQQGVL

SEQ ID NO: 10241 - DNA, 2313 bp, Sorghum bicolor
  misc_feature: Ceres ANNOT ID no. 6111699
  misc_feature: Encodes the peptide sequence at SEQ ID NO 10242
atgtctactcctggcacatcttcggctgctggatctcaagtgcaagctgccgacgacgtgcgcgagctcctcctctccaccacagccgacgcctctgacccgtccacgcccctctcagcgcccgacctccgcctcctcatcgaccgcctacgcctccgctccgaccgcctgcacgcctcggccctctccttcgccgcctctaaccgcggggccctcgccaacgcgctcctccgcgcagcctctgccgccgattcctccgcctccttaaagtcttccctcgactctgcgcttgccccgctcgcctcctcgcctgacctctccgacctcagggcccttgccgaccgcctcctctctgcccgccgcgagctcgccgagcgccaggagcacctcgctgctgcctccacaattgcttcgctcgctgcccgcctccgtgaggcccgtgccgcagcaagcccccttgacagggctgctgccgttgctgaactcaagaccctcctgatcgatcccgacagatctggatctgatcaagacgacccggtcgtatttgggctcctcaggaacgactgggagcaacttgtcgacgagctggaagtggggcttgggaagaatgtggaggagtgtgtggaatttgcgccagagggaggtaaggttgtggtgagggctactccgagaggtcactccggtggaagtgttgagcttcctgttgccctgcaggcgttggagactattgatgccctaggctatgggatggcaaaaattgcagacttgatgatgaaacatattctcgttccagcaatcagtaacatacaggtgtcagtgattgaggaagttggtccagaacactctgtatcagtcttgagtgtagtcccttctgaggaaataaaagacaataaagatggttcaaatctgtactcaagaataattgatgtcatcaagtttgtgtgcaaattcatttgcatggaaaatagcaagtgggttcagtcttttgcaaagttaacctggccaagaatttctgatctggttatcacacactttctctccaaggctgtacccaatgaagcatccaagctaattgagttccaagatgtcgtacgaagtacagttgaattcgagaacaaacttaggggcatgatgtttctttcgcctgatagaaaggatggcaaattgacccaatttgttgatgatgttgaagttcattttgctgtacggaagagaagtgagatcttggtgaaagcaaggaacattcttgtacaatatgattatgatagtcctctggaatctggtgaccaaggtgattctgttgttgatctactttttcagccagagaagtgttttacatctaaatcagcacttctagtaatgaaattggttcatggagccctcaagttgcatgcattgactattgcatgcgaatgcaccgttccactttttagtgatgcatctttgtcatcagcaagagtagctaaggagttctgctttgctgctagggatgttttgctcctttataaggctattgtgccagttcagctagagaagcaatttgatagcttaagtcaagtggctgctattgttcacaatgatttctaccatttgtcccaagaaattctgggccttgcatttcagtatcgtgcagattttcctagtgatctacaaaaacaggttgtttttgtggatttagccccaatcttctcccagatggcagatgctgtattgagaagacaaatacaactcgctgttgatactataagtgaggctatagatggcgctgaaggttttcagaacacacaccaacctcagcattatgagtcggcaaaatttagtatcgagcaggtcgtgtttattttggaaaagatacgcatcatgtgggaatcgatactgccaagatcaacttacaggaaaagtatgtgtcatgtccttgggtctgtcttctcaagaattacaagggatatgcttctgatagatgacatggcagcagaagagacattgcagcttcaaggccttatccatttggctctggaaaacctctcttcactatttctttccctggttgagaacgatgatggcagcacaaagttcttagaccatgacacttggattcaattggatggaattctaccctctttgaaaaagttccgcaagcttgcagagttgcttgatatgtcattgaagtccatcacagcatgttgggaaagtggagacctagctagatgtggtttcacatcatctgaggtgcaaaatttcatcaaagcaatattcgccgactcacctcttaggaaggagtgcctaggatggatcattaggacgccagcttag

SEQ ID NO: 10242 - protein, 770 aa, Sorghum bicolor
  misc_feature: Ceres ANNOT ID no. 6111699
  misc_feature (9)..(603): Pfam Id: Zw10 Pfam Desc: Centromere/kinetochore Zw10
  misc_feature (475)..(770): NCBI GI: 115485833 NCBI Desc: os11g0545700 [oryza sativa (japonica cultivar-group)]
  misc_feature (331)..(765): NCBI GI: 48735421 NCBI Desc: loc443575 protein [xenopus laevis]
  misc_feature (332)..(765): NCBI GI: 13364842 NCBI Desc: centromere protein zw10 [gallus gallus]
  misc_feature (332)..(765): NCBI GI: 45383019 NCBI Desc: zw10 protein [gallus gallus]
  misc_feature (420)..(765): NCBI GI: 119587633 NCBI Desc: zw10, kinetochore associated, homolog (drosophila) [homo sapiens]
MSTPGTSSAAGSQVQAADDVRELLLSTTADASDPSTPLSAPDLRLLIDRLRLRSDRLHASALSFAASNRGALANALLRAASAADSSASLKSSLDSALAPLASSPDLSDLRALADRLLSARRELAERQEHLAAASTIASLAARLREARAAASPLDRAAAVAELKTLLIDPDRSGSDQDDPVVFGLLRNDWEQLVDELEVGLGKNVEECVEFAPEGGKVVVRATPRGHSGGSVELPVALQALETIDALGYGMAKIADLMMKHILVPAISNIQVSVIEEVGPEHSVSVLSVVPSEEIKDNKDGSNLYSRIIDVIKFVCKFICMENSKWVQSFAKLTWPRISDLVITHFLSKAVPNEASKLIEFQDVVRSTVEFENKLRGMMFLSPDRKDGKLTQFVDDVEVHFAVRKRSEILVKARNILVQYDYDSPLESGDQGDSVVDLLFQPEKCFTSKSALLVMKLVHGALKLHALTIACECTVPLFSDASLSSARVAKEFCFAARDVLLLYKAIVPVQLEKQFDSLSQVAAIVHNDFYHLSQEILGLAFQYRADFPSDLQKQVVFVDLAPIFSQMADAVLRRQIQLAVDTISEAIDGAEGFQNTHQPQHYESAKFSIEQVVFILEKIRIMWESILPRSTYRKSMCHVLGSVFSRITRDMLLIDDMAAEETLQLQGLIHLALENLSSLFLSLVENDDGSTKFLDHDTWIQLDGILPSLKKFRKLAELLDMSLKSITACWESGDLARCGFTSSEVQNFIKAIFADSPLRKECLGWIIRTPA

SEQ ID NO: 10243 - DNA, 2262 bp, Sorghum bicolor
  misc_feature: Ceres ANNOT ID no. 6111719
  misc_feature: Encodes the peptide sequence at SEQ ID NO 10244
atgggagcaagctatcctcacatgtttttgatcctcttactgcttcaaggagccagtgctgctttgaaacctccagcagggccaaaatggctgactctgagcggtcttccccctctagtcatagctcgaggaggattctctggcttgtttcctgactcgagccagtttgcctaccagtttgccttgactgcctgcttgcctgatgtcgttctgttatgtgatctacaattgtcaagcgaccgtataggcttctgcaaaacagggttgacccttgataactcgacgactgtctctgagatcttccccaagatggaaaggacatacaagctgcacggagaagatgtccgtggctggttctctctagatttcaccgcagaacagctggcgcagaacgtctcattgatacagaacatcttttcgcgcccaagcacatttgatggctccttgcggatgtacccgcttgatgaagttgttgaactccacccccctcaaatatggcttaatgtacagtacaattcattctttttggagcacaaattaagtagtgaagattatatattagaactaccaaaagataccctctcttacatctcctcgccggagattgaattcttgaaaagcttgggtgggaagctcaagaaagccaagacaaagctcatcttccggttactcaatgaagacattgaggagccttcaaccaagaaaacatatggggaacttctgaaagatctaaaatccatcaaggaattcgcagttgggattcttgtgcccaagacatacatctggccagtagaaaaggatcagtacttggcgccatcgcccaccagtttggtcaaagatgctcatgccatcgggctggaagtgtatgcatccggatttgccaatgatatcgtcttgagttacaactacagctatgatccctctgcagagtacttgcagttcatagacaatccagacttctctgttgacggtgtgcttacggacttcccggtcaccgcatcaggggctgttgcttgcatggctcattccaagggcaatcctctaccacctcctggaaaaagcaggccgctgatcatcacccacaacggcgcgagcggcatgttcgccggcagcacagatcttgcctaccaggaggcgatcaaagatgccgctgacatcatcgattgcacggttcagatgtcaaaagacggaacggccttctgcatgcactccgctgatatctccagctccacgaccgcggccaccgcttttgcgtccaaagcctctactgtccatgagatccagaacaagtctggcattttctcgttcgatctgtcatggagtgagattgcaaccttgaggcccgccctcgtctctccgtttgctcaggcaggcatgcaaagaaatcctctagcaaagaatgccggcaagttgatgactttgccccatttcttagacttggccaaggccagcaacatcaccggtatactgatcgaaatagagcatgctgcatacctcgccaagagagggatcggcattgtggaggcggtgtctagcgcgctgaccaaggcgggctacgacaaggagaccaagcagcaggtgttcgtccagtccgacgactcgtcggtgctggaggcgttcaagaagttcaagacattcaggagggtgctcaacatcgaggccaagatcagcggcgcctccaagccgtcgctggatgacatcaagaagttcgcggacacggtgaggatcaaccggaactcggttgcgcagatcaccggctacttcatgacgcacttcaccgacacggtcggcagcctacaggccgccaacctcaccgtgtttgttggcgtgctcaagaacgagttcatgaacctcggcttcgacttcttcgctgacccgacgatcgaggtcgctacctacgcttattcggtggtggccgatgggatcgtcacggactaccctgccactgcagcttcctacttcaggagtccatgcagtgacatgaagctgaacctgagctactcgatcctgcctgcacaacctggcgctctggtcaacctggcagcccccgggatgttggctccggcgggagcgccggcaccgttgctccaacccactgacgtagtggacccgccgctgcctccggttaaagctgtgatcaccgccgacgcgccggcaccaaaggcggctgacaacacctcatcggcgttcagctccaacacggcgaacggcctcttgtgggctggcgtcgttgccctcttgtccctgacctttctgcactga

SEQ ID NO: 10244 - protein, 753 aa, Sorghum bicolor
  misc_feature: Ceres ANNOT ID no. 6111719
  misc_feature (361)..(649): Pfam Id: GDPD Pfam Desc: Glycerophosphoryl diester phosphodiesterase family
  misc_feature (1)..(752): NCBI GI: 46390048 NCBI Desc: glycerophosphoryl diester phosphodiesterase 2 precursor-like protein [oryza sativa (japonica cultivar-group)]
  misc_feature (1)..(676): NCBI GI: 46390047 NCBI Desc: glycerophosphoryl diester phosphodiesterase 2 precursor-like protein [oryza sativa (japonica cultivar-group)]
  misc_feature (29)..(447): NCBI GI: 140067076 NCBI Desc: glycerophosphoryl diester phosphodiesterase [medicago truncatula]
  misc_feature (8)..(752): NCBI GI: 18416801 NCBI Desc: glycerophosphoryl diester phosphodiesterase family protein [arabidopsis thaliana]
  misc_feature (10)..(719): NCBI GI: 38344811 NCBI Desc: osjnbb0022f23.4 [oryza sativa (japonica cultivar-group)]
  misc_feature: Useful for making plants with altered cell wall content and/or composition
  misc_feature: GREAT-hit functional homolog of the protein sequence encoded by LOCUS at5g58170
MGASYPHMFLILLLLQGASAALKPPAGPKWLTLSGLPPLVIARGGFSGLFPDSSQFAYQFALTACLPDVVLLCDLQLSSDRIGFCKTGLTLDNSTTVSEIFPKMERTYKLHGEDVRGWFSLDFTAEQLAQNVSLIQNIFSRPSTFDGSLRMYPLDEVVELHPPQIWLNVQYNSFFLEHKLSSEDYILELPKDTLSYISSPEIEFLKSLGGKLKKAKTKLIFRLLNEDIEEPSTKKTYGELLKDLKSIKEFAVGILVPKTYIWPVEKDQYLAPSPTSLVKDAHAIGLEVYASGFANDIVLSYNYSYDPSAEYLQFIDNPDFSVDGVLTDFPVTASGAVACMAHSKGNPLPPPGKSRPLIITHNGASGMFAGSTDLAYQEAIKDAADIIDCTVQMSKDGTAFCMHSADISSSTTAATAFASKASTVHEIQNKSGIFSFDLSWSEIATLRPALVSPFAQAGMQRNPLAKNAGKLMTLPHFLDLAKASNITGILIEIEHAAYLAKRGIGIVEAVSSALTKAGYDKETKQQVFVQSDDSSVLEAFKKFKTFRRVLNIEAKISGASKPSLDDIKKFADTVRINRNSVAQITGYFMTHFTDTVGSLQAANLTVFVGVLKNEFMNLGFDFFADPTIEVATYAYSVVADGIVTDYPATAASYFRSPCSDMKLNLSYSILPAQPGALVNLAAPGMLAPAGAPAPLLQPTDVVDPPLPPVKAVITADAPAPKAADNTSSAFSSNTANGLLWAGVVALLSLTFLH

SEQ ID NO: 10245 - DNA, 1200 bp, Sorghum bicolor
  misc_feature: Ceres ANNOT ID no. 6111726
  misc_feature: Encodes the peptide sequence at SEQ ID NO 10246
atggccggtcggcttccgggcgccgccgcgtcctcaccgctcccccgcgcgctcctcctcctcgccgcgctcgcgctcttctccatctccttcctctcgcttcgctccctccgccccgccgcggaccccgcggtcgcggccgccgccgacaagtcccgtcccctcctccggctccagtcctcctcgtcggtgtaccactccccggaggcgttcgcggcggggtacgcggagatggaacggagcttcaaggtgtacatctacccggacggcgaccccaagacattctatcagacgcctcgcaagctcacggggaagtacgccagcgagggctacttcttccagaacatccgagagagccggttccgcaccgatgaccccgaccaggcgcacctcttcttcgtccccatatcgccacacaagatgcgcggcaagggtactacatatgagaatatgacggtgatagttaaggactacgtagaaggtttgataaacaagtatccttactggaacaggacactaggagcagaccacttttttgtcacctgccatgatgtgggtgtgagagcatttgaaggacttccattcatggtgaaaaactctattagagttgtatgttcgccaagctataatgttgactttataccgcataaggatattgcccttcctcaagtgctacagccatttgccctacctgaaggaggaaatgatattgagaacaggacaattcttggcttttgggctggccatcgaaattccaaaataagagttatcctagcacgagtttgggaaaatgacacagagcttgctatcagcaacaatcggatcagtagagctattggagagctagtttatcagaagcagttttaccgtaccaagttctgtatctgtcctggtggttctcaagttaacagtgcccgtatatctgactcaatacactatggttgtgttcctgactactatgacctgcctttcaatgatgcccttgactggagaaagtttgcggttatacttagggagagagatgtatatcaactgaagaatatcttgaaatctatatcacaggaggagtttgtttcattacataaatctctagttcaggtgcagaaacactttgtgtggcattcacctcctgtctcctacgatgcattccacatggttatgtatgaactgtggctgcgtcataatgtgataaagtactga

SEQ ID NO: 10246 - protein, 399 aa, Sorghum bicolor
  misc_feature: Ceres ANNOT ID no. 6111726
  misc_feature (84)..(364): Pfam Id: Exostosin Pfam Desc: Exostosin family
  misc_feature (78)..(399): NCBI GI: 51535578 NCBI Desc: pectin-glucuronyltransferase-like [oryza sativa (japonica cultivar-group)]
  misc_feature (198)..(399): NCBI GI: 115469106 NCBI Desc: os06g0638300 [oryza sativa (japonica cultivar-group)]
  misc_feature (57)..(397): NCBI GI: 87162615 NCBI Desc: exostosin-like [medicago truncatula]
  misc_feature (64)..(398): NCBI GI: 52076236 NCBI Desc: pectin-glucuronyltransferase -like [oryza sativa (japonica cultivar-group)]
  misc_feature (71)..(391): NCBI GI: 102140005 NCBI Desc: exostosin family protein [musa acuminata]
  misc_feature: Useful for making plants with altered cell wall content and/or composition
  misc_feature: GREAT-hit functional homolog of the protein sequence encoded by LOCUS at4g38040
  misc_feature: Useful for making plants with altered carbohydrate content
  misc_feature: Functional homolog of the protein sequence given in SEQ ID NO 13594
  misc_feature: Useful for making plants with altered cell wall content and/or composition
  misc_feature: Functional homolog of the protein sequence given in SEQ ID NO 13595
MAGRLPGAAASSPLPRALLLLAALALFSISFLSLRSLRPAADPAVAAAADKSRPLLRLQSSSSVYHSPEAFAAGYAEMERSFKVYIYPDGDPKTFYQTPRKLTGKYASEGYFFQNIRESRFRTDDPDQAHLFFVPISPHKMRGKGTTYENMTVIVKDYVEGLINKYPYWNRTLGADHFFVTCHDVGVRAFEGLPFMVKNSIRVVCSPSYNVDFIPHKDIALPQVLQPFALPEGGNDIENRTILGFWAGHRNSKIRVILARVWENDTELAISNNRISRAIGELVYQKQFYRTKFCICPGGSQVNSARISDSIHYGCVPDYYDLPFNDALDWRKFAVILRERDVYQLKNILKSISQEEFVSLHKSLVQVQKHFVWHSPPVSYDAFHMVMYELWLRHNVIKY

SEQ ID NO: 10247 - DNA, 825 bp, Sorghum bicolor
  misc_feature: Ceres ANNOT ID no. 6111728
  misc_feature: Encodes the peptide sequence at SEQ ID NO 10248
atgggcgccgccctgctgctcgcgcttctcctcgcggccgccgcgccgctctccgcgtcggcggcggtcacagccggcgacgcgcacccgggctactccgacgagggcacgtgcacggtggacgcgggggtgggcgcggagctgcggcggctggaggagcgcgggcccggcgggcgcatcatcgacatcacgcacgcgtacgtgccggacctgccggcgttcgcgacgggggcggtcacggggcccgtggtgcgcctcaaggagtccatggcggacgggtccgagtacaacctctcggagctgcggatggagtgccacatgggcacccacgtcgacgcgccgggacacatcaaccaggcccacttcgccgccggcctcgacgtcgacacgctcgacctcgaagtcctcaacggacctgcattgctagttgatgttccgagggacacaaatataacagctaaagcaatggaattcctaaaaatcccgagaggagttcgccgagttttattcaggacactgaacactgacaggaagttgatgtggaggaagggaggtgacatgagctatgttggatttacagaggatggcgcacagtggttagttgacaacactgacataaagctaattggagttgacggtctatcagttgcagcatttgattacttgatctctgcccatgtggtcttcttcaaaaccccggatataatccctgttgaggccctgaaactagacgacattgaggcgggaatatacatgctgcattgtttacctctcaggctggttggagctgagggtgcaccgaccagatgcatcctcatcaagtga

SEQ ID NO: 10248 - protein, 274 aa, Sorghum bicolor
  misc_feature: Ceres ANNOT ID no. 6111728
  misc_feature (60)..(260): Pfam Id: Cyclase Pfam Desc: Putative cyclase
  misc_feature (1)..(274): NCBI GI: 46390076 NCBI Desc: metal-dependent hydrolase-like protein [oryza sativa (japonica cultivar-group)]
  misc_feature (7)..(274): NCBI GI: 51535583 NCBI Desc: metal-dependent hydrolase-like protein [oryza sativa (japonica cultivar-group)]
  misc_feature (7)..(274): NCBI GI: 115469112 NCBI Desc: os06g0638700 [oryza sativa (japonica cultivar-group)]
  misc_feature (4)..(274): NCBI GI: 115475854 NCBI Desc: os08g0319900 [oryza sativa (japonica cultivar-group)]
  misc_feature (23)..(274): NCBI GI: 46806364 NCBI Desc: cyclase-like protein [oryza sativa (japonica cultivar-group)]
  misc_feature: Useful for making plants with modulated salt sensitivity
  misc_feature: Functional homolog of the protein sequence given in SEQ ID NO 13597
MGAALLLALLLAAAAPLSASAAVTAGDAHPGYSDEGTCTVDAGVGAELRRLEERGPGGRIIDITHAYVPDLPAFATGAVTGPVVRLKESMADGSEYNLSELRMECHMGTHVDAPGHINQAHFAAGLDVDTLDLEVLNGPALLVDVPRDTNITAKAMEFLKIPRGVRRVLFRTLNTDRKLMWRKGGDMSYVGFTEDGAQWLVDNTDIKLIGVDGLSVAAFDYLISAHVVFFKTPDIIPVEALKLDDIEAGIYMLHCLPLRLVGAEGAPTRCILIK

SEQ ID NO: 10249 - DNA, 1086 bp, Sorghum bicolor
  misc_feature: Ceres ANNOT ID no. 6111764
  misc_feature: Encodes the peptide sequence at SEQ ID NO 10250
atggcagtgacggcggaagcggcagcggagatagggttggaacggcgggcgtacgcgcgggtggggctcctcggcaaccccagcgacgtgtacggcggcagggcgctgtcctttaccatcgctgacttctccgccaccgtccgcctccgcccttcgcccgagctgctcatccagccgcacccgcaccacgacctcgtcgccttcccctccctccctcaactcgtgagtcgtttgcaaagtgaaggatattatggaggtgtccggctgctgatggctatctgtaaagttttctacaatcactgtattcaaaataatatcagtttaaaagctgaaaatttcaccttatcatatgatactaatattcctcgacaggctgggttgtcgggttcgagcgcgattgtttgtgctgctctaagctgccttcttgacttctatgatgtcagacatctaataaaagttgaaatgagacctaatctaattctcaacgctgagaaagagcttgggattgttgctggacttcaggaccgagtggcacaggtttatggaggactggtttatatggattttagccaggagcatatgggcaagctgggtcatggcatatacatgccattggatgtgaatctgcttcctcctctatacctcatctatgcagagaaccccagtgactctggcaaggtccacagcactgttagacaaagatggcttgatggtgatgagtttataatatcacgtatgaaggaagtagcgcagctagcattcgatggtcacaaggctttgctgcagaaggattatactgagctagcgaggcttatgaataagaattttgatctgcgaagggaaatgtttggggatgatgtacttggttcagtgaacataaagatggtggaggtggcacgcagggtgggcgcggcatccaagttcactggcagtggaggcgcagtggttgccctgtgcccagatggggattcacaggtggagcatctccgtgaggcttgccaggaggccggctttgtaatacagcaggtgaaagttgccccctcggtgctgacggatgcggagctgtcaagtttattagcttcctag

SEQ ID NO: 10250 - protein, 361 aa, Sorghum bicolor
  misc_feature: Ceres ANNOT ID no. 6111764
  misc_feature (114)..(183): Pfam Id: GHMP_kinases_N Pfam Desc: GHMP kinases N terminal domain
  misc_feature (256)..(339): Pfam Id: GHMP_kinases_C Pfam Desc: GHMP kinases C terminal
  misc_feature (3)..(358): NCBI GI: 22655334 NCBI Desc: at3g01640/f4p13_18 [arabidopsis thaliana]
  misc_feature (91)..(358): NCBI GI: 56121900 NCBI Desc: at5g14470 [arabidopsis thaliana]
  misc_feature (13)..(345): NCBI GI: 116228930 NCBI Desc: ghmp kinase [solibacter usitatus ellin6076]
  misc_feature (115)..(346): NCBI GI: 94969458 NCBI Desc: ghmp kinase [acidobacteria bacterium ellin345]
  misc_feature (16)..(340): NCBI GI: 29345884 NCBI Desc: d-glycero-d-manno-heptose 1-phosphate kinase [bacteroides thetaiotaomicron vpi-5482]
MAVTAEAAAEIGLERRAYARVGLLGNPSDVYGGRALSFTIADFSATVRLRPSPELLIQPHPHHDLVAFPSLPQLVSRLQSEGYYGGVRLLMAICKVFYNHCIQNNISLKAENFTLSYDTNIPRQAGLSGSSAIVCAALSCLLDFYDVRHLIKVEMRPNLILNAEKELGIVAGLQDRVAQVYGGLVYMDFSQEHMGKLGHGIYMPLDVNLLPPLYLIYAENPSDSGKVHSTVRQRWLDGDEFIISRMKEVAQLAFDGHKALLQKDYTELARLMNKNFDLRREMFGDDVLGSVNIKMVEVARRVGAASKFTGSGGAVVALCPDGDSQVEHLREACQEAGFVIQQVKVAPSVLTDAELSSLLAS

SEQ ID NO: 10251 - DNA, 3303 bp, Sorghum bicolor
  misc_feature: Ceres ANNOT ID no. 6111779
  misc_feature: Encodes the peptide sequence at SEQ ID NO 10252
atgagcgacgatggtgaccgcacctgcccgctctgtgccgaggagatggacatcactgaccagcagctcaagccatgcaaatgcggctacgacatttgtgtttggtgttggcaccacatcatagacatggctgagaaggaggaaacagagggtcgctgccctgcatgccgcacacgctatgacaaggacaggatcgtcaagatggctgccacgtgtgacaggacggtggctgagaaaaatgcagagaagaagcacaagacccaaaaggttaagccaaaggcagcaccaccaccaacagcaatgtcaactgtagaatctaagaagcatctggctagtgtcagggttatccagagaaatctggtgtacataattgggctacctgcgcatttatgccatgagagcgtacttgagcgcagggaatactttggtcaatatgggaaagttttgaaggtttcagtttcccgtccgactgggcctccctctcaggcatcagcgaacagcaatattagtgtgtatattacttatgccaaagaagaagaggccatccggtgtattcaagctgtacacaattttgttttggaagggaaagtgctaagggcatgctttggtactacgaagtattgccatgcatggctgcgaaacataacatgtgggaatccagattgtctctatttgcatgatgtaggcagtcaggaggatagttttactaaagatgagatcatctcagcatatacgaggactagagtcccccagatggcatctagtgtttcacaaagacgtacaggcactgtgttgcctcctccaggagatgatttctcttacagtgcggttgtttcagccaagcatacattcaagaatggagcacttaataccaccaaccagcccagactttcacctccaaacagtagttctgggaggtccacacttccaccagctgcctcatgggggcagcgtgatttgaatgccaggacaacagctactggggcgacatcatcacaatctcatacaaaacctaaatcagaatcacagagtaatccattttcaagttctccagtaatttccagtacaaaaacaccctcttcgtggaatgatgatacaagtacagcaacaaaaatgtcatcaggacagcaggtgtcagaaaaagagtctaaaaccttgcagccgtataagcctggtatttcaaaggaaacacaagctctatcatcactggagtcatcactggacatagatttctcgacaataccttcagcttggaatgatgatgacattgtagtatctgatgggatgtcaaaaggaagcgatgaaaatcaagttgcaaatgaaaatggcgagctaacccatccagcatctaagccactggttttatctaagaaagacaacattaccagcaaaagtccttcagattttgtatcaagtctagcaatatctaaatcagatgtaagtacgagtgatggtgaccactcacttaccaatattactcctaaaagccttacttcaaatgctgtagactgccaatctggggagaaaatattggaagatattggatccaggaacactgacatggaaaagctatctgctcagatatcttcagtaaaattaggtggcaacaatgatattcagagtatggcaggaaatcagcaatcagatgtaatgccatgcacatctgttgttgtgcccatggatcagaattttgacaaagaccaatctcatctcaatcttgatgagctcttattaccttcagaaaataaggatactattctttcttgtcaatatagttctgataagcgtcttgattggagttcagagctgcaaaattgtagtgtgactcctttaaatgatatagtagattctacagtgctcactgacaaacttcatagtatactactggatggttcaaagcaaccatcatattcgtcatttgcccaatttcctagtacattggatagttcgttgtggaatgatacagaaagtaaccctgcattgatgattggcactagagcttcttcacagacggggttttcttcaataaataacacttatgtcttgccaaatggagggcaagatgggctagggactgtatatacacatggtaatgtttctggacatcctggaataggaagtcttcagcatagagcaacgggttcagatagtataggaagttttgacaagaccataagtgtaaataaggatgagagcagaataatttctgatatgttgtcgtcagagtttaatccatgggatgattcatattcgactgctaacaattttgttaggatgcttagggaatctgaaaataatgatgttaatttcactgcgccttcatggaaatcaggaactgcgagcaaagagtccagattttcatttgctagacaggataaccaagggaacttgttagattcatctctcagaaactgtggcactgttactgagcagaatttcagtttgctgccccagaattctcgaggaaatatttaccagaatggccttgcattccaatctctagaaaatgatttttccaatggcaactctcttggtgtattagatatggcaactgctggtacatcgaggtctaaaatatctgctcccccaggattttcagcaccagcaagagtcccccctcctggattttcttctgtgtttccatcccaggatagacttccagcacaggatggtcctaatcctccttctagatttacttctgcattttcttctggattttcatcacaggatgggtctaatcagtcatatggctcaacataccaagacaatcttctccgggatactgttttgggtggcaacagtaatcattaccaatctcagtttggaaggcacacaagtgatatggagtttgatgatcctgctatattagctgtgggcaaagggctgatgcctggaattggtggtccagagctggagatgaaaaatacccctgcttttcaagcacagttgcaatcagcaagtagtgatccaaggtttcagttacatgtacagccaaatgtgcagtctcatcaaaacctgagattctcagaccctatgcaggatggcttgaaccatatgaatgataattacctggcatccagatttttagctcagaaccatggtcctgtatccccttatgctcagattccgcaacaacccagaaactcccaggttacaaatggtcattgggatgggtggagtgattccagacaagggaataacactgctatgtcagacatgtcgaggatgttatatccaagtgacgtgaacaagttgcacatgctgggttcaaatgatatctataacagagcatttggaatgtga

SEQ ID NO: 10252 - protein, 1100 aa, Sorghum bicolor
  misc_feature: Ceres ANNOT ID no. 6111779
  misc_feature (121)..(200): Pfam Id: RRM_1 Pfam Desc: RNA recognition motif. (a.k.a. RRM, RBD, or RNP domain)
  misc_feature (1)..(550): NCBI GI: 145359475 NCBI Desc: rna binding [arabidopsis thaliana]
  misc_feature (1)..(550): NCBI GI: 8885568 NCBI Desc: general negative transcription regulator-like [arabidopsis thaliana]
  misc_feature (16)..(499): NCBI GI: 140056836 NCBI Desc: rna-binding region rnp-1 (rna recognition motif) [medicago truncatula]
  misc_feature (1)..(443): NCBI GI: 79565326 NCBI Desc: nucleic acid binding / ubiquitin-protein ligase/ zinc ion binding [arabidopsis thaliana]
  misc_feature (1)..(407): NCBI GI: 28828505 NCBI Desc: similar to dictyostelium discoideum (slime mold). mkpa protein
MSDDGDRTCPLCAEEMDITDQQLKPCKCGYDICVWCWHHIIDMAEKEETEGRCPACRTRYDKDRIVKMAATCDRTVAEKNAEKKHKTQKVKPKAAPPPTAMSTVESKKHLASVRVIQRNLVYIIGLPAHLCHESVLERREYFGQYGKVLKVSVSRPTGPPSQASANSNISVYITYAKEEEAIRCIQAVHNFVLEGKVLRACFGTTKYCHAWLRNITCGNPDCLYLHDVGSQEDSFTKDEIISAYTRTRVPQMASSVSQRRTGTVLPPPGDDFSYSAVVSAKHTFKNGALNTTNQPRLSPPNSSSGRSTLPPAASWGQRDLNARTTATGATSSQSHTKPKSESQSNPFSSSPVISSTKTPSSWNDDTSTATKMSSGQQVSEKESKTLQPYKPGISKETQALSSLESSLDIDFSTIPSAWNDDDIVVSDGMSKGSDENQVANENGELTHPASKPLVLSKKDNITSKSPSDFVSSLAISKSDVSTSDGDHSLTNITPKSLTSNAVDCQSGEKILEDIGSRNTDMEKLSAQISSVKLGGNNDIQSMAGNQQSDVMPCTSVVVPMDQNFDKDQSHLNLDELLLPSENKDTILSCQYSSDKRLDWSSELQNCSVTPLNDIVDSTVLTDKLHSILLDGSKQPSYSSFAQFPSTLDSSLWNDTESNPALMIGTRASSQTGFSSINNTYVLPNGGQDGLGTVYTHGNVSGHPGIGSLQHRATGSDSIGSFDKTISVNKDESRIISDMLSSEFNPWDDSYSTANNFVRMLRESENNDVNFTAPSWKSGTASKESRFSFARQDNQGNLLDSSLRNCGTVTEQNFSLLPQNSRGNIYQNGLAFQSLENDFSNGNSLGVLDMATAGTSRSKISAPPGFSAPARVPPPGFSSVFPSQDRLPAQDGPNPPSRFTSAFSSGFSSQDGSNQSYGSTYQDNLLRDTVLGGNSNHYQSQFGRHTSDMEFDDPAILAVGKGLMPGIGGPELEMKNTPAFQAQLQSASSDPRFQLHVQPNVQSHQNLRFSDPMQDGLNHMNDNYLASRFLAQNHGPVSPYAQIPQQPRNSQVTNGHWDGWSDSRQGNNTAMSDMSRMLYPSDVNKLHMLGSNDIYNRAFGM

SEQ ID NO: 10253 - DNA, 1017 bp, Sorghum bicolor
  misc_feature: Ceres ANNOT ID no. 6111782
  misc_feature: Encodes the peptide sequence at SEQ ID NO 10254
atgccgtcgccggcggccgtgctcgtcagcaacggcgccatctccccacacgctcccccatccgccgccgccttcctcgactccacgccgggcgcctacaccaccgcccgcggcaccctgcactggtggccacgccatctccgccgcctcgccgaatccgccacgctcctcgcccgttcccaccccgacctgctcggcctccccgttccccgatcgcgcgccctcgacctcgacttccactccatccagtctctcgtcaacccctccgtacgggtagccatccacgagatgcgcgctcggctgcccatgaccaaggacgacgacgatttggcgctcacggccctggtcagaggagcaggagcaggagccgattccgtttctgcttctggggacggcctcgacgtcttcgtccatgtggggacgtattccccgccgatcttcggagagtcgggggccaggcttgctgttgccggcaggggaagggacgccgccgctgccaagtacgcgtcctgggccaggattcggaagagtatggaaaagatgaggcctcctggggtcacagagctcttgttgactaacgacggggatcacattcttgaaggcgctgtcacaaacttctttgttgtctgccaacaggaggaacatgagaggaatgagcaattctctaatcaaacaatggatattaagtttgaagtgcaaacagcaccactgagtgatggagtcctcccagggattatacgtcagatagtgatagaggtgtgccatgatattggaatcccagtacgagagatgtctccgtcgtggtccaataatgaactttggaaagaggcatttgttacaagtagcttaaggtttatccagcatgtagagtcagttcaagtacctttattttgggaggacatacaatctaaaacctggagtgatgtaccttgggcggtgaagaagtttcagggtgctggctgcattaccacacagattcagacattttggctgctctgtgctttatttgttggctaa

SEQ ID NO: 10254 - protein, 338 aa, Sorghum bicolor
  misc_feature: Ceres ANNOT ID no. 6111782
  misc_feature (2)..(212): NCBI GI: 115445345 NCBI Desc: os02g0252600 [oryza sativa (japonica cultivar-group)]
  misc_feature (232)..(297): NCBI GI: 22299586 NCBI Desc: branched-chain amino acid aminotransferase [thermosynechococcus elongatus bp-1]
  misc_feature (231)..(292): NCBI GI: 111019961 NCBI Desc: branched-chain-amino-acid transaminase [rhodococcus sp. rha1]
  misc_feature (232)..(293): NCBI GI: 116229860 NCBI Desc: aminotransferase, class iv [solibacter usitatus ellin6076]
  misc_feature (21)..(292): NCBI GI: 29251033 NCBI Desc: glp_587_119251_118319 [giardia lamblia atcc 50803]
  misc_feature: The sequence is a functional homolog of SEQ ID NO. 504 in the 11/188,298 US application
MPSPAAVLVSNGAISPHAPPSAAAFLDSTPGAYTTARGTLHWWPRHLRRLAESATLLARSHPDLLGLPVPRSRALDLDFHSIQSLVNPSVRVAIHEMRARLPMTKDDDDLALTALVRGAGAGADSVSASGDGLDVFVHVGTYSPPIFGESGARLAVAGRGRDAAAAKYASWARIRKSMEKMRPPGVTELLLTNDGDHILEGAVTNFFVVCQQEEHERNEQFSNQTMDIKFEVQTAPLSDGVLPGIIRQIVIEVCHDIGIPVREMSPSWSNNELWKEAFVTSSLRFIQHVESVQVPLFWEDIQSKTWSDVPWAVKKFQGAGCITTQIQTFWLLCALFVG

SEQ ID NO: 10255 - DNA, 771 bp, Sorghum bicolor
  misc_feature: Ceres ANNOT ID no. 6111783
  misc_feature: Encodes the peptide sequence at SEQ ID NO 10256
atggacgagtgggttcgccaagctgaggtgtgggtgcgccaagccgagagctggatccggcagcagcccccggagcagatctatatcgcggccgtggtggttgccctcacaatcctgctgcttatcctagcatcttgtctgaaatcctcaaagctaaatactatagtgctatccggacttagtggcagtggcaaaactactattttctaccagcttcgggatggatcatcacatcaaggaactgtgacttcaatggaagaaaacaatgacacatttgtactacattcggagcaagaaaggaaaggcaaagtaaaacctgtgcatgttgttgatgtccctggccattcaaggctcaagcccaagcttgatgaagtcctgcctaaagcagctggggttgttttcgttgttgatgctcaagatttcttgtctagcatgcaagctgccgcagagtacctgtatgacattctgacaaaggcaactgtagtgaagaaaaaggttcctgtgcttatattctgcaacaagacagataaagttacagcccactcaaaggagttcataaagaaacaattggagaaagaaataaacaagcttcgggaatcaaggaatgccatatcatcagctgacatctctgatgaagttcagctcggggtccctggagaggtattcaacttcagccattgccagaacaaggtggctgttgctgagggtgccggttcgaccggtaatgtttcagctgttgagcaattcatccgtgaacatgtgaaggcgtag

SEQ ID NO: 10256 - protein, 256 aa, Sorghum bicolor
  misc_feature: Ceres ANNOT ID no. 6111783
  misc_feature (39)..(209): Pfam Id: Arf Pfam Desc: ADP-ribosylation factor family
  misc_feature (53)..(176): Pfam Id: MMR_HSR1 Pfam Desc: GTPase of unknown function
  misc_feature (1)..(255): NCBI GI: 92887265 NCBI Desc: aaa atpase; small gtp-binding protein domain [medicago truncatula]
  misc_feature (8)..(255): NCBI GI: 110736264 NCBI Desc: signal recognition particle receptor beta subunit-like protein [arabidopsis thaliana]
  misc_feature (85)..(256): NCBI GI: 51090418 NCBI Desc: signal recognition particle receptor beta subunit-like [oryza sativa (japonica cultivar-group)]
  misc_feature (118)..(256): NCBI GI: 115468056 NCBI Desc: os06g0473100 [oryza sativa (japonica cultivar-group)]
  misc_feature (29)..(242): NCBI GI: 111608123 NCBI Desc: signal recognition particle receptor beta subunit [bombyx mori]
  misc_feature: Useful for making plants with modulated cold sensitivity
  misc_feature: GREAT-hit functional homolog of the protein sequence given in SEQ ID NO 12929
  misc_feature: Useful for making plants with modulated cold sensitivity
  misc_feature: Functional homolog of the protein sequence given in SEQ ID NO 12929
MDEWVRQAEVWVRQAESWIRQQPPEQIYIAAVVVALTILLLILASCLKSSKLNTIVLSGLSGSGKTTIFYQLRDGSSHQGTVTSMEENNDTFVLHSEQERKGKVKPVHVVDVPGHSRLKPKLDEVLPKAAGVVFVVDAQDFLSSMQAAAEYLYDILTKATVVKKKVPVLIFCNKTDKVTAHSKEFIKKQLEKEINKLRESRNAISSADISDEVQLGVPGEVFNFSHCQNKVAVAEGAGSTGNVSAVEQFIREHVKA

SEQ ID NO: 10257 - DNA, 1773 bp, Sorghum bicolor
  misc_feature: Ceres ANNOT ID no. 6111791
  misc_feature: Encodes the peptide sequence at SEQ ID NO 10258
atgggcagctacaagtacaagtactgcatgtgtttcacgcgcaagttcagatccccggacgcccagccgccgcccgacgtccgcgccgcctacctctccttcaactccgacgtccacgccctccgtcgcttcctctcccaggcgcaggccgagcaccccgccgacgtcgaccgcatcctcgccctgctcacggccgcctcggggggacatggcatcgcccgcctcgtcaccaggtcgccggcgccggccatgcccacgctcgaggacttcttcgccttcctcttctcgccggaactcaacccgcccttgcctcaccaggttcaccaggacatgtctgccccgctctctcattatttcatattcaccggacataattcctacctaactgggaaccagctcaatagtgactccagcgacatcccaattataaaagcattgcagagaggtgttagagtcattgaactcgatatgtggccaaattcttcaaagaccaatgtcgatattcttcatggagggacattgactgcgccagtagaaatgatcaggtgtttgaagtccattaaagaatatgccttttgtgcatcaccatatccgcttgtcatcactcttgaggatcaccttacaccagatctccaagccaaagtagctaagatgctcactgaaacattcggagatctacttttcgtacctagttcagacccaatgaaagagttcccctctccagcagctctgatgaagagaataatcatctcgactaaacccccacaagagtacaaggagttcctcaaagttaaggataaccaaaatggcagtggaaatatagctgatttgccagacacaggaaacatgggaagcctaagaagaatagattcaaatgctgatgaatctgatggaaaggatgagctggatgaactggatgaggaagattccgacgaggatgatccaaaatttcagcaggacactgcctgtgagtataggaaactgatcaccatccaagctggcaaaccgaaaggccatttgcgggatgcgctaaaggtggatccagaaaaagtcaggcggctttctttgagtgagacacagttagctaaagcaacaacttctcatggtgctgaagtcataaggttcacccagaataatatactccgtgtgtatccaaagggcacgagggttaattcttcaaactatgatccaatgaatgcctggactcatggtgctcagatggttgcattcaacatgcaggggcatgataaagcgctccggctgatgcaaggatttttcagagccaatgggggctgtggatatgttaaaaaacctgacttcttgctaaggacaggtccaaacggggaagtattcgaccccaaaggtagtttgccagtgaagaaaactctcaaggtaaaagtatatatgggagatgggtggcgcatggatttcagcaagactcatttcgatgctttttcgcctccagatttctataccagggtagggattgccggagtgaaggcggacactgtgatgaagaagacaagggtgatcgaagaccagtgggtgccggtgtgggacgaggagttcacgttccctctgaaggtgccggagctggccctcctgaggatagaggtgcaggaatacgacatgtcggagaagcacgactttgggggacagacgtgcctgccggtgtgggagctgaagcagggcatccgtgctgtacccctgcacgaccgcaagggcaacaggtacaaatcggttaggctgcttatgcgcttcgattttttctag

SEQ ID NO: 10258 - protein, 590 aa, Sorghum bicolor
  misc_feature: Ceres ANNOT ID no. 6111791
  misc_feature (111)..(254): Pfam Id: PI-PLC-X Pfam Desc: Phosphatidylinositol-specific phospholipase C, X domain
  misc_feature (324)..(442): Pfam Id: PI-PLC-Y Pfam Desc: Phosphatidylinositol-specific phospholipase C, Y domain
  misc_feature (463)..(555): Pfam Id: C2 Pfam Desc: C2 domain
  misc_feature (1)..(589): NCBI GI: 42741757 NCBI Desc: phospholipase c [zea mays]
  misc_feature (1)..(589): NCBI GI: 2765140 NCBI Desc: 1-phosphatidylinositol-4,5-bisphosphate phosphodiesterase [nicotiana rustica]
  misc_feature (1)..(589): NCBI GI: 1771381 NCBI Desc: phosphoinositide-specific phospholipase c [nicotiana rustica]
  misc_feature (1)..(589): NCBI GI: 145308221 NCBI Desc: phosphoinositide-specific phospholipase c [nicotiana tabacum]
  misc_feature (1)..(589): NCBI GI: 37654366 NCBI Desc: phospholipase c [vigna radiata]
  misc_feature: Useful for making plants with modulated water use efficiency
  misc_feature: Functional homolog of the protein sequence given in SEQ ID NO 13598
MGSYKYKYCMCFTRKFRSPDAQPPPDVRAAYLSFNSDVHALRRFLSQAQAEHPADVDRILALLTAASGGHGIARLVTRSPAPAMPTLEDFFAFLFSPELNPPLPHQVHQDMSAPLSHYFIFTGHNSYLTGNQLNSDSSDIPIIKALQRGVRVIELDMWPNSSKTNVDILHGGTLTAPVEMIRCLKSIKEYAFCASPYPLVITLEDHLTPDLQAKVAKMLTETFGDLLFVPSSDPMKEFPSPAALMKRIIISTKPPQEYKEFLKVKDNQNGSGNIADLPDTGNMGSLRRIDSNADESDGKDELDELDEEDSDEDDPKFQQDTACEYRKLITIQAGKPKGHLRDALKVDPEKVRRLSLSETQLAKATTSHGAEVIRFTQNNILRVYPKGTRVNSSNYDPMNAWTHGAQMVAFNMQGHDKALRLMQGFFRANGGCGYVKKPDFLLRTGPNGEVFDPKGSLPVKKTLKVKVYMGDGWRMDFSKTHFDAFSPPDFYTRVGIAGVKADTVMKKTRVIEDQWVPVWDEEFTFPLKVPELALLRIEVQEYDMSEKHDFGGQTCLPVWELKQGIRAVPLHDRKGNRYKSVRLLMRFDFF

SEQ ID NO: 10259 - DNA, 1284 bp, Sorghum bicolor
  misc_feature: Ceres ANNOT ID no. 6111846
  misc_feature: Encodes the peptide sequence at SEQ ID NO 10260
atggaggggaacggcggcgccggcacgacgaagtggagtatctccaggccgtcagcgggaacgccgctggaggccgcggggaccatgagtatccgtgcagtgctcaaccgcgtcttctcctcggtcgacgacggctcgggcccgcggccagtgctgacgctcggcagcggtgaccccaccgcctcgccctgcttcaggcctccgcccgaggccgaggacgccatagtggaggcgctccgatctgggaagcacaacgggtactcaccaacagtcggtgtcctctcggcgcgccgtgctattgcagagtacctatctcgggatctttcctatcagctttcaccagacaatatttacctcactgctggatgctgccaagctattgaggtcatcatctctgtccttgctcagcctggctccaatgtcttgcttcccaaacctgggtttccattgtacgagtcacggaccatgttcagtaatctagaggctcggcatttcaaccttattcctgaacgtggctgggaagctgaccttgagtctctggaagctcttgctgatgagaatactgttgcgatggtcattataaatcctagtaacccttgtgggagtgtatactcatatgatcatttggccaaaattgcagagactgcaaggaaacttggaataataatcatagctgacgaggtatatgaccatttggtttttggcaataagccttttataccaatgggtgtctttgcggatatagttccagtgatcaccttgggatctatatctaaaagatggcttgtgcctggttggcgacttggttggatagcaacgtgcgatctgaattgtgtgctaaaggaagctcaggttgacaaattgattgaaaactatataaatatcacaaatgatcctgcaacatttatccagggtgcagtccctcaaataatagccaacacaaaggaagattacttcaacaaaatacttaatcttttgaggaactctgcagatttatgttataataaaataaaggagactaggggcattacatgccctcacaagccagagggatcaatgtttgttatggtaaaattggatctctctttgttgcatggcatccaagatgatttggacttctgctgcaggttggcaaaagaggactctgtaatagtgttaccaggaagcgcactaggaatgaaggactggattcgtatcaatttcgctacggatgtacctactcttgagaatgcccttgaacggatcaagtccttctgccagaggcatgctaaactggaagcataa

SEQ ID NO: 10260 - protein, 427 aa, Sorghum bicolor
  misc_feature: Ceres ANNOT ID no. 6111846
  misc_feature (49)..(415): Pfam Id: Aminotran_1_2 Pfam Desc: Aminotransferase class I and II
  misc_feature (3)..(424): NCBI GI: 6498122 NCBI Desc: nicotianamine aminotransferase a [hordeum vulgare subsp. vulgare]
  misc_feature (3)..(424): NCBI GI: 6469090 NCBI Desc: nicotianamine aminotransferase [hordeum vulgare subsp. vulgare]
  misc_feature (11)..(424): NCBI GI: 6469089 NCBI Desc: nicotianamine aminotransferase [hordeum vulgare subsp. vulgare]
  misc_feature (11)..(424): NCBI GI: 6469087 NCBI Desc: nicotianamine aminotransferase b [hordeum vulgare subsp. vulgare]
  misc_feature (202)..(424): NCBI GI: 115485877 NCBI Desc: os11g0552000 [oryza sativa (japonica cultivar-group)]
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MEGNGGAGTTKWSISRPSAGTPLEAAGTMSIRAVLNRVFSSVDDGSGPRPVLTLGSGDPTASPCFRPPPEAEDAIVEALRSGKHNGYSPTVGVLSARRAIAEYLSRDLSYQLSPDNIYLTAGCCQAIEVIISVLAQPGSNVLLPKPGFPLYESRTMFSNLEARHFNLIPERGWEADLESLEALADENTVAMVIINPSNPCGSVYSYDHLAKIAETARKLGIIIIADEVYDHLVFGNKPFIPMGVFADIVPVITLGSISKRWLVPGWRLGWIATCDLNCVLKEAQVDKLIENYINITNDPATFIQGAVPQIIANTKEDYFNKILNLLRNSADLCYNKIKETRGITCPHKPEGSMFVMVKLDLSLLHGIQDDLDFCCRLAKEDSVIVLPGSALGMKDWIRINFATDVPTLENALERIKSFCQRHAKLEA

SEQ ID NO: 10261 - DNA, 366 bp, Sorghum bicolor
  misc_feature: Ceres ANNOT ID no. 6111857
  misc_feature: Encodes the peptide sequence at SEQ ID NO 10262
atgccgtgcctcaacgtgtcgaccaacgtgaacctggagggggtggacacctccgtcatcctcgccgaagcctccaagtccgtcgctaacatcatcggcaagccagaggcctacgtgatggttgtcctcaagggttcagtgcctatggcatttggaggtacccaggagccagcagcgtacggtgagctggtttccatcggaggcctgaaccctgacgtgaataagaagctgagtgctggcattgcttccatcctggagtcaaagctgtctgttcccaagtcacgcttctacctcaagttctatgactcaaaggcccatccggcacaagaacatgctcaatgtttgcatgctttgcatcaagaatag

SEQ ID NO: 10262 - protein, 121 aa, Sorghum bicolor
  misc_feature: Ceres ANNOT ID no. 6111857
  misc_feature (2)..(116): Pfam Id: MIF Pfam Desc: Macrophage migration inhibitory factor (MIF)
  misc_feature (1)..(104): NCBI GI: 115486916 NCBI Desc: os12g0107500 [oryza sativa (japonica cultivar-group)]
  misc_feature (1)..(104): NCBI GI: 20148493 NCBI Desc: light-inducible protein atls1 [arabidopsis thaliana]
  misc_feature (1)..(104): NCBI GI: 5869758 NCBI Desc: at-ls1 product [arabidopsis thaliana]
  misc_feature (1)..(104): NCBI GI: 140041566 NCBI Desc: macrophage migration inhibitory factor [medicago truncatula]
  misc_feature (1)..(102): NCBI GI: 140041567 NCBI Desc: macrophage migration inhibitory factor [medicago truncatula]
MPCLNVSTNVNLEGVDTSVILAEASKSVANIIGKPEAYVMVVLKGSVPMAFGGTQEPAAYGELVSIGGLNPDVNKKLSAGIASILESKLSVPKSRFYLKFYDSKAHPAQEHAQCLHALHQE

SEQ ID NO: 10263 - DNA, 2184 bp, Sorghum bicolor
  misc_feature: Ceres ANNOT ID no. 6111878
  misc_feature: Encodes the peptide sequence at SEQ ID NO 10264
atggtgacgagcaaatcctcgtggagccaggttgtaaaaaataccaggccgacaaacctgtccattcccacaagaaacctccaaccacaagaccttggagctgtgatatttggttgcacaaacaataccattcaagagtgtcactcacggcaactttttggcttgccaaaatcacatatttcatacgtacgaaacattaaggaaggactatctctcttcctcttcaactatgatgatcgcagattgtatggtatttacgaagctgcagggaatggcaagttctgtcctgaatcaaatgcatggtcacatgatagcaagagcaaaacaaactatcctgcccaggttgcaatgcgggtaaggctgtggtgtttcccgctagcagaggatcagttcagaaatgctattatagccaattactatcagaacacacccggtgtccctggccagaagctccattttttcaagtttgaattggatcatgctcaaacacgtgttttgatggatatgtttactccttctccccccaacaatttctggatgccccctgccgcagcaccagctgatgatcattggagagaattagtgctgtcacctggatgggcaacagagcgtgaggggaacaataacctcaaatcagaaaaggttgtaaagtcatatgctgacatagtgaagaagaataaatttgaggaagttgggacaagagatttggatgtggaacatgcaagctcaggtaatgaatcttctggtggtttcgatgaacttgattgtcaatacacatcaccagagagggaggactatgcactatcagatagggtggttccagtgcaacaacaacagtaccctgatacgcaggggaaaatgctgagctttgatcaggtgttacaagggcgcatggcttttcctggtcagcagtggcactctgatctttatgccaatactactgaaactgaagataatgatccatatagctgcaagtatgcccaagaggtcaaatttgcaattctggatgggagctctaatttgccagaaaccttagattctgaagttgataagctgtccttggggcattcgaatttgctggtgcagttattggactctgaatcatgcacagaagccaagatgattgatgtagttaaagagttatctggacgaatagaggtgatggagaagaagcaggcttggtccaacaaagaagtcaaacatttacagggggtgaatgagaggttactgaaaagaattgttgaactaaagggaacagttaagacattgaattctaaaatagatcctttgaccctagacgattcgcttaaccagtttgtagaacaatgtttgggttcagaagatgtcatttatctagttggtggttttgatggcttctcatttgtgccatcactagactccttttccccttcattggacgtagtaacacccctcaaaccaatggctgttggcaagtcatatacctcaactgttgcactagagggcaagatatttgttcttggtggtggtgatggtgcttgctggtttgatacagttgaatgttatgaccgaagccgtgatgattggtccacatgcccatcgttgactcgtgacaaggggagccttgctggggttagtgtcaatgggagaatctatgcatttggtggtggagatggaactgagtgtttctctgatgttgagatgtttgatcctactcatggaaagtggataaaaaatcaacctatgctggaaaagcgctttgctctagctggtgtagcactaaatggtgtgatttatgctgttggtggcttcaatggtgttgaatatctgagctctgctgaaagacttgatcctcgggagcctaactggaaaatgctgccaaagatgagtgcaggaaggggctgtcatacgcttacagtattctcaattggtggatacgacactggggctaaagcaatggtggctactgttgaggtgtatgagccaaggatgccgtcatggatgatggtggaacccatgaactacaccagaggataccattcttcggctgtgctcggtggctcaatattcacctttggtggggtcaaaggtgaagcagatacaatcttggatgtggtggaacgctacaaggaagggtgtggttgggtgactacggggttgaagtcgattggcaagagatgctactgctcagcgattgttctctga

SEQ ID NO: 10264 - protein, 727 aa, Sorghum bicolor
  misc_feature: Ceres ANNOT ID no. 6111878
  misc_feature (484)..(529): Pfam Id: Kelch_1 Pfam Desc: Kelch motif
  misc_feature (531)..(576): Pfam Id: Kelch_1 Pfam Desc: Kelch motif
  misc_feature (578)..(623): Pfam Id: Kelch_1 Pfam Desc: Kelch motif
  misc_feature (578)..(623): Pfam Id: Kelch_2 Pfam Desc: Kelch motif
  misc_feature (1)..(727): NCBI GI: 28812092 NCBI Desc: kelch-like protein [oryza sativa (japonica cultivar-group)]
  misc_feature (372)..(727): NCBI GI: 115462287 NCBI Desc: os05g0164900 [oryza sativa (japonica cultivar-group)]
  misc_feature (369)..(727): NCBI GI: 33243058 NCBI Desc: keap1 [oryza sativa (japonica cultivar-group)]
  misc_feature (450)..(726): NCBI GI: 29476994 NCBI Desc: klhl5 protein [homo sapiens]
  misc_feature (450)..(726): NCBI GI: 37748107 NCBI Desc: klhl5 protein [homo sapiens]
  misc_feature: The sequence is a functional homolog of SEQ ID NO. 315 in the 11/188,298 US application
  misc_feature: The sequence is a functional homolog of SEQ ID NO. 440 in the 11/188,298 US application
MVTSKSSWSQVVKNTRPTNLSIPTRNLQPQDLGAVIFGCTNNTIQECHSRQLFGLPKSHISYVRNIKEGLSLFLFNYDDRRLYGIYEAAGNGKFCPESNAWSHDSKSKTNYPAQVAMRVRLWCFPLAEDQFRNAIIANYYQNTPGVPGQKLHFFKFELDHAQTRVLMDMFTPSPPNNFWMPPAAAPADDHWRELVLSPGWATEREGNNNLKSEKVVKSYADIVKKNKFEEVGTRDLDVEHASSGNESSGGFDELDCQYTSPEREDYALSDRVVPVQQQQYPDTQGKMLSFDQVLQGRMAFPGQQWHSDLYANTTETEDNDPYSCKYAQEVKFAILDGSSNLPETLDSEVDKLSLGHSNLLVQLLDSESCTEAKMIDVVKELSGRIEVMEKKQAWSNKEVKHLQGVNERLLKRIVELKGTVKTLNSKIDPLTLDDSLNQFVEQCLGSEDVIYLVGGFDGFSFVPSLDSFSPSLDVVTPLKPMAVGKSYTSTVALEGKIFVLGGGDGACWFDTVECYDRSRDDWSTCPSLTRDKGSLAGVSVNGRIYAFGGGDGTECFSDVEMFDPTHGKWIKNQPMLEKRFALAGVALNGVIYAVGGFNGVEYLSSAERLDPREPNWKMLPKMSAGRGCHTLTVFSIGGYDTGAKAMVATVEVYEPRMPSWMMVEPMNYTRGYHSSAVLGGSIFTFGGVKGEADTILDVVERYKEGCGWVTTGLKSIGKRCYCSAIVL

SEQ ID NO: 10265 - DNA, 2061 bp, Sorghum bicolor
  misc_feature: Ceres ANNOT ID no. 6111883
  misc_feature: Encodes the peptide sequence at SEQ ID NO 10266
atggccgccgcggcatcccaccaccaccagcagcagcagcagcacaggcaccccaagcgccgccgcctcgcgctctccccctcccccacccccacccctgccgccgccgtgccgccgctcgactcgctggccgacgagcttctcttcctggtgctggaccgcgtggcgcaggccgacccgcgggcgctcaagtccttcgctttggcctcccgcgcctgccacgccgccgagtcccggcaccgccggacgctccgcccgctccgcgcggacctcctccccgccgcgctggcgcggtacccgtccgccacccgcctcgacctctccctctgcgcgcgcgtccccgacgccgccctcgcctccgccgtctccgggtcctcttcctcagcgctccgccgccgcgggcgtcgccgcgctcgtcgcgtcgtgccggggcctctgccgacctcgcacctctccaatggcgtccacctcggggacgcctcggccgccgaggtggcgcgggcgaggggcttacggaggctctcgctggcaaggtggaagccgctcaccgatatggggctcggctgcgtcgccgttgggtgtacggagctcagggagctctcgctcaagtggtgccttgggttgtcggatctgggcatccagctcctcgccctcaagtgcaggaagctcaccagcctggatctctcctacaccatgatcacaaaggatagctttcctcctatcatgaagctacccaatcttcaagagttgacactggtggggtgtattggaattgatgatgatgcctttggtagtcttggggaagaatgcagtaaatcactacaggtgcttgatctgtctcagtgtcagaatatcactgatgtgggagtttcatccatactgaagtcggtacccaatttattggaactggatctttcatactgctgtcctgttactccttgtatggtgagaagcttccagaagattcctaaactgcagaccctgaagctggaaggctgcaaattcatggcttatgcactaaaagccattggaacctcttgtgtttctttaagggagttaagcttgagcaagtgctctggagtgacggatacagaactctcttttgccgtgtcaagactaaagaacctgctgaagctggacattacttgctgtcgcaatatcactgatgtttcactagcggccataactagttcatgcagttccctcatctctctgaagatggagtcttgtagccatgtgtccagtggagcactccaactgatcgggaagcactgttctcacttggaagagttggaccttactgacagtgatttggatgacgaaggattgaaagctctttccagatgcagcaaactttcaagtctaaaagttggcatttgcttgaagataagtgatgaaggtcttacccacattggaaggtcctgcccaaaactccgcgagattgatttgtacaggtgtggaggccttagtgatgatggaattattcaaattgcacagggttgtcccaagctagagtctatgaatctatcctactgtacagaaataacagaccgttcactgatttcactttcaaaatgcacaaagctgaatactctggagattcgtggctgccccatgattacatccactgggctctcagaaatagcaatggggtgcaggctgctttccaagcttgatattaagaaatgctttgagattaatgatgcgggaatgctttacctttcccagttctctcatagcctccgtcagataaacttgtcatactgttcagtcaccgatattgggcttctttccctttctggcatatccggcttgcagaacatgaccatcgtccatttagcgggtatgacgcctaatggcttgatggctactcttatggtttgtggtggtttgacgaaagtgaagcttcatgaagcattcaaatccatggtgcctcctcatatgataaaaaatgtacaggcgcgcgggtgtgttttccagtggatcgataaaccattcaaggttgaggtggaaccttgtgatgtatggaagcaacagtcccaagatgttcttgtacgatga

SEQ ID NO: 10266 - protein, 686 aa, Sorghum bicolor
  misc_feature: Ceres ANNOT ID no. 6111883
  misc_feature (43)..(661): NCBI GI: 92879669 NCBI Desc: leucine-rich repeat; leucine-rich repeat, cysteine-containing subtype [medicago truncatula]
  misc_feature (252)..(661): NCBI GI: 144923780 NCBI Desc: leucine-rich repeat; leucine-rich repeat, cysteine-containing [medicago truncatula]
  misc_feature (325)..(665): NCBI GI: 115488994 NCBI Desc: os12g0552700 [oryza sativa (japonica cultivar-group)]
  misc_feature (43)..(642): NCBI GI: 115486415 NCBI Desc: os11g0641200 [oryza sativa (japonica cultivar-group)]
  misc_feature (43)..(638): NCBI GI: 77552216 NCBI Desc: f-box protein family, atfbl4 [oryza sativa (japonica cultivar-group)]
MAAAASHHHQQQQQHRHPKRRRLALSPSPTPTPAAAVPPLDSLADELLFLVLDRVAQADPRALKSFALASRACHAAESRHRRTLRPLRADLLPAALARYPSATRLDLSLCARVPDAALASAVSGSSSSALRRRGRRRARRVVPGPLPTSHLSNGVHLGDASAAEVARARGLRRLSLARWKPLTDMGLGCVAVGCTELRELSLKWCLGLSDLGIQLLALKCRKLTSLDLSYTMITKDSFPPIMKLPNLQELTLVGCIGIDDDAFGSLGEECSKSLQVLDLSQCQNITDVGVSSILKSVPNLLELDLSYCCPVTPCMVRSFQKIPKLQTLKLEGCKFMAYALKAIGTSCVSLRELSLSKCSGVTDTELSFAVSRLKNLLKLDITCCRNITDVSLAAITSSCSSLISLKMESCSHVSSGALQLIGKHCSHLEELDLTDSDLDDEGLKALSRCSKLSSLKVGICLKISDEGLTHIGRSCPKLREIDLYRCGGLSDDGIIQIAQGCPKLESMNLSYCTEITDRSLISLSKCTKLNTLEIRGCPMITSTGLSEIAMGCRLLSKLDIKKCFEINDAGMLYLSQFSHSLRQINLSYCSVTDIGLLSLSGISGLQNMTIVHLAGMTPNGLMATLMVCGGLTKVKLHEAFKSMVPPHMIKNVQARGCVFQWIDKPFKVEVEPCDVWKQQSQDVLVR

SEQ ID NO: 10267 - DNA, 1134 bp, Sorghum bicolor
  misc_feature: Ceres ANNOT ID no. 6111889
  misc_feature: Encodes the peptide sequence at SEQ ID NO 10268
atgggaaacatcatcaggtgcctcacgggaagagaccatggccatggtgatgatgatgattactacccctactaccgtgcagcgagcacagcctcgaggccccgctacgagctgcaggccggcgggtgggaggacgacgatgaacctgcagcagccttttggcctcgccagcagtctctaggtcccatccatggaggcgtcagcgtcacgccggcggccaccgccgcctccctggcccaggacctgcagctcaacatggaatccacgtccatgattcctgaagggttcaaacggcatgtcacatcatccaaaaaagcacaaactaattggtacaaggacatggcagaggcatacaaggatatgaaaaccccacaaaaaacacaagctgaaactgcccttaccaggatccagagagcagatttggaggatatattttcatttcacaatctgccgaccgcatcactccctctaccagactcaaaccatcaccggacaccgccaccagaggatgtgcagtttgtgctgaatactttgccggtccataacaagtgcattggagatggtgatggctttaccgcttatgttgacacagcagacccaacggagtccgcagatgtgccacgggaagtgcatgagatggtgattgcaataactcaagcacgcactgatagggattatcagacagctaatgctcttcaaagaagccttgacaaagctggatataaggtaatagacattttaggcgaagagatccttgcaaggaaatatagaatccgaatgaggggcattgatgcaccggagcttaagatgccgtatggaatggaggcaaagaaagaattaataaagctcattggtgggaaaagtgtcacaatttatgtgtatgagcaagaccaatttggacgctatgtgggtgacatctattgtgataacatgtttatccaggagcaaatgctgaagtgtggtcatgttcatcatttcaagaagtacgacaaacgcccagagtttgaaaactggcagaaagaggcaaaatctacaggcctaggactctgggcatcaaagaagccccctcagaagccatgggattggagaagaaacaaacgacatgcaagacacagtgccattccggtttactga

SEQ ID NO: 10268 - protein, 377 aa, Sorghum bicolor
  misc_feature: Ceres ANNOT ID no. 6111889
  misc_feature (234)..(352): Pfam Id: SNase Pfam Desc: Staphylococcal nuclease homologue
  misc_feature (1)..(298): NCBI GI: 115483783 NCBI Desc: os11g0109500 [oryza sativa (japonica cultivar-group)]
  misc_feature (59)..(370): NCBI GI: 60476854 NCBI Desc: ca(2+)-dependent dnase [populus tomentosa]
  misc_feature (59)..(366): NCBI GI: 14030876 NCBI Desc: nuclease [nicotiana tabacum]
  misc_feature (66)..(367): NCBI GI: 18410440 NCBI Desc: ca(2+)-dependent nuclease [arabidopsis thaliana]
  misc_feature (66)..(367): NCBI GI: 7684292 NCBI Desc: ca(2+)-dependent nuclease [arabidopsis thaliana]
  misc_feature: Useful for making plants with altered terpenoid content
  misc_feature: GREAT-hit functional homolog of the protein sequence given in SEQ ID NO 13227
MGNIIRCLTGRDHGHGDDDDYYPYYRAASTASRPRYELQAGGWEDDDEPAAAFWPRQQSLGPIHGGVSVTPAATAASLAQDLQLNMESTSMIPEGFKRHVTSSKKAQTNWYKDMAEAYKDMKTPQKTQAETALTRIQRADLEDIFSFHNLPTASLPLPDSNHHRTPPPEDVQFVLNTLPVHNKCIGDGDGFTAYVDTADPTESADVPREVHEMVIAITQARTDRDYQTANALQRSLDKAGYKVIDILGEEILARKYRIRMRGIDAPELKMPYGMEAKKELIKLIGGKSVTIYVYEQDQFGRYVGDIYCDNMFIQEQMLKCGHVHHFKKYDKRPEFENWQKEAKSTGLGLWASKKPPQKPWDWRRNKRHARHSAIPVY

SEQ ID NO: 10269 - DNA, 987 bp, Sorghum bicolor
  misc_feature: Ceres ANNOT ID no. 6111921
  misc_feature: Encodes the peptide sequence at SEQ ID NO 10270
atggctgctccatcagccccgagcggcggcagatcaggcgtcatcgctgtcctcttgcttcttgtgttgctggccggcaccggcacctcgtcggcgcagctgtgcaccagcttctactcccactcgtgtcccggcgtgtacgacgccgtcaggtcggtgttgcaggccgccatcgccagggagcagcgcatgggcgcctccatcctccgcctcttcttccacgactgcttcgtccagggctgcgacgcctcgctgctgctggatgacacgcccagtttccagggcgagaagatggccaaccccaacaacggctccgccagaggattcgaggtcatcgacgccatcaagtccgccgtcgacaaggtctgtcccggcgtcgtctcctgcgctgacatcctcgccatcgccgcaagagacagcgtcgtcatcctgggtggtccgagctgggacgtcaaggtcgggaggagggactcgaggacggcgagcttcagcggcgccaacaacaacatcccgccgccgacgtcgggcctcgtcaacctcacctcgctcttcgccgcgcaaggcctctcccaaaaggacatggtcgcgctatctggagcccacaccattggcttagcacgctgcaccaacttcagagcccacatatacaatgacaccaacatcgacggcagcttcgcaagatcaaggcaatcggtttgccctaggacctcaggttcaggtgacaataatttggcgcctctagaccttcaaaccccaactgtctttgagaacaactactacaagaaccttgtttacaagaaggggattctacactctgaccaagagctcttcaatggtggatcaaccgatgcgcaagtccaatcatacgttagtagccagagcgcgttctttgcggactttgtgactggcatgatcaaaatgggtgacatcatgccattgaccggctccaacggggagatcaggaagaactgcagaaggattaattaa

SEQ ID NO: 10270 - protein, 328 aa, Sorghum bicolor
  misc_feature: Ceres ANNOT ID no. 6111921
  misc_feature (50)..(292): Pfam Id: peroxidase Pfam Desc: Peroxidase
  misc_feature (17)..(328): NCBI GI: 5381253 NCBI Desc: peroxidase [nicotiana tabacum]
  misc_feature (15)..(328): NCBI GI: 28400794 NCBI Desc: peroxidase [asparagus officinalis]
  misc_feature (30)..(328): NCBI GI: 28400798 NCBI Desc: peroxidase [asparagus officinalis]
  misc_feature (28)..(328): NCBI GI: 28400796 NCBI Desc: peroxidase [asparagus officinalis]
  misc_feature (18)..(328): NCBI GI: 32351452 NCBI Desc: class iii peroxidase [gossypium hirsutum]
  misc_feature (15)..(328): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at1g14550
  misc_feature: Functional homolog of the protein sequence encoded by LOCUS at1g68850
  misc_feature: GREAT-hit functional homolog of the protein sequence encoded by LOCUS at5g05340
  misc_feature: Functional homolog of the protein sequence encoded by LOCUS at5g58390
  misc_feature: Functional homolog of the protein sequence encoded by LOCUS at5g58400
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated oxidative stress sensitivity
  misc_feature: Functional homolog of the protein sequence given in SEQ ID NO 13607
MAAPSAPSGGRSGVIAVLLLLVLLAGTGTSSAQLCTSFYSHSCPGVYDAVRSVLQAAIAREQRMGASILRLFFHDCFVQGCDASLLLDDTPSFQGEKMANPNNGSARGFEVIDAIKSAVDKVCPGVVSCADILAIAARDSVVILGGPSWDVKVGRRDSRTASFSGANNNIPPPTSGLVNLTSLFAAQGLSQKDMVALSGAHTIGLARCTNFRAHIYNDTNIDGSFARSRQSVCPRTSGSGDNNLAPLDLQTPTVFENNYYKNLVYKKGILHSDQELFNGGSTDAQVQSYVSSQSAFFADFVTGMIKMGDIMPLTGSNGEIRKNCRRIN

SEQ ID NO: 10271 - DNA, 1023 bp, Sorghum bicolor
  misc_feature: Ceres ANNOT ID no. 6111926
  misc_feature: Encodes the peptide sequence at SEQ ID NO 10272
atggcgccgtccaagcacgcggatgagggcgggcagctccagctcatagacgccgacagggtcgaggacgaggaggagtgcttcgagtccatcgacaagctgatttctcaggggataaatgcaggagacgtgaagaagctgcaggatgcagggatttacacttgcaatggcctaatgatgcataccaaaaagaaccttataggaatcaaaggtttatctgaagcaaaagttgataagatctgcgaagcagctgaaaaacttctgaaccagggtttcatgacaggaaatgatctccttctcaagcggaagtctgttgttcggattacaactgggagccaggcacttgatgagctgcttggcggagggattgaaacactttgcatcacagaggcattcggggagttccggtcagggaagacccagttggctcataccctatgtgtctccactcagcttccaatccacatgcatggggggaatgggaaggttgcctacattgacactgagggaacattccgacctgaacgcattgtgccaattgctgagagatttgggatggatgccaatgctgttcttgacaatatcatatatgctcgtgcatacacctatgagcaccagtacaacttgctcctgggccttgctgccaagatggctgaagaacctttcaggcttctgattgtggattctgtgattgcactattccgtgttgatttcagtggcaggggtgaacttgcagagcgtcagcaaaagctggcacagatgctgtcccgccttaccaagattgctgaggagttcaatgttgcagtgtacatcaccaaccaagtgattgctgatccaggtggcggtatgttcataactgatccaaagaaaccagcaggtggccatgtgttggcgcatgctgccaccatcagattgatgctgaggaaaggcaaaggcgagcagcgtgtctgcaagatcttcgatgctcctaaccttcctgaaggagaagttacatcaggtggaatcatggacgcaaaagactga

SEQ ID NO: 10272 - protein, 340 aa, Sorghum bicolor
  misc_feature: Ceres ANNOT ID no. 6111926
  misc_feature (84)..(339): Pfam Id: Rad51 Pfam Desc: Rad51
  misc_feature (1)..(340): NCBI GI: 21805945 NCBI Desc: dmc1 protein type b [oryza sativa (indica cultivar-group)]
  misc_feature (1)..(340): NCBI GI: 14588672 NCBI Desc: rilim15b [oryza sativa]
  misc_feature (1)..(340): NCBI GI: 21322144 NCBI Desc: dmc1 [oryza sativa (japonica cultivar-group)]
  misc_feature (1)..(340): NCBI GI: 115484153 NCBI Desc: os11g0146800 [oryza sativa (japonica cultivar-group)]
  misc_feature (1)..(340): NCBI GI: 14669856 NCBI Desc: rilim15b [oryza sativa]
MAPSKHADEGGQLQLIDADRVEDEEECFESIDKLISQGINAGDVKKLQDAGIYTCNGLMMHTKKNLIGIKGLSEAKVDKICEAAEKLLNQGFMTGNDLLLKRKSVVRITTGSQALDELLGGGIETLCITEAFGEFRSGKTQLAHTLCVSTQLPIHMHGGNGKVAYIDTEGTFRPERIVPIAERFGMDANAVLDNIIYARAYTYEHQYNLLLGLAAKMAEEPFRLLIVDSVIALFRVDFSGRGELAERQQKLAQMLSRLTKIAEEFNVAVYITNQVIADPGGGMFITDPKKPAGGHVLAHAATIRLMLRKGKGEQRVCKIFDAPNLPEGEVTSGGIMDAKD

SEQ ID NO: 10273 - DNA, 1695 bp, Sorghum bicolor
  misc_feature: Ceres ANNOT ID no. 6111927
  misc_feature: Encodes the peptide sequence at SEQ ID NO 10274
atgtcgtccaagaagaactactataaggagaagatgatgcggcggaaagaggagaaaaaagaagaaccagagacacctaggtatcgtgatcgtgctaaggagcgtcgcgaagatcagaacccagattatgaacctacagaacttggttcatttcatgcagtggcacctcctgggactgatttgaggttggcagatgcccacaagatttcaattgagaaaagcaaatatctcggaggtgatttggagcatacacatctggtcaagggcttggactatgctctacttcacaaagtacggagtgaaattgaaaagaaacctgatgcagaggatgggaaggatgcaaagtcaagggcaacaaaagaagatcaggcaatctccttccgcactgcaactgcaaagtctgtctaccaatggatcataaagcctcaaagcataattaaggagaatgaattgtttcttcctggtcggatgtcatttatttacaacatggaggagggagtaacaaatgatattccaacaactcttcataggagcaaagctgattgcccaattccagaggagatggttactgttagcgtggatggttctgtacttgacaggattgctaaaattatgacataccttcggcttggatcatcagggaaggtcttgaagaaaaagaaaaaggagagagatataaaagggaagagcaatttggcaagtggtgactatgatgagtctgtaaaaccttcccaaattaatggttctactctgaaacatcaatcagatatgccaccaccaccagctccaccccctcggaacaataatttcaatggaaaggagaaacaaccagtccctgtttcaagagcagatgatgatgacatttttgttggagatggagttgactattcagttcctaacaaggaaatgagtcagagccctgtttctgatatggatgaatccccacataaccatcagaagcagtccaatttcactgaacccatgtatggcccagtaccaccatctgaacctgctcaagcttggcaacagcagaacgggtatgatgctgttcaagcccagatggcagctgctggatatcaaggtgactggtcaagctatgtgtatgcagaacagcagttgggttatccagaacagtatgtgcagcaaagcacccaggaatacgatgtgttagctgaccctagtctatcccaggatccgaggttcatgactcaagcagacaaggatcggggtttaggttctgttttcaaacgtgatgatcaaaggcttaatcagctgagggaaaaagatgcacgggagagagatccaaattttatttcagatagttactcagagtgttatcctggttaccaggagtataataatgagattgcaggaagcgatgatgaagatgatttatcgaagatggatatgggtggacgggcgaagggccgtcttcacaggtgggactttgagactgaagaggagtgggccaagtacaacgatcagaaagaagccatgccaaaggctgccttccagtttggggtgaagatgcaggacggcaggaagaccaggaagcagaataaggaccagaagctcacgaacgacctccacaagatcaacaagatcctggctaggaagaagggcgagaaagatggggcggaagatggcggtcactatgatgatgatttacctagctcgaagaaacagcgtggctga

SEQ ID NO: 10274 - protein, 564 aa, Sorghum bicolor
  misc_feature: Ceres ANNOT ID no. 6111927
  misc_feature (5)..(222): Pfam Id: RED_N Pfam Desc: RED-like protein N-terminal region
  misc_feature (442)..(561): Pfam Id: RED_C Pfam Desc: RED-like protein C-terminal region
  misc_feature (186)..(563): NCBI GI: 115487300 NCBI Desc: os12g0143400 [oryza sativa (japonica cultivar-group)]
  misc_feature (4)..(222): NCBI GI: 119582432 NCBI Desc: ik cytokine, down-regulator of hla ii, isoform cra_a [homo sapiens]
  misc_feature (4)..(224): NCBI GI: 29179595 NCBI Desc: ik cytokine, down-regulator of hla ii [danio rerio]
  misc_feature (4)..(224): NCBI GI: 50416543 NCBI Desc: mgc83922 protein [xenopus laevis]
  misc_feature (4)..(222): NCBI GI: 51858635 NCBI Desc: similar to ik protein [rattus norvegicus]
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPDAEDGKDAKSRATKEDQAISFRTATAKSVYQWIIKPQSIIKENELFLPGRMSFIYNMEEGVTNDIPTTLHRSKADCPIPEEMVTVSVDGSVLDRIAKIMTYLRLGSSGKVLKKKKKERDIKGKSNLASGDYDESVKPSQINGSTLKHQSDMPPPPAPPPRNNNFNGKEKQPVPVSRADDDDIFVGDGVDYSVPNKEMSQSPVSDMDESPHNHQKQSNFTEPMYGPVPPSEPAQAWQQQNGYDAVQAQMAAAGYQGDWSSYVYAEQQLGYPEQYVQQSTQEYDVLADPSLSQDPRFMTQADKDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGAEDGGHYDDDLPSSKKQRG

SEQ ID NO: 10275 - DNA, 492 bp, Sorghum bicolor
  misc_feature: Ceres ANNOT ID no. 6111930
  misc_feature: Encodes the peptide sequence at SEQ ID NO 10276
atgagcctcacggcggccttccgagccgccaaaatcccgcgccctcttcccccaaagtgcggcgagccagccgccgccacctcggcctcggcgtccggggatccgccggcggtgcccgcgaagagtactaaggcgccaccgccgccgtggtgcgtgtaccttatagcctcctcccggatcccccgcacctacgtcggcgttaccaccgacttccctcgaaggttgcggcaacataatggtgagttaaaaggtggtgcaaaagctgcctctgctggaaggccttggaatctcgcatgccttgttgaaggctttgccaacagaagtgaagcctgtgagtttgaatcgaaatggaagaacatctcccgaaaaatggcacggaaacggactgagcctagcttgaagtcagtgttgcaacatcgagaggcagcattgagcagagtggaagcattcatggattgtagccacctacaaatcaaatggcagtcaagttga

SEQ ID NO: 10276 - protein, 163 aa, Sorghum bicolor
  misc_feature: Ceres ANNOT ID no. 6111930
  misc_feature (49)..(131): Pfam Id: GIY-YIG Pfam Desc: GIY-YIG catalytic domain
  misc_feature (1)..(75): NCBI GI: 115487298 NCBI Desc: os12g0143300 [oryza sativa (japonica cultivar-group)]
  misc_feature (50)..(120): NCBI GI: 7106110 NCBI Desc: spap27g11.15 [schizosaccharomyces pombe]
  misc_feature (50)..(147): NCBI GI: 66358858 NCBI Desc: holiday junction resolvase, s1x1p, uri domain nuclease [cryptosporidium parvum]
  misc_feature (50)..(147): NCBI GI: 46227695 NCBI Desc: holiday junction resolvase, s1x1p, uri domain nuclease [cryptosporidium parvum]
  misc_feature (38)..(119): NCBI GI: 119404386 NCBI Desc: giy-yig catalytic domain protein [aspergillus clavatus nrrl 1]
MSLTAAFRAAKIPRPLPPKCGEPAAATSASASGDPPAVPAKSTKAPPPPWCVYLIASSRIPRTYVGVTTDFPRRLRQHNGELKGGAKAASAGRPWNLACLVEGFANRSEACEFESKWKNISRKMARKRTEPSLKSVLQHREAALSRVEAFMDCSHLQIKWQSS

SEQ ID NO: 10277 - DNA, 2370 bp, Sorghum bicolor
  misc_feature: Ceres ANNOT ID no. 6111944
  misc_feature: Encodes the peptide sequence at SEQ ID NO 10278
atgaaacatctccccgtgccggccagccggctgtgggacgcgggcatccgcaagctccaaaacgtccgccgcgtcggcgccgtcgtgcccgccgccgcgtcgtcgggcggtggccccgttgtcgacagcgccgatgacttcacgcctagcttctccccctcggcctcgacgtccaaaaccatctaccagtacgacgacggtgacggcgacggcgaaggcgacgacgacaacggcacggagggcagtggcaacgacgacgacgacgacgacgacaacgacgccgggctcggcgagcccacccacgccgagcagccgcttgccagcggggacttctacgagggcgacctgcgcggggacctcccgcacggcacgggtaagttcctctggaccgacggcagcatctacgagggctcctggcgccgcggccgcgcctcggggcacggcaagctctcctgggcgtccggcgccacctacgagggcgacttccatggcgggtacatgcacggccagggcaccttcatcggcgagctcggggacgccttcgcggggctctgggcggggaacctccgccacggccgcggcacgcaggcgtacgccaacggggacgtgtacgacggccactggcgcgagggactgcaggacggccatgggcgctacatctggcgccacggccacgagtacatcggcgcctggagggccggcggcatgcacggctccggcaccgtcatctgggccgacggcgaccgctacgacggcgcgtgggagggcgccaggcccaggggccagggcacgttccgcttggacggcggcgggatgtacatcggcacctggcggtgggagatggagggggcgccggcggcggccgcggtgcgcgccgacggcctctactacccgccgaccggtggccccgcggtgcccatgcctcgggagccgtgcgagcccatcaccacgctgctccaggagctcgacgtgtgcgagggcaagacggcgtcgctgatgccgtcgaccaagatagtcacgtggccaggggtggaggctgtgcagaagaagccggtgcagcggcggcgcaaggtgagcgccccggctgccgacgccgacgccgaccatgggaggaggtccagcttgagcagggggagcagcacgtccttggacatggacagtctggcgctggctgaaggtgaggccggcaaggaggcgcagacggacaggtggtcatccctgctgtcctcgtcaatcatgcccacgccgccgccgaggccggggaagaagcagggggagacgataaccaaggggcacaggaactatgagctcgtgctcaacctgcaacttggcatcaggcatactgttggaaagtactcagcacctgcatcgctggatcttaaaccatcagcatttgatccaaaagagaaggtgtggacaagatttcctcctgaaggatcaaagcatactcctcctcaccaatcatgcgattttcggtggaaggactactgcccactggttttcaggactttgtgcaagctcttcggtgtcaaccctgtggattacatgaactccatctgtggggaagaggcactcagggagatttcgtctcccggaaaaagtggatgtttcttttacctaacgaatgatgacaagtacatgatcaaaacaatgaagcagtcagaagttaaagtgcttcttaggatgcttccatcctactataaacatgttcgtgcttttgaaaatactctaataactaaattttttggtctgcactctgttaaacttacaggagcggctattcagaaaaaggttcgctttgttataatggggaatcttttctgcaccaactatgcaatccataggcgcttcgatttgaaaggatcttcacaaggtcgcatgacagataaaccaattgatcagattaatgagcataccacgttgaaggaccttgacctcaatttcattttccggctgcaaggatcttggtttcaagaattctgcaggcaggtggacaaagattgtgaattactggagcaggagaggatcatggactatagtcttttggttggaattcacttcaaggacagatgcaaagatagaaaagcaccattaaaactagggatttgcatgcactcaagggtggagaatgtattgaagaatcctgacggtgaatctttgctcctgggtgatcttactggcgaaatacaggatgtcatactattttttggaatcattgatattctacaagactacgatatcagtaaaaagcttgagcatgcttacaaagccatgcaatatgatcccaattccatatcagcagttgacccaaagcaatactgcaagcgattcagagacttcatttatagggctttcacaaaagatgtatag

SEQ ID NO: 10278 - protein, 789 aa, Sorghum bicolor
  misc_feature: Ceres ANNOT ID no. 6111944
  misc_feature (517)..(785): Pfam Id: PIP5K Pfam Desc: Phosphatidylinositol-4-phosphate 5-Kinase
  misc_feature (112)..(134): Pfam Id: MORN Pfam Desc: MORN repeat
  misc_feature (135)..(157): Pfam Id: MORN Pfam Desc: MORN repeat
  misc_feature (158)..(180): Pfam Id: MORN Pfam Desc: MORN repeat
  misc_feature (181)..(203): Pfam Id: MORN Pfam Desc: MORN repeat
  misc_feature (204)..(226): Pfam Id: MORN Pfam Desc: MORN repeat
  misc_feature (227)..(249): Pfam Id: MORN Pfam Desc: MORN repeat
  misc_feature (75)..(688): NCBI GI: 33354203 NCBI Desc: phosphatidylinositol-4-phosphate 5-kinase-like protein [oryza sativa (japonica cultivar-group)]
  misc_feature (75)..(693): NCBI GI: 87162536 NCBI Desc: phosphatidylinositol-4-phosphate 5-kinase [medicago truncatula]
  misc_feature (422)..(732): NCBI GI: 9280673 NCBI Desc: f2e2.1 [arabidopsis thaliana]
  misc_feature (422)..(732): NCBI GI: 3702691 NCBI Desc: atpip5k1 [arabidopsis thaliana]
  misc_feature (422)..(689): NCBI GI: 140065036 NCBI Desc: phosphatidylinositol-4-phosphate 5-kinase [medicago truncatula]
  misc_feature (76)..(689): SWISSPROT Homolog: EC 2.7.1.68 Phosphatidylinositol-4-phosphate 5-kinase 5
MKHLPVPASRLWDAGIRKLQNVRRVGAVVPAAASSGGGPVVDSADDFTPSFSPSASTSKTIYQYDDGDGDGEGDDDNGTEGSGNDDDDDDDNDAGLGEPTHAEQPLASGDFYEGDLRGDLPHGTGKFLWTDGSIYEGSWRRGRASGHGKLSWASGATYEGDFHGGYMHGQGTFIGELGDAFAGLWAGNLRHGRGTQAYANGDVYDGHWREGLQDGHGRYIWRHGHEYIGAWRAGGMHGSGTVIWADGDRYDGAWEGARPRGQGTFRLDGGGMYIGTWRWEMEGAPAAAAVRADGLYYPPTGGPAVPMPREPCEPITTLLQELDVCEGKTASLMPSTKIVTWPGVEAVQKKPVQRRRKVSAPAADADADHGRRSSLSRGSSTSLDMDSLALAEGEAGKEAQTDRWSSLLSSSIMPTPPPRPGKKQGETITKGHRNYELVLNLQLGIRHTVGKYSAPASLDLKPSAFDPKEKVWTRFPPEGSKHTPPHQSCDFRWKDYCPLVFRTLCKLFGVNPVDYMNSICGEEALREISSPGKSGCFFYLTNDDKYMIKTMKQSEVKVLLRMLPSYYKHVRAFENTLITKFFGLHSVKLTGAAIQKKVRFVIMGNLFCTNYAIHRRFDLKGSSQGRMTDKPIDQINEHTTLKDLDLNFIFRLQGSWFQEFCRQVDKDCELLEQERIMDYSLLVGIHFKDRCKDRKAPLKLGICMHSRVENVLKNPDGESLLLGDLTGEIQDVILFFGIIDILQDYDISKKLEHAYKAMQYDPNSISAVDPKQYCKRFRDFIYRAFTKDV

SEQ ID NO: 10279 - DNA, 711 bp, Sorghum bicolor
  misc_feature: Ceres ANNOT ID no. 6111951
  misc_feature: Encodes the peptide sequence at SEQ ID NO 10280
atgccaacaaacccaagcacacacacctccagccttccttcttctacaactcttgcttcctgcagctctactctcttgtttcgatcggccatggcggcggcggcggcggcggcggtggccacagagactccgttccatgtcctggcggtggacgacagtctcccggacaggaagctcatcgagaggctcctcaagacctcttccttccaagtgaccactgtcgactcagggagcaaggcgctgcagttcctgggactccatgacgaccacagccctgttcctgtccacacagaccagctggatgtggcagtgaacctgatcatcacagactactgcatgcccggcatgacaggatatgacctgctcaagaagatcaaggagtcgtcgtctctcagagatatcccagtggtgatcatgtcctctgagaacattccttcaaggatcaataggtgcctggaggaaggagctgatgagtttttcctaaaaccagtacggctatcagacatgaacaagctcaagccccacatactgaaaagcagatgcagagagcacaatcaccaggaacagctccagcaaagtgacagcaacagcgaggaatgcagtaatcccacgagcagcagcagcagcagcggtagcagcagcaaccgcaagagaaagggagcagacaacgaagaaatcttgccccaggcaaacagatcaaggcatagttag

SEQ ID NO: 10280 - protein, 236 aa, Sorghum bicolor
  misc_feature: Ceres ANNOT ID no. 6111951
  misc_feature (45)..(173): Pfam Id: Response_reg Pfam Desc: Response regulator receiver domain
  misc_feature (1)..(236): NCBI GI: 12060388 NCBI Desc: response regulator 6 [zea mays]
  misc_feature (38)..(236): NCBI GI: 71273491 NCBI Desc: type a response regulator 9 [oryza sativa (indica cultivar-group)]
  misc_feature (29)..(236): NCBI GI: 115487262 NCBI Desc: os12g0139400 [oryza sativa (japonica cultivar-group)]
  misc_feature (40)..(236): NCBI GI: 109631210 NCBI Desc: srr197 [striga asiatica]
  misc_feature (40)..(236): NCBI GI: 109631202 NCBI Desc: srr217 [striga asiatica]
  misc_feature: The sequence is a functional homolog of SEQ ID NO 932 in the 10/666,642US patent application
  misc_feature: The sequence is a functional homolog of SEQ ID NO 936 in the 10/666,642US patent application
  misc_feature: Useful for making plants with altered Lignin content
  misc_feature: Useful for making plants with altered carotene content
  misc_feature: Useful for making plants with altered terpenoid content
  misc_feature: Useful for making plants with modulated biomass
  misc_feature: Useful for making plants with modulated growth and phenotype characteristics
  misc_feature: Useful for making plants with modulated heat sensitivity
  misc_feature: Useful for making plants with modulated low light sensitivity
  misc_feature: Functional homolog of the protein sequence given in SEQ ID NO 13290
  misc_feature: Functional homolog of the protein sequence given in SEQ ID NO 13292
  misc_feature: GREAT-hit functional homolog of the protein sequence given in SEQ ID NO 13434
  misc_feature: GREAT-hit functional homolog of the protein sequence given in SEQ ID NO 13463
  misc_feature: The sequence is a functional homolog of SEQ ID NO 932 in the 20070033671 US patent application
  misc_feature: The sequence is a functional homolog of SEQ ID NO 936 in the 20070033671 US patent application
  misc_feature: Useful for making plants with altered carotene content
  misc_feature: Useful for making plants with altered lignin content
  misc_feature: Useful for making plants with altered terpenoid content
  misc_feature: Functional homolog of the protein sequence given in SEQ ID NO 13463
  misc_feature: Useful for making plants with modulated low light sensitivity
  misc_feature: Useful for making plants with modulated nitrogen use efficiency
  misc_feature: Functional homolog of the protein sequence given in SEQ ID NO 13599
  misc_feature: The sequence is a functional homolog of SEQ ID NO 932 in the 10/666,642 US patent application
  misc_feature: The sequence is a functional homolog of SEQ ID NO. 378 in the 11/188,298 US application
MPTNPSTHTSSLPSSTTLASCSSTLLFRSAMAAAAAAAVATETPFHVLAVDDSLPDRKLIERLLKTSSFQVTTVDSGSKALQFLGLHDDHSPVPVHTDQLDVAVNLIITDYCMPGMTGYDLLKKIKESSSLRDIPVVIMSSENIPSRINRCLEEGADEFFLKPVRLSDMNKLKPHILKSRCREHNHQEQLQQSDSNSEECSNPTSSSSSSGSSSNRKRKGADNEEILPQANRSRHS

SEQ ID NO: 10281 - DNA, 1902 bp, Sorghum bicolor
  misc_feature: Ceres ANNOT ID no. 6111954
  misc_feature: Encodes the peptide sequence at SEQ ID NO 10282
atggcgtcctcgctgctctcctcccccgctaaacctttctgctccaccaccaaaacgacccccgcaccaaaagccacccgctttccatccccaagattcctctcctccgcccatgtcctctccgccgcgcgccgcctccgtgcggtctccgcccgagcgtcgcagcagcagcctccgccgccgcgggggcagcagcagcggcggccggagtacgtcccgaaccgcatcgacgacccaaactacgtgcgaatcttcgacaccacgctgcgcgacggggagcagtccccgggcgccacgatgacgagcgcgcagaagctcgtcgtcgcgcgccagctggcccgcctcggcgtcgacatcatcgaggccgggttcccggcttcctcccccgacgacctcgacgccgtgcgctccatcgccatcgaggtcggcaaccccgcacccgccggggacgacggtggcgccgacgccacgcacgtgccggtcatctgtggcctctcgcggtgcaacaggaaggacatcgacgcggcgtgggaggccgtgcgccacgcgcgacggccccggatccacaccttcatcgccaccagcgacatccacatgcagcataagctcaggaagacccccgagcaggtggcggccattgccagggacatggtggcctacgcccgcagcctcggatgcactgacgtcgagttcagccccgaggacgccggcaggtcaaatagagagttcttgtatcatattctaggggaagtcataaaagctggagctacaactctcaatatcccggacactgtcggatacaatcttccttatgaatttgggaagttaattgctgatataaaggcaaacactcctggaattgaaaatgctatcatttcaactcattgccagaatgaccttggtcttgcgactgccaacactttagcgggcgctcgtgcaggggcacgacaattagaggttactattaatggtattggtgaaagagctggaaatgcttctttggaggaggttgtcatggcaattaaatgccgcagagaactgttaaatggtctctatactggaatcgattctcggcatatcactttgacgagcaaaatggtacaagagcatagtggactgatcgtacaaccacataaagctattgttggtgccaatgcatttgctcatgaaagtggaattcatcaggatggcatgcttaaaaacaaaggaacttatgaaattatatcgcctgatgatattggtttgacacgtgcaaacgaatttggtattgttcttgggaaactcagtggaaggcatgctgtgagatctaagctagtggagcttggatatgaaatcggtgacaaggaatttgaggacttctttaaacgctacaaagaggttgcagagaagaaaaagcgtgtaactgatgaagacttagaagcgttattgtcagatgagatattccagcctaagcttatttggtcccttgctgatgtacaggcaacatgcggtacacttagtttatctacggcaacggtgaaattgataggaccagatggagaggagagaatagcatgttcagtcggaacaggtccagtcgatgcagcttacaaggctgttgaccaaataatccagattccaaccgttctacgagaatatagcatgacatcagtcacagaaggcattgacgcaattgcaacaactcgagttgttgtcactggagatgtgagcatcaacgccaaacatgccttgactggccgctctttcaaccgctccttcagtgggagcggggcatccatggacattgtggtgtccagcgtcagagcttacctgagcgccctgaacaagatttgcagttttgctggcgccgtgaaagccagcagcgaggtacctgagatcgcaagcgttccgagcacagaatga

SEQ ID NO: 10282 - protein, 633 aa, Sorghum bicolor
  misc_feature: Ceres ANNOT ID no. 6111954
  misc_feature (90)..(373): Pfam Id: HMGL-like Pfam Desc: HMGL-like
  misc_feature (466)..(611): Pfam Id: LeuA_dimer Pfam Desc: LeuA allosteric (dimerisation) domain
  misc_feature (1)..(633): NCBI GI: 77548611 NCBI Desc: 2-isopropylmalate synthase [oryza sativa (japonica cultivar-group)]
  misc_feature (1)..(633): NCBI GI: 115484117 NCBI Desc: os11g0142500 [oryza sativa (japonica cultivar-group)]
  misc_feature (1)..(613): NCBI GI: 75707983 NCBI Desc: 2-isopropylmalate synthase 1 [brassica insularis]
  misc_feature (67)..(625): NCBI GI: 2213882 NCBI Desc: 2-isopropylmalate synthase [lycopersicon pennellii]
  misc_feature (1)..(441): NCBI GI: 6714306 NCBI Desc: f15h18.3 [arabidopsis thaliana]
  misc_feature (67)..(625): SWISSPROT Homolog: EC 2.3.3.13 2-isopropylmalate synthase A
MASSLLSSPAKPFCSTTKTTPAPKATRFPSPRFLSSAHVLSAARRLRAVSARASQQQPPPPRGQQQRRPEYVPNRIDDPNYVRIFDTTLRDGEQSPGATMTSAQKLVVARQLARLGVDIIEAGFPASSPDDLDAVRSIAIEVGNPAPAGDDGGADATHVPVICGLSRCNRKDIDAAWEAVRHARRPRIHTFIATSDIHMQHKLRKTPEQVAAIARDMVAYARSLGCTDVEFSPEDAGRSNREFLYHILGEVIKAGATTLNIPDTVGYNLPYEFGKLIADIKANTPGIENAIISTHCQNDLGLATANTLAGARAGARQLEVTINGIGERAGNASLEEVVMAIKCRRELLNGLYTGIDSRHITLTSKMVQEHSGLIVQPHKAIVGANAFAHESGIHQDGMLKNKGTYEIISPDDIGLTRANEFGIVLGKLSGRHAVRSKLVELGYEIGDKEFEDFFKRYKEVAEKKKRVTDEDLEALLSDEIFQPKLIWSLADVQATCGTLSLSTATVKLIGPDGEERIACSVGTGPVDAAYKAVDQIIQIPTVLREYSMTSVTEGIDAIATTRVVVTGDVSINAKHALTGRSFNRSFSGSGASMDIVVSSVRAYLSALNKICSFAGAVKASSEVPEIASVPSTE

SEQ ID NO: 10283 - DNA, 2733 bp, Sorghum bicolor
  misc_feature: Ceres ANNOT ID no. 6111960
  misc_feature: Encodes the peptide sequence at SEQ ID NO 10284
atgatgtgtatgccatctgtgcgggatcaggtgcggcttgtcccggctctgtatcagtgcgcaacacatgtaagcgagggatccatcggaaagactaacgatagtcttagtgagataaaaaggctctcctccatagttgatgggccgctgcagcgtctctcccagattatggctgacagcctagctcgccgtcttctcttctcttgtgagggccttactggttccctcattcatccatctgactactttgagcagtcgagcattcagtctgctcgctataactttgctagcctcagtccctacctcaacactggctttgctactatcaaccgggccatccttgaagcaatggaggttgaaaaggttgtccgcattatcgacttgtcctgctcagcctcccacccacgtcagtggctcaagctccttcatggcttccatgggcgcccaggagggccacctgaagtacgccttacagttgtccacgatgacaatgactttctggccaacatgagggcattgctatctaaggaagctgatatgctcaaaatcccgttccagtttaatgatgtaaatggcaggcttgagaccttggacttcagtaacctccgtagtgtcctagggataaaatatggtgaagcgattgcgatcagctgttctctacagctgcatcgcctgctcgtggttgatgacaatgccagctgttccgctattgatcagctccagaaaatggcaaacgctgcgcagcttaagcagatggctagctcagtgtacagcccagcttccatactgaactatccacgaacaccgtcccctcttttgttggcaagcttcctcaatgccatccatacgctcaaaccaaacatcatgctggtgatggagcaagatgcaaaccacaacgccttgttgttctccgaccggtttgttgaggcacttaactattatgcagccctctttgacagcttcaatgcaatggctgccaccaactcgcaaagggccaatgagcgggcacaagtagaaaggatgatcctgggggaagagatcaagaacatattactgtgtgaaggagtcaatcggcatgagcgacacgagacgctgagccagtgggcaatgtacatggatacatcagggtttcaccatgttccgctcagcttcggtgccattagggagggtgaactgaagctcatgagcttcgggttgaatggatgtcagtaccaggaggacacgctgtcgtcggcgacgtcgtcgccggcgtcgtcgctgtacacgccgtcgccgcacggtcatggcgggctcgggtcgtcgtgggtgcaggagctgagccatgaccagcagggcctgcgcctcatcaacctgctgtaccagtgcgcggcggaggtggcggcgggcgccttcgaccgcgccaacttctacctggagcagatcacgcagctggcgtcgctggacgcgccgcacacgctgcagcggctcgccgccgtcttcgccgacgcgctggcgcggaagctgctcaacctggtccccggcctgtcgcgggcgctgctgtccacggggggcaactccggcgaggcgcacctggtgcccgccgcgcggcgccacctcttcgacgtgctgccgttcatgaagctggcgtacctgaccaccaaccacgccatcctggaggcgatggaaggggagaggttcgtgcacgtcgtcgacctctccggccccgccgccaacccggtgcagtggatcgctctgttccacgccttccgcggccgccgcggcgggccaccgcacctccgcgtcacggccgtgcacgacggcagggagtttctggccaacatggccgccgtgctcgccaaggaggccgaggcgttcgacatcccgttccagttcagcgccgtggaagccaagctggaggagctggacaccgacgcgctccggcacgtcctccgcgtgcggtccggcgaggcgctcgccgtcagcgttgtcgggcaactgcaccgcctcctggcggtcgacgacgccggtggcaggaacagcagacatgtcccgggcagcagctgcctcaccccggtgcagatcatcgcgcggtccagcccaagcagcttcggcgagctgctggaccgggagctcaacacgcggctgcagctgagcccggactcgtcggcagtgctctccatgtcgccgcagtcgtcgtcgctgtcgccggcgcatcagcaacagcagcagagggaaaaggcaaagctggggagcttcctgcgcgcggtgcgggcgctgtcgccgacgctcatggtggtggcggagccggaggcgaaccacaacgcggcgacgttcctggagcggttcgaggaggcgctcaactactacgcgtcgctgttcgactgcctggagcgcgcgtcggcggcgcaggcgcaccggtgcgccggggagcgggcgcgcgccgagcggctggtgctcggggaggagatccgcggcgtggtggcgcgggagggcgcggagaggaaggagcggcacgagcggctggcgcagtgggcgcgacggatggaggccgccgggatggagcgcgtcgggctcagctacgccggcatgatggaggcgaggaagctgctgcagagctgcggctggggcggcggggactacgcgtaccaggtggcccacgacgccggcggcgaggccttcttcttctgctggcaccgcaagccgctctactccgtctccgcctggaggccggcggcggcgtgccggcacacctag

SEQ ID NO: 10284 - protein, 910 aa, Sorghum bicolor
  misc_feature: Ceres ANNOT ID no. 6111960
  misc_feature (3)..(333): Pfam Id: GRAS Pfam Desc: GRAS family transcription factor
  misc_feature (423)..(797): Pfam Id: GRAS Pfam Desc: GRAS family transcription factor
  misc_feature (390)..(910): NCBI GI: 77552978 NCBI Desc: scarecrow-like 3 protein [oryza sativa (japonica cultivar-group)]
  misc_feature (406)..(684): NCBI GI: 115442223 NCBI Desc: os01g0948200 [oryza sativa (japonica cultivar-group)]
  misc_feature (116)..(408): NCBI GI: 4580515 NCBI Desc: scarecrow-like 3 [arabidopsis thaliana]
  misc_feature (413)..(663): NCBI GI: 60656559 NCBI Desc: della protein [brassica rapa]
  misc_feature (742)..(905): NCBI GI: 115184074 NCBI Desc: dwarf plant9 [zea mays]
  misc_feature: The sequence is a functional homolog of SEQ ID NO 110 in the 10/225,068US patent application
  misc_feature: The sequence is a functional homolog of SEQ ID NO 1254 in the 10/374,780US patent application
  misc_feature: The sequence is a functional homolog of SEQ ID NO 1255 in the 10/374,780US patent application
  misc_feature: The sequence is a functional homolog of SEQ ID NO 1256 in the 10/374,780US patent application
  misc_feature: The sequence is a functional homolog of SEQ ID NO 1257 in the 10/374,780US patent application
  misc_feature: The sequence is a functional homolog of SEQ ID NO 190 in the 10/374,780US patent application
  misc_feature: The sequence is a functional homolog of SEQ ID NO 212 in the 10/714,887US patent application
  misc_feature: The sequence is a functional homolog of SEQ ID NO 212 in the 11/435,388US patent application
  misc_feature: The sequence is a functional homolog of SEQ ID NO 214 in the 10/714,887US patent application
  misc_feature: The sequence is a functional homolog of SEQ ID NO 214 in the 11/435,388US patent application
  misc_feature: The sequence is a functional homolog of SEQ ID NO 216 in the 10/714,887US patent application
  misc_feature: The sequence is a functional homolog of SEQ ID NO 216 in the 11/435,388US patent application
  misc_feature: The sequence is a functional homolog of SEQ ID NO 218 in the 10/714,887US patent application
  misc_feature: The sequence is a functional homolog of SEQ ID NO 218 in the 11/435,388US patent application
  misc_feature: The sequence is a functional homolog of SEQ ID NO 220 in the 10/225,066US patent application
  misc_feature: The sequence is a functional homolog of SEQ ID NO 220 in the 10/714,887US patent application
  misc_feature: The sequence is a functional homolog of SEQ ID NO 220 in the 11/435,388US patent application
  misc_feature: The sequence is a functional homolog of SEQ ID NO 222 in the 10/714,887US patent application
  misc_feature: The sequence is a functional homolog of SEQ ID NO 222 in the 11/435,388US patent application
  misc_feature: The sequence is a functional homolog of SEQ ID NO 4 in the 10/714,887US patent application
  misc_feature: The sequence is a functional homolog of SEQ ID NO 4 in the 11/435,388US patent application
  misc_feature: Useful for making plants with modulated growth and phenotype characteristics
  misc_feature: The sequence is a functional homolog of SEQ ID NO 110 in the 20050120408 US patent application
  misc_feature: The sequence is a functional homolog of SEQ ID NO 212 in the 20060015972 US patent application
  misc_feature: The sequence is a functional homolog of SEQ ID NO 214 in the 20060015972 US patent application
  misc_feature: The sequence is a functional homolog of SEQ ID NO 216 in the 20060015972 US patent application
  misc_feature: The sequence is a functional homolog of SEQ ID NO 218 in the 20060015972 US patent application
  misc_feature: The sequence is a functional homolog of SEQ ID NO 220 in the 20060015972 US patent application
  misc_feature: The sequence is a functional homolog of SEQ ID NO 222 in the 20060015972 US patent application
  misc_feature: The sequence is a functional homolog of SEQ ID NO 1254 in the 20060162006 US patent application
  misc_feature: The sequence is a functional homolog of SEQ ID NO 1255 in the 20060162006 US patent application
  misc_feature: The sequence is a functional homolog of SEQ ID NO 1254 in the 10/374,780 US patent application
  misc_feature: The sequence is a functional homolog of SEQ ID NO 218 in the 10/714,887 US patent application
  misc_feature: The sequence is a functional homolog of SEQ ID NO 218 in the 11/435,388 US patent application
MMCMPSVRDQVRLVPALYQCATHVSEGSIGKTNDSLSEIKRLSSIVDGPLQRLSQIMADSLARRLLFSCEGLTGSLIHPSDYFEQSSIQSARYNFASLSPYLNTGFATINRAILEAMEVEKVVRIIDLSCSASHPRQWLKLLHGFHGRPGGPPEVRLTVVHDDNDFLANMRALLSKEADMLKIPFQFNDVNGRLETLDFSNLRSVLGIKYGEAIAISCSLQLHRLLVVDDNASCSAIDQLQKMANAAQLKQMASSVYSPASILNYPRTPSPLLLASFLNAIHTLKPNIMLVMEQDANHNALLFSDRFVEALNYYAALFDSFNAMAATNSQRANERAQVERMILGEEIKNILLCEGVNRHERHETLSQWAMYMDTSGFHHVPLSFGAIREGELKLMSFGLNGCQYQEDTLSSATSSPASSLYTPSPHGHGGLGSSWVQELSHDQQGLRLINLLYQCAAEVAAGAFDRANFYLEQITQLASLDAPHTLQRLAAVFADALARKLLNLVPGLSRALLSTGGNSGEAHLVPAARRHLFDVLPFMKLAYLTTNHAILEAMEGERFVHVVDLSGPAANPVQWIALFHAFRGRRGGPPHLRVTAVHDGREFLANMAAVLAKEAEAFDIPFQFSAVEAKLEELDTDALRHVLRVRSGEALAVSVVGQLHRLLAVDDAGGRNSRHVPGSSCLTPVQIIARSSPSSFGELLDRELNTRLQLSPDSSAVLSMSPQSSSLSPAHQQQQQREKAKLGSFLRAVRALSPTLMVVAEPEANHNAATFLERFEEALNYYASLFDCLERASAAQAHRCAGERARAERLVLGEEIRGVVAREGAERKERHERLAQWARRMEAAGMERVGLSYAGMMEARKLLQSCGWGGGDYAYQVAHDAGGEAFFFCWHRKPLYSVSAWRPAAACRHT

SEQ ID NO: 10285 - DNA, 1152 bp, Sorghum bicolor
  misc_feature: Ceres ANNOT ID no. 6111970
  misc_feature: Encodes the peptide sequence at SEQ ID NO 10286
atgatgcttggaaatcagatggtgagcccagcggtggccttcagtaaggttcgtcagacgcagcgcgccgatggcctcgcatcagtcctttcgattgggacggccgtcccgcctaactgcgttttgcaagaagaatacgcagattactacttccatgtcacccagaccttgcaccaccgcatcggcctgaaagagaagctgcataaattatgtcagaacacaggtataaagaaacgctacttctatcacacggaggaaatgatccaaggtcatccggagtttctgaaccgtgcgtcaccgtcgctagacgctcggatggacattttggccaccgccgtccctgagctagcgtcggcagctgcagccaaggcgatcgccgagtggggacggccggcggcggagatcacccacctcatcgtcagcacctactcctccggagggcacatgccgggcgccgacttccgcctggcgacactcctcggcctgccctcgtcggtgcagcgcaccatgctctacatgtacggctgcaccggcacctccgcggcgctccgtgcggccaaggacatcgccgagaacaacggcggcgcgcgcgtcctcgtggcgtgcgcggacctcacgctcatgctgttccgcgcgcccgacgaggcgcgcaacgagaccttaaagatgcagtccatgtttagcgacggcgcgggcgccgtcgtggtcggcgccgaagcgcagccaaagtttgagctggtgtcggcgtcgcaggctatggcgccggcgggagaactcgacggtggcgtcggccagctacgggagaacggcctcctgttccacccgtcgaggaacatccccgccgtgatccatgagaacttggagcgatgggtgtctgacgcggtggcgccgcttggcattagcccgagtgactggaacgagctgttttttgcacgtcgaggacgcgctggactggagctgaggcccggcaagctcgcggcaagccgcagggtgttggccgagtatggcaacatgtctgggccgtcgctagtttttgttctgcaggagctccagcgctccaagacggatagagaaataggggtgatgctaggtcttggaccaggactggatgttgaggccatggtgttgcgcgccacgggcaaacactactag

SEQ ID NO: 10286 - protein, 383 aa, Sorghum bicolor
  misc_feature: Ceres ANNOT ID no. 6111970
  misc_feature (12)..(240): Pfam Id: Chal_sti_synt_N Pfam Desc: Chalcone and stilbene synthases, N-terminal domain
  misc_feature (245)..(380): Pfam Id: Chal_sti_synt_C Pfam Desc: Chalcone and stilbene synthases, C-terminal domain
  misc_feature (7)..(378): NCBI GI: 115472461 NCBI Desc: os07g0525900 [oryza sativa (japonica cultivar-group)]
  misc_feature (12)..(356): NCBI GI: 11096319 NCBI Desc: chalcone synthase [hypericum androsaemum]
  misc_feature (12)..(356): NCBI GI: 121622038 NCBI Desc: aromatic polyketide synthase [hypericum hookerianum]
  misc_feature (11)..(370): NCBI GI: 2253119 NCBI Desc: chalcone synthase [bromheadia finlaysoniana]
  misc_feature (12)..(370): NCBI GI: 4191255 NCBI Desc: chalcone synthase [casuarina glauca]
MMLGNQMVSPAVAFSKVRQTQRADGLASVLSIGTAVPPNCVLQEEYADYYFHVTQTLHHRIGLKEKLHKLCQNTGIKKRYFYHTEEMIQGHPEFLNRASPSLDARMDILATAVPELASAAAAKAIAEWGRPAAEITHLIVSTYSSGGHMPGADFRLATLLGLPSSVQRTMLYMYGCTGTSAALRAAKDIAENNGGARVLVACADLTLMLFRAPDEARNETLKMQSMFSDGAGAVVVGAEAQPKFELVSASQAMAPAGELDGGVGQLRENGLLFHPSRNIPAVIHENLERWVSDAVAPLGISPSDWNELFFARRGRAGLELRPGKLAASRRVLAEYGNMSGPSLVFVLQELQRSKTDREIGVMLGLGPGLDVEAMVLRATGKHY

SEQ ID NO: 10287 - DNA, 3072 bp, Sorghum bicolor
  misc_feature: Ceres ANNOT ID no. 6111975
  misc_feature: Encodes the peptide sequence at SEQ ID NO 10288
atggagtggctggagaagaacctgcaggagaagttcgacctgccgcccaagaaccgctccgaggaggccctgcgccgatggcgcgacgccgtctccgtcgtcaagaacccgcgccgccgcttccgcatggtcgccgacctcgaaaagatccgggtcgccctctatgtgcagcaggctgcgctcaatttcatcgatggtgtcaaacataaagactaccggctaactgatgatattatcaaggctgggttttccatcaacccagatgagctggcgtcgatcacaagcaaacatgatatgaaagttttgaagatgcatggtggggtagatgggatatccacaaaagtacgttcatcatttgaccatggcatatctgctagcaacttggatactaggcaaaccatctatggtgaaaatcgctacacggaaaaacctccaagaagtttctggatgtttgtctgggatgcgttgcaggacatgactcttatcatccttatggtatgtgctctgctatctgctgtagttggtctggcatctgaaggctggcccaagggcatgtatgatggcctgggaataatactcagcattctgttggttgtgatggttactgctgtcagtgactacaggcagtcgcttcagttcaaggagctagacaatgagaagaagaagatatttatccatgtaaccagggacggctgtcggcagaagatctctatatatgacttggtagttggtgatattgtgcacctgtcaattggagaccaagtgcctgctgatggactgtacattcatggatattcccttttgattgatgaatccagcttgtcaggtgagagtgagccagtttatatttctcaagataagccattcatcttggcaggaactaaagtccaagatggatcagctaagatgctggtaactgctgttggcatgcgcactgaatggggaaggctgatgagcacgttgagtgaaggaggggaggatgagacaccattgcaggttaagctcaacggagttgcaaccatcatcgggaaaattggcctgctgtttgccacattaacatttgttgtcctgatggttagattccttattgagaaaggtttgacagttggtctgtccaagtggtactctacagatgcattgactatcgtaaactactttgcaacagcagtcactattattgttgttgctgtccctgaagggctgcctctagctgttactttgagtctggcatttgcaatgaaaaagctaatgaatgataaagcacttgtaagacatctttcagcatgtgagacaatgggatctgctggtactatatgcactgataaaactggaactttgactaccaaccatatggtggttgacaagatatggatatctgaggtttcaaagtcacttaccagtaacaacagtttggaagatctgaattctgccatttctccagccacattgagcctacttctgcagggcatttttgagaacactagttcagaggtagtcaaagacaaggatggtgggcaaactgttttgggaaccccaacagagagggcaatcttagaatttggattgaaactagaaggacatcatgatgctgaagataggagctgcaccaaggttaaggttgaacctttcaattcagtgaagaagaagatggcagtgttggtctcattacccaatggcaaataccgttggtacaccaaaggtgcatcagaaattattgtgcaaatgtgtgacatgatgattgatggcgatggaaacagtgttcccttgtcggaagctcagaggaagaacgtcttgggtactatcaactcttttgcttcagatgctttaaggacattgtgcctggcatataaggaaggggatgatttcagtgatgatacagatagtccaacaggcggttttactctaatatctatttttggaatcaaggatcctgtgcgcccaggagtcaaggaagctgttgaggcctgtatgtctgctggtatcatagtacgaatggtgactggtgacaatatcaatacagctaaagctatagccaaagagtgtggaatactgactgatggtggcatagcaatagaaggaccagaattccgaaacaaaagcccagaggagatgagggacctgatacctaagattcaggttatggctcgttctttaccacttgacaagcatacccttgttacaaacttgcgaggtatgttcaaggaggtggttgctgttacaggcgatggtacgaatgatgctccagcattgcatgaagcagatattgggcttgcaatgggtatagcaggaacagaggtagccaaggagagtgctgatgtgatagtgcttgatgataattttacaactataataaacgtcgcaaggtggggtcgtgcagtttacataaacattcagaagtttgtgcagtttcagttgactgtcaatattgttgctttggtcatcaactttgtctcagcatgtattacaggaagtgctcctctcacagcagtgcaattgttgtgggtcaatatgatcatggatacattaggagctttagctctagcaacagagcctccaaacgatgacatgatgaagaggccacctgttgggcgaggagagagtttcattaccaaagtcatgtggcgaaatatcattgggcaaagtttatatcagttggctgtacttggagctctcatgtttggcggggaacgtcttctgaacctcaagggtgcagattccaaatctgttatcaatacactcatattcaactcctttgtgttctgccaggtgttcaatgaaataaacagcagggaaatgcagaagatcaatgttttccgtggcatgttcagcaactggatcttcattggaatcatagctgtgacagcagctttccaagtggtgatcatcgaattcctcggcacctttgccagcaccgttccacttagctggcagctgtggctggtaagcgtcggtctcggatccatcagcttgatcgtcggtgtcatcctaaagtgcataccagttaaatcagatggaactcgcgcgagtccaaatgggtacgcaccgcttcccagcggtcctgataacatatag

SEQ ID NO: 10288 - protein, 1023 aa, Sorghum bicolor
  misc_feature: Ceres ANNOT ID no. 6111975
  misc_feature (190)..(431): Pfam Id: E1-E2_ATPase Pfam Desc: E1-E2 ATPase
  misc_feature (859)..(1003): Pfam Id: Cation_ATPase_C Pfam Desc: Cation transporting ATPase, C-terminus
  misc_feature (435)..(763): Pfam Id: Hydrolase Pfam Desc: haloacid dehalogenase-like hydrolase
  misc_feature (100)..(176): Pfam Id: Cation_ATPase_N Pfam Desc: Cation transporter/ATPase, N-terminus
  misc_feature (1)..(1023): NCBI GI: 110832728 NCBI Desc: probable calcium-transporting atpase 4, plasma membrane-type (ca(2+)-atpase isoform 4)
  misc_feature (1)..(1023): NCBI GI: 110832729 NCBI Desc: probable calcium-transporting atpase 5, plasma membrane-type (ca(2+)-atpase isoform 5)
  misc_feature (1)..(1021): NCBI GI: 18483249 NCBI Desc: type iib calcium atpase [medicago truncatula]
  misc_feature (6)..(1023): NCBI GI: 16508162 NCBI Desc: type iib calcium atpase [medicago truncatula]
  misc_feature (10)..(1023): NCBI GI: 75330630 NCBI Desc: calcium-transporting atpase 3, plasma membrane-type (ca(2+)-atpase isoform 3)
  misc_feature (10)..(1023): SWISSPROT Homolog: EC 3.6.3.8 Calcium-transporting ATPase 3, plasma membrane-type
MEWLEKNLQEKFDLPPKNRSEEALRRWRDAVSVVKNPRRRFRMVADLEKIRVALYVQQAALNFIDGVKHKDYRLTDDIIKAGFSINPDELASITSKHDMKVLKMHGGVDGISTKVRSSFDHGISASNLDTRQTIYGENRYTEKPPRSFWMFVWDALQDMTLIILMVCALLSAVVGLASEGWPKGMYDGLGIILSILLVVMVTAVSDYRQSLQFKELDNEKKKIFIHVTRDGCRQKISIYDLVVGDIVHLSIGDQVPADGLYIHGYSLLIDESSLSGESEPVYISQDKPFILAGTKVQDGSAKMLVTAVGMRTEWGRLMSTLSEGGEDETPLQVKLNGVATIIGKIGLLFATLTFVVLMVRFLIEKGLTVGLSKWYSTDALTIVNYFATAVTIIVVAVPEGLPLAVTLSLAFAMKKLMNDKALVRHLSACETMGSAGTICTDKTGTLTTNHMVVDKIWISEVSKSLTSNNSLEDLNSAISPATLSLLLQGIFENTSSEVVKDKDGGQTVLGTPTERAILEFGLKLEGHHDAEDRSCTKVKVEPFNSVKKKMAVLVSLPNGKYRWYTKGASEIIVQMCDMMIDGDGNSVPLSEAQRKNVLGTINSFASDALRTLCLAYKEGDDFSDDTDSPTGGFTLISIFGIKDPVRPGVKEAVEACMSAGIIVRMVTGDNINTAKAIAKECGILTDGGIAIEGPEFRNKSPEEMRDLIPKIQVMARSLPLDKHTLVTNLRGMFKEVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDDMMKRPPVGRGESFITKVMWRNIIGQSLYQLAVLGALMFGGERLLNLKGADSKSVINTLIFNSFVFCQVFNEINSREMQKINVFRGMFSNWIFIGIIAVTAAFQVVIIEFLGTFASTVPLSWQLWLVSVGLGSISLIVGVILKCIPVKSDGTRASPNGYAPLPSGPDNI

SEQ ID NO: 10289 - DNA, 1551 bp, Sorghum bicolor
  misc_feature: Ceres ANNOT ID no. 6111990
  misc_feature: Encodes the peptide sequence at SEQ ID NO 10290
atgacctggaacaacaacccccctccccgtcccgctccctccgacgacgacggccgcctccgcgagctcggctacaagcaggagctcaagcgccacctctcggtgctgtccaacttctccatctccttcaccgtcatctccgtgctgacgggggtcaccacgctctacaacaccggcctcgccttcggcggtcccgccaccatgacgctcggctggttcctcgccggcgccttcaccatggccgtcggactctccatggccgagatctgctccgccttccccacctccggtggcctctactactggagcgcccgactctccggccaccgctgggcgcccttcgcctcctggatcaccggatggttcaacatcgtagcacaatgggcaggcactgccagcatcgacttctctctggcacagctaatccaggtcatcatccttctcagcactggcggcaacaatggcggcgggtacatggcatcaaagtacgtcgttttcgccttccacgcagggattctgctgacccacgccgccatcaacagcctctccatctcttggctatctttgctcggacagttcgccgcgctttggaatatgctaggtgtctttgtcctgatgatcgctgtaccggttgttgctactgagagggctagtgcaaagtacgttttcacccatttcaacacgggtaacagcgctggaatccacagtaacctctacatcttcgttctggggctcctcatgagccaatacacactgtcaggatatgacgcatctgcacacatgaccgaagagaccaaaaatgcaggcaggaacggcccgattgggataatcagtgcgatcggtatatcgttggtagtaggctgggggtacatacttggcatcacgtttgcagtgaaggacatccccttcctcctgagccctgacaacaatgcgggaggctatgcgatcgctcaggtgttctaccttgccttcaaaagccgatatgggaatggtgctggagggatcgtctgcttgtggatcgtcgctgtcgccatatacttctgtggcatgagctcgatgactagcaactcaaggatgacttatgcgttctcgagagatggggcgatgccgttttcatccatctggcacaaagttaacaagcaagaagtgccgataaacgccgtctggctgtcagctttcatctccctttgcatggcattgccgtctctgggcagcctggtggcgttccaggcgatggcatctgtcgcaacgaccgcagtctacatcgcctacgcgctgccgatcctcttccgcgtgacgctggcgcacaatcgcttcgtgccaggccccttcagcctcggccggtacggcgtgctcgtgggctggatcgcagtgctctgggtcgcgaccatcaccgtgctcttctcgctgccggtctcatacccggtgaccaagaacaccctcaactacactccggtcgccgttggcgggctgttcgcactgatcttgtcgtcgtggatcgtcagcgcaaggcgctggttcacgggtcctgtcacaaatttgggagggtag

SEQ ID NO: 10290 - protein, 516 aa, Sorghum bicolor
  misc_feature: Ceres ANNOT ID no. 6111990
  misc_feature (42)..(513): Pfam Id: AA_permease Pfam Desc: Amino acid permease
  misc_feature (16)..(494): NCBI GI: 115438394 NCBI Desc: os01g0607200 [oryza sativa (japonica cultivar-group)]
  misc_feature (8)..(513): NCBI GI: 115442195 NCBI Desc: os01g0945300 [oryza sativa (japonica cultivar-group)]
  misc_feature (16)..(514): NCBI GI: 19386876 NCBI Desc: p0614d08.21 [oryza sativa (japonica cultivar-group)]
  misc_feature (80)..(514): NCBI GI: 42570627 NCBI Desc: amino acid permease family protein [arabidopsis thaliana]
  misc_feature (16)..(261): NCBI GI: 115442199 NCBI Desc: os01g0945700 [oryza sativa (japonica cultivar-group)]
  misc_feature: The sequence is a functional homolog of SEQ ID NO. 297 in the 11/188,298 US application
  misc_feature: The sequence is a functional homolog of SEQ ID NO. 510 in the 11/188,298 US application
  misc_feature: The sequence is a functional homolog of SEQ ID NO. 472 in the 11/188,298 US application
MTWNNNPPPRPAPSDDDGRLRELGYKQELKRHLSVLSNFSISFTVISVLTGVTTLYNTGLAFGGPATMTLGWFLAGAFTMAVGLSMAEICSAFPTSGGLYYWSARLSGHRWAPFASWITGWFNIVAQWAGTASIDFSLAQLIQVIILLSTGGNNGGGYMASKYVVFAFHAGILLTHAAINSLSISWLSLLGQFAALWNMLGVFVLMIAVPVVATERASAKYVFTHFNTGNSAGIHSNLYIFVLGLLMSQYTLSGYDASAHMTEETKNAGRNGPIGIISAIGISLVVGWGYILGITFAVKDIPFLLSPDNNAGGYAIAQVFYLAFKSRYGNGAGGIVCLWIVAVAIYFCGMSSMTSNSRMTYAFSRDGAMPFSSIWHKVNKQEVPINAVWLSAFISLCMALPSLGSLVAFQAMASVATTAVYIAYALPILFRVTLAHNRFVPGPFSLGRYGVLVGWIAVLWVATITVLFSLPVSYPVTKNTLNYTPVAVGGLFALILSSWIVSARRWFTGPVTNLGG

SEQ ID NO: 10291 - DNA, 1440 bp, Sorghum bicolor
  misc_feature: Ceres ANNOT ID no. 6111994
  misc_feature: Encodes the peptide sequence at SEQ ID NO 10292
atggagaccaccggcggggcggccgccgctggcgaggtgggctggtacgtgctcggcccggaccagcagggcgttggcccctacgcgcttgtggagctgcgagagcattttgcaaacggttacctcaacgagagcacaatgctgtgggcacaagggaggaaggaatggatgccgctctcgtcgatccccgagttacactctatagccacagcatcaaaggatcagtctacacaagctgctgctccggatgtcgacgatgatttcgcgaaattccaaaaggaggttaccgaagccgagaaggaagtgaaaggcagcgctgaagtcggtgatgtggaccggcaggatgatgagcggccggcaaccccgccggatggagaggaggaatttactgatgatgatggcaccatttacaagtgggactgtactctcagggcatgggttcctcaaaatgatgtatcaggtaaaaaggacggttatgctgttgaagagatgacatttgcacttgaggaagaagtattccaggcaccagatatccctggtccatctgcattagaagaaatcaacactccagcggaagttaaaaacaaagaatctgataaagcagaaaagagaggagaaaagaaacagaaatcttctcagaagccagctgaaaaaaaagaagctaacaaaccgccggacagttggtttgatctgaaagtcaatacacatgtctatgtaaatggtttgcctgatgatgtcacagtggaggagattgtggaggtattttccaagtgtggaataataaaggaggacccggagactaaaaagcctcgggtgaagatctatactgacaaggaaaccagcaggaaaaagggtgatgccttggtgacatatttcaaggagccttctgtagctttagcagttcaattgttggatgggacatcattccgtcctggtggtaagactctgatgtctgtaagtccagccaggtttcagcagaaaggtgatgttttcattgcaaagaaaactgacaagcaaaagaaaaggaagatcagaaaggttgaagacaaaatgcttggatggggtggacatgatgataagaaggtgatgattcctactacagtaattttacggcacatgttcagtcctgccgagttgagagctgatgaagaccttctttctgagcttgaggtagatgttagagaggagtgtaccaagtttggtccagtggataacgtcaaggtctgtgaaaatcatccacagggtgtcatactggtgaaattcaaagaccggaaggatggcgccaaatgcatagagaagatgaatggaagatggtttggtgggcggcaaatccatgcaagcgaagatgatggttccattaaccattctcttatccgtgattatgatgcagaggtgtcaagactggatcggtttggagaggagttagaagagtccacgtag

SEQ ID NO: 10292 - protein, 479 aa, Sorghum bicolor
  misc_feature: Ceres ANNOT ID no. 6111994
  misc_feature (237)..(318): Pfam Id: RRM_1 Pfam Desc: RNA recognition motif. (a.k.a. RRM, RBD, or RNP domain)
  misc_feature (124)..(476): NCBI GI: 70569833 NCBI Desc: ci-htatsf1 [ciona intestinalis]
  misc_feature (124)..(470): NCBI GI: 33417205 NCBI Desc: similar to hiv tat specific factor 1 [danio rerio]
  misc_feature (124)..(470): NCBI GI: 37590291 NCBI Desc: loc398736 protein [xenopus laevis]
  misc_feature (124)..(470): NCBI GI: 54038341 NCBI Desc: loc398736 protein [xenopus laevis]
  misc_feature (125)..(479): NCBI GI: 24668057 NCBI Desc: cg6049-pc, isoform c [drosophila melanogaster]
  misc_feature: Useful for making plants with altered terpenoid content
  misc_feature: GREAT-hit functional homolog of the protein sequence given in SEQ ID NO 13098
  misc_feature: Useful for making plants with altered terpenoid content
  misc_feature: Functional homolog of the protein sequence given in SEQ ID NO 13098
METTGGAAAAGEVGWYVLGPDQQGVGPYALVELREHFANGYLNESTMLWAQGRKEWMPLSSIPELHSIATASKDQSTQAAAPDVDDDFAKFQKEVTEAEKEVKGSAEVGDVDRQDDERPATPPDGEEEFTDDDGTIYKWDCTLRAWVPQNDVSGKKDGYAVEEMTFALEEEVFQAPDIPGPSALEEINTPAEVKNKESDKAEKRGEKKQKSSQKPAEKKEANKPPDSWFDLKVNTHVYVNGLPDDVTVEEIVEVFSKCGIIKEDPETKKPRVKIYTDKETSRKKGDALVTYFKEPSVALAVQLLDGTSFRPGGKTLMSVSPARFQQKGDVFIAKKTDKQKKRKIRKVEDKMLGWGGHDDKKVMIPTTVILRHMFSPAELRADEDLLSELEVDVREECTKFGPVDNVKVCENHPQGVILVKFKDRKDGAKCIEKMNGRWFGGRQIHASEDDGSINHSLIRDYDAEVSRLDRFGEELEEST

SEQ ID NO: 10293 - DNA, 1338 bp, Sorghum bicolor
  misc_feature: Ceres ANNOT ID no. 6111996
  misc_feature: Encodes the peptide sequence at SEQ ID NO 10294
atggccggcggtggtgaagcgccgttgctggaagggaagcccagggtgtacttcgacggctgccccgggtgtgccaatgaccggaggaaggcggagaacctgggaattccctacggccaattcttccatatctggatcatcatcctcgtctcctgtttgccaatatcattgttgtttcccttcatatatttcatgataagagacttgcatattgctgaaagggtagagggtattggattctatgccggttttgtaggtgcttcatatatgcttggtagagctctaacttccaccgcttggggaatgatagcagatcgtattgggaggaagcccgttatcattctttcaattatctccacgcttttgttcaacactttgttcggattgagtgtaaattattggatggcgatagcaacaagattccttcttggttctttaaatggtttacttggcccaataagagcttatgctgttgaagtatgccgaactgagcatcaagctattggactgacacttgttagcacatcatgggcaataggtcttattattgggccagctattggtggatacctcgcacagccagttgaaaaatatccaaagttatttccagccaattcaatatttgggaggttcccatattttttaccatgtttgtgtgtatcattcttctgtttggttatcctcataagctgtatttggctcccgaattggccattgatgtcatcaattatcttattttgtgtcacctcttttgatgatatggcttacacagagatattttctctatgggccgaaagcgacaaaaagtatggaggactaggtttctcatctgaggatgtcggtcaagtgcttgcagttacaggtgctagcatccttttgtaccaaacatttgtttatccacgtattgtaaaagttcttggaccagtcaatgcttcccgtattgcagctattttgtctatggtgctccttttcacttatccaccaatgacacatctatcaaaaccatggttatcagttgtagtgaatattgcatcaatgttgaaaaacaatttagttgttaccgttgtaacatgctcttttattcttcagaataattcagtgcctcaagagcaaagagcaactgcaaatggcttagcaactacattaatgtcctttttcaaggcatttgccccagcaggagctggtattgtattttcatgggcacaaaaacgccaacatgctttcctctttccaggtgatcaaatggtgttcttccttctggacattgtgatctttgttgagctcatatggacattcaagccatttctagccattccggagcaaatccccagaagttag

SEQ ID NO: 10294 - protein, 445 aa, Sorghum bicolor
  misc_feature: Ceres ANNOT ID no. 6111996
  misc_feature (44)..(391): Pfam Id: MFS_1 Pfam Desc: Major Facilitator Superfamily
  misc_feature (4)..(235): NCBI GI: 77548534 NCBI Desc: major facilitator superfamily protein [oryza sativa (japonica cultivar-group)]
  misc_feature (22)..(235): NCBI GI: 115487198 NCBI Desc: os12g0133100 [oryza sativa (japonica cultivar-group)]
  misc_feature (15)..(235): NCBI GI: 23452823 NCBI Desc: major facilitator superfamily antiporter [oryza sativa (japonica cultivar-group)]
  misc_feature (6)..(235): NCBI GI: 77548523 NCBI Desc: major facilitator superfamily [oryza sativa (japonica cultivar-group)]
  misc_feature (236)..(439): NCBI GI: 115484055 NCBI Desc: os11g0136400 [oryza sativa (japonica cultivar-group)]
  misc_feature: The plant flowers significantly late compared to wild-type.
  misc_feature: Useful for making plants with modulated flowering time
  misc_feature: Functional homolog of the protein sequence given in SEQ ID NO 12969
MAGGGEAPLLEGKPRVYFDGCPGCANDRRKAENLGIPYGQFFHIWIIILVSCLPISLLFPFIYFMIRDLHIAERVEGIGFYAGFVGASYMLGRALTSTAWGMIADRIGRKPVIILSIISTLLFNTLFGLSVNYWMAIATRFLLGSLNGLLGPIRAYAVEVCRTEHQAIGLTLVSTSWAIGLIIGPAIGGYLAQPVEKYPKLFPANSIFGRFPYFLPCLCVSFFCLVILISCIWLPNWPLMSSIILFCVTSFDDMAYTEIFSLWAESDKKYGGLGFSSEDVGQVLAVTGASILLYQTFVYPRIVKVLGPVNASRIAAILSMVLLFTYPPMTHLSKPWLSVVVNIASMLKNNLVVTVVTCSFILQNNSVPQEQRATANGLATTLMSFFKAFAPAGAGIVFSWAQKRQHAFLFPGDQMVFFLLDIVIFVELIWTFKPFLAIPEQIPRS

SEQ ID NO: 10295 - DNA, 1437 bp, Sorghum bicolor
  misc_feature: Ceres ANNOT ID no. 6111997
  misc_feature: Encodes the peptide sequence at SEQ ID NO 10296
atgagcagcgaggaagcgccgctgctggtgccggcgccggcgccggtggcggagggttgccccgggtgcgcgatggagcggcggaaggcgagcagcaacgggaggatcccctacaaggagctcttcttcgtcggcgtcacctccctcgcctcatctttaccaatcacgtgcctcttccccttcctgtatttcatggtaagggacttccacattgctaaaacagaggaagatattggattttatgctggttttcttgctgcatcatacatggtgggcagaggcttttcttcagttttctggggcattctcgcagaccgaattggacggaagcctgtcatcgcattttcaatcttggtcatatttaacacactatttggtctaagtacaacgtattggatggcaattgctacaagacttgtgttgggtgctctaaatggcctacttgccccaataaaggcatattgcgttgaagtttgtcaacctgaacatcaggcacttggactctcaattgtgaacacggcatgggctttgggtcttattgttggtccagctcttggaggttacctttcacagccagctgagaaatatcctcgcatatttttcaaggattctgtctttggcagatttccatatcttttaccctgtctaagtgtatcagtgttcgctacaattgtcctgataatctgtgaatggcttccggagactatacataaacataaagttcccgaaatggacaccagaataatcaaagccttgccatcagaaaagggttattgggaagcacctcgcaagaagaagagtttgctccagaacagggcttggatatcaactatgctaccttactgcttttttagtcttcatgacacagcatatagtgagatactttccttatgggctgtgagcgatcggaagtatggcggccttagcttctcaactgaagatattggtcaggttcttgctatggcaggtgctagtcttctagtataccagcttatcatttatcgctgggttcataaaactcttggaacagtcaactcagcacgtattgcttctgctgtgtctatacttgttcttgcgacttatccctttatgacatacctatctggagtgaaactttcctttgctcttcattctgcagccatgatgagaagtgctctttcaatcactgtcaacacaggaatttcccttctacagaacaatgctgtgtgccaagaacaaagaggcaccgcaaatggtatagcgacaactgcaatgtcattcttcaagtcaattgctccagtaggtgcaggggccctattctcatgggcacaaaaacgtcaagatgttgctttcctgccaggtgatcaggtggttttcatggtgctgaatctggtgcagctccttgggctgatatccatctttgagccctttctggtgttacctgcattaccggagtag

SEQ ID NO: 10296 - protein, 478 aa, Sorghum bicolor
  misc_feature: Ceres ANNOT ID no. 6111997
  misc_feature (44)..(426): Pfam Id: MFS_1 Pfam Desc: Major Facilitator Superfamily
  misc_feature (40)..(470): Pfam Id: Sugar_tr Pfam Desc: Sugar (and other) transporter
  misc_feature (3)..(474): NCBI GI: 77548523 NCBI Desc: major facilitator superfamily [oryza sativa (japonica cultivar-group)]
  misc_feature (11)..(474): NCBI GI: 23452823 NCBI Desc: major facilitator superfamily antiporter [oryza sativa (japonica cultivar-group)]
  misc_feature (5)..(474): NCBI GI: 77548534 NCBI Desc: major facilitator superfamily protein [oryza sativa (japonica cultivar-group)]
  misc_feature (21)..(474): NCBI GI: 115487198 NCBI Desc: os12g0133100 [oryza sativa (japonica cultivar-group)]
  misc_feature (18)..(471): NCBI GI: 42565446 NCBI Desc: transporter-related [arabidopsis thaliana]
  misc_feature: Useful for making plants with modulated flowering time
  misc_feature: Functional homolog of the protein sequence given in SEQ ID NO 12969
  misc_feature: The sequence is a functional homolog of SEQ ID NO. 331 in the 11/188,298 US application
MSSEEAPLLVPAPAPVAEGCPGCAMERRKASSNGRIPYKELFFVGVTSLASSLPITCLFPFLYFMVRDFHIAKTEEDIGFYAGFLAASYMVGRGFSSVFWGILADRIGRKPVIAFSILVIFNTLFGLSTTYWMAIATRLVLGALNGLLAPIKAYCVEVCQPEHQALGLSIVNTAWALGLIVGPALGGYLSQPAEKYPRIFFKDSVFGRFPYLLPCLSVSVFATIVLIICEWLPETIHKHKVPEMDTRIIKALPSEKGYWEAPRKKKSLLQNRAWISTMLPYCFFSLHDTAYSEILSLWAVSDRKYGGLSFSTEDIGQVLAMAGASLLVYQLIIYRWVHKTLGTVNSARIASAVSILVLATYPFMTYLSGVKLSFALHSAAMMRSALSITVNTGISLLQNNAVCQEQRGTANGIATTAMSFFKSIAPVGAGALFSWAQKRQDVAFLPGDQVVFMVLNLVQLLGLISIFEPFLVLPALPE

SEQ ID NO: 10297 - DNA, 1440 bp, Sorghum bicolor
  misc_feature: Ceres ANNOT ID no. 6111998
  misc_feature: Encodes the peptide sequence at SEQ ID NO 10298
atgggtcgcaccatcaagagggccaagaaggccaaatccaagaaggccaagaagaaaactgaagcgtcctcttcgtccaatcctgcggttgcctctggcccggctaaggtctggcaaccgggtgtagatgcactggaagatggggaggagctgcagtttgatcctgaggcttacaattatctccgaggttttggcattggctggtcttgcttgagttttgatgttgtgcgtgatcaacttggactcgtccgatcagagttccctcatacattctatggtgttgctggaacgcaggctgagaaagcttcatggaattatattggcgttttcaagctttctaacataagtgggaagaagcgggaacctataccagcttcagcggttgatggtgacactgatgtggatagcgacagcagcagtgatgaagaagatgaagaaattaatgaggatacaaagcccatcctacatctaaaaaaggtggctcatgcgggatgtgtaaaccggatacgctcaatgactcaaaaaccacatataagtgctacgtggggagatactggtcatgttcaggtgtgggacttgagctccttccttaattctttagcagagtcgggggcagatgcacccaaagaagatgacataatccacaaacacttacccgtgaaagtatttagtggccataaagatgagggatatgccattgattggagtccacttgttactggaagacttgtttctggtgactgcaataagtgcattcacctatgggaaccaacttcaagcaactggaacatagatgcaaacccatttgttggacactctgcaagtgttgaagatctacagtggagtcccacagaagctgacatatttgcctcttgttctgtggatggtacgatatcaatatgggatatacgtacagggaagaaaccttgtatttctgtcaaagctcataaagccgatgtgaatgttatctcatggaacaggcttgctagctgcatgatagcttctgggtgtgatgatggcagtttctcagttcgtgatcttagatcaattcaggaggactcattggtagcacattttgagtaccacaagaaagcaattacatctatcgagtggagtccacacgaagcatcatcattagctgtaacatctgaagatcatcaactaacaatctgggacctttcattggaaagagatgcagaagaggaggctgagttcagagcaaagatgaaagagcaggcaaatgcacctgaggatttgcccccacaacttctctttgctcatcagggccagaaagacttgaaagaactgcactggcacccacagataccgtcgatgatcatatcaacggcaattgatggattcaacgtgctgatgcctagcaacattgatacaaccattcctggcaacactgatacagcaatggcatctgctgagccataa

SEQ ID NO: 10298 - protein, 479 aa, Sorghum bicolor
  misc_feature: Ceres ANNOT ID no. 6111998
  misc_feature (217)..(256): Pfam Id: WD40 Pfam Desc: WD domain, G-beta repeat
  misc_feature (263)..(302): Pfam Id: WD40 Pfam Desc: WD domain, G-beta repeat
  misc_feature (353)..(392): Pfam Id: WD40 Pfam Desc: WD domain, G-beta repeat
  misc_feature (1)..(466): NCBI GI: 94541038 NCBI Desc: immature pollen 1 [oryza sativa (japonica cultivar-group)]
  misc_feature (1)..(469): NCBI GI: 82400122 NCBI Desc: wd-40 repeat protein-like protein [solanum tuberosum]
  misc_feature (2)..(463): NCBI GI: 24021163 NCBI Desc: wd40 [tortula ruralis]
  misc_feature (33)..(456): NCBI GI: 89272848 NCBI Desc: glutamate-rich wd repeat containing 1 [xenopus tropicalis]
  misc_feature (33)..(456): NCBI GI: 49118670 NCBI Desc: mgc83609 protein [xenopus laevis]
  misc_feature: The sequence is a functional homolog of SEQ ID NO. 502 in the 11/188,298 US application
  misc_feature: The sequence is a functional homolog of SEQ ID NO. 485 in the 11/188,298 US application
MGRTIKRAKKAKSKKAKKKTEASSSSNPAVASGPAKVWQPGVDALEDGEELQFDPEAYNYLRGFGIGWSCLSFDVVRDQLGLVRSEFPHTFYGVAGTQAEKASWNYIGVFKLSNISGKKREPIPASAVDGDTDVDSDSSSDEEDEEINEDTKPILHLKKVAHAGCVNRIRSMTQKPHISATWGDTGHVQVWDLSSFLNSLAESGADAPKEDDIIHKHLPVKVFSGHKDEGYAIDWSPLVTGRLVSGDCNKCIHLWEPTSSNWNIDANPFVGHSASVEDLQWSPTEADIFASCSVDGTISIWDIRTGKKPCISVKAHKADVNVISWNRLASCMIASGCDDGSFSVRDLRSIQEDSLVAHFEYHKKAITSIEWSPHEASSLAVTSEDHQLTIWDLSLERDAEEEAEFRAKMKEQANAPEDLPPQLLFAHQGQKDLKELHWHPQIPSMIISTAIDGFNVLMPSNIDTTIPGNTDTAMASAEP

SEQ ID NO: 10299 - DNA, 2028 bp, Sorghum bicolor
  misc_feature: Ceres ANNOT ID no. 6112007
  misc_feature: Encodes the peptide sequence at SEQ ID NO 10300
atgtgcgggatcttcgcctacctcaactacaacgtctcgcgggagcgccgctacatcctcgaggtgctcttcaacggcctccgccgcctcgagtaccgcggctacgactcctccgggatcgcgctcgatgccgacgccgccgccgcccagctcccctccccctcccccgcctacgccggggcgccgccgctcgtgttccgccaggagggcaagatcgagaacctcgtgcgatccgtctactccgaggttgatgagaaggatgtgaacctggatgctgccttcagtgtgcatgctgggattgcccacaccaggtgggccacgcacggtgtgcctgctccaaggaacagccacccccaatcgtccggtgccggtgatgagttcttggttgtccacaacggcattatcaccaactatgaggtgctgaaagagacactaactaggcatgggttcacctttgagtctgatacagacacagaagtcattcctaagctagcaaagttcgttttcgataaatctcatgatgaagaaggtgatgtaacgtttagccaagttgttatggaagtcatgaggcagcttgaaggagcctacgcacttatctttaaaagtccacactatcccaatgaattgattgcatgcaaacgaggcagccaactgatacttggtgtcaatgaattgagtggtcaacagaatgggaaatcatttcatgatgtcaaaaccttgacaacaaacggaaagcccaaagaattattcttctccagtgatctatgtgctattgtagagcatacgaagaactatttagctcttgaagataatgaaatttgtcatattaaggatggtagtgtctcgatcctcaagtttgacccgcacaaagagaagccagcatctgtgcaacgagcattgtctgttcttgagatggaagttgagcaaataaagaaaggaagttatgaccacttcatgcaaaaagaaatccatgaacagccacattcattgaaaacaacaatgaggggtagactgaaggatggcggggttcttctaggtggactgaaggaatatctcaaaacaattaggcgctgtagaagggtggtttttattggctgtggaacaagttacaatgctgccttagctgcaagaccttttgtggaagaactgactggtattcctgtgactatggaggttgcaagtgacttgctggacagacaaggtcccatctacagagaagacactgcagtttttgttagtcagtctggggagacagcagataccctcatggctcttgattatgcactagaaaatggagctctttgtgttggcataacaaatactgttggaagcacactgtctagaaaaacacactgcggagttcatatcaatgctggttgtgagattggtgttgccagtacaaaggcatatacaagtcaaatagtagccatggcgatgatggcgttggctattggatccgatcaaatatctactcaagctagaagggaaactatcatcagtggacttaccaacctttcaagcaatgttagcgaagttctcaaactagatgttgaaatgaaggaacttgcctcgtcgctgatcgattcagagtcgctcctcgtgttcggaagaggctacaactatgccaccgcgctggagggtgctctgaaagtcaaggaggttgcgctgatgcacagcgaaggcatgcttgctggcgagatgaagcatgggccgctggccctggtggacgagaaccttcccatcattgtcattgcgactcgcgacgcatgcttcagcaagcagcagtcggtgatccagcagctcctttcgcgcaaggggcgcctgatagttatgtgctcgaggggagacgcttccgctgtatgccctagtggatcctgcagagtcattgaagttccacaggttgcagattgtctccagccagtgattaacataattccattacagttgctggcataccatctgactgttctccgtggattcgatgtggaccaaccaaggaatctggcgaagagcgtgacaacgcagtag

SEQ ID NO: 10300 - protein, 675 aa, Sorghum bicolor
  misc_feature: Ceres ANNOT ID no. 6112007
  misc_feature (354)..(483): Pfam Id: SIS Pfam Desc: SIS domain
  misc_feature (525)..(658): Pfam Id: SIS Pfam Desc: SIS domain
  misc_feature (2)..(255): Pfam Id: GATase_2 Pfam Desc: Glutamine amidotransferases class-II
  misc_feature (1)..(675): NCBI GI: 9294678 NCBI Desc: glutamine-fructose-6-phosphate transaminase 2 [arabidopsis thaliana]
  misc_feature (245)..(675): NCBI GI: 4826742 NCBI Desc: glutamine-fructose-6-phosphate transaminase 2 [homo sapiens]
  misc_feature (245)..(675): NCBI GI: 60655461 NCBI Desc: glutamine-fructose-6-phosphate transaminase 2 [synthetic construct]
  misc_feature (245)..(675): NCBI GI: 32879979 NCBI Desc: glutamine-fructose-6-phosphate transaminase 2 [homo sapiens]
  misc_feature (207)..(675): NCBI GI: 145338887 NCBI Desc: transaminase [arabidopsis thaliana]
  misc_feature (245)..(675): SWISSPROT Homolog: EC 2.6.1.16 Glucosamine--fructose-6-phosphate aminotransferase [isomerizing] 2
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 12878
  misc_feature: Useful for making plants with modulated biomass
  misc_feature: Useful for making plants with modulated flowering time
  misc_feature: Functional homolog of the protein sequence given in SEQ ID NO 12878
MCGIFAYLNYNVSRERRYILEVLFNGLRRLEYRGYDSSGIALDADAAAAQLPSPSPAYAGAPPLVFRQEGKIENLVRSVYSEVDEKDVNLDAAFSVHAGIAHTRWATHGVPAPRNSHPQSSGAGDEFLVVHNGIITNYEVLKETLTRHGFTFESDTDTEVIPKLAKFVFDKSHDEEGDVTFSQVVMEVMRQLEGAYALIFKSPHYPNELIACKRGSQLILGVNELSGQQNGKSFHDVKTLTTNGKPKELFFSSDLCAIVEHTKNYLALEDNEICHIKDGSVSILKFDPHKEKPASVQRALSVLEMEVEQIKKGSYDHFMQKEIHEQPHSLKTTMRGRLKDGGVLLGGLKEYLKTIRRCRRVVFIGCGTSYNAALAARPFVEELTGIPVTMEVASDLLDRQGPIYREDTAVFVSQSGETADTLMALDYALENGALCVGITNTVGSTLSRKTHCGVHINAGCEIGVASTKAYTSQIVAMAMMALAIGSDQISTQARRETIISGLTNLSSNVSEVLKLDVEMKELASSLIDSESLLVFGRGYNYATALEGALKVKEVALMHSEGMLAGEMKHGPLALVDENLPIIVIATRDACFSKQQSVIQQLLSRKGRLIVMCSRGDASAVCPSGSCRVIEVPQVADCLQPVINIIPLQLLAYHLTVLRGFDVDQPRNLAKSVTTQ

SEQ ID NO: 10301 - DNA, 480 bp, Sorghum bicolor
  misc_feature: Ceres ANNOT ID no. 6112013
  misc_feature: Encodes the peptide sequence at SEQ ID NO 10302
atgggatggaaggcggcggagaagcttatcaggcactggaagatcctccgcggagacaacgtgatgatcatcagaggaaaggacaaaggggagaccgggctcatcaagcgtgtcattcggtcgcagaatcgcgtcatcgtcgagggcaagaacttggttaagaaacacattaagcaaggggaagggaacacaggtggtattttctcgattgaagctccacttcatgtttcaaatgtccaagtagttgatcctgtcacagggaaagcatgtaaggttggatataagtatttggaagatgggaccaaagtcagattcgctagggggatgaatgcatctggtgctgtgataccccggccagaaattctgaaggagagaaaaaaaccgagacctacatcacctggctcaaaggatacaccgattgagcttgtactggagaaaacctacgatgataaagctggaattggcatgcccgatctgtag

SEQ ID NO: 10302 - protein, 159 aa, Sorghum bicolor
  misc_feature: Ceres ANNOT ID no. 6112013
  misc_feature (17)..(48): Pfam Id: KOW Pfam Desc: KOW motif
  misc_feature (1)..(159): NCBI GI: 8809706 NCBI Desc: 50s ribosomal protein l24 [arabidopsis thaliana]
  misc_feature (1)..(120): NCBI GI: 115487226 NCBI Desc: os12g0135900 [oryza sativa (japonica cultivar-group)]
  misc_feature (14)..(111): NCBI GI: 85713153 NCBI Desc: ribosomal protein l24 [idiomarina baltica os145]
  misc_feature (13)..(148): NCBI GI: 89307416 NCBI Desc: ribosomal protein l24 containing protein [tetrahymena thermophila sb210]
  misc_feature (15)..(134): NCBI GI: 124523436 NCBI Desc: ribosomal protein l24 [bacillus coagulans 36d1]
MGWKAAEKLIRHWKILRGDNVMIIRGKDKGETGLIKRVIRSQNRVIVEGKNLVKKHIKQGEGNTGGIFSIEAPLHVSNVQVVDPVTGKACKVGYKYLEDGTKVRFARGMNASGAVIPRPEILKERKKPRPTSPGSKDTPIELVLEKTYDDKAGIGMPDL

SEQ ID NO: 10303 - DNA, 1971 bp, Sorghum bicolor
  misc_feature: Ceres ANNOT ID no. 6112014
  misc_feature: Encodes the peptide sequence at SEQ ID NO 10304
atggatctcaagcaatccttctctactacaatcttctgcgttctgcttctattctgtgtgggctgcagatgtcggcctttagaaatagaggccacccagacagcaaccctcaaggttgatgccacgccacagcttgcccggaagatccctgaaacattatttgggatattttttgaggagattaaccatgcaggggccggtggcatatgggcagagcttgtcaataacagaggtttcgaagctggaggccctcatactccatcaaacattgacccgtggtccatcattggagatgactcctctatattcgtggcgactgatcgtacatcatgtttcagccgaaacattgttgctctgaggatggaggtcctctgtaatgactgtccagctggtggtgttggtgtttacaacccaggtttttggggcatgaacatagaagatgggaaggcttacaatcttgttatgtatgttaagtctccggaaacaacggatttaacagtttcattaacaagctctgacggattgcaaaacttggcttcagctacgataacagtttctggcacatcaaattggacaaaagtggagcagaagctggttgctaaaggaaccaatagaacctcaaggcttcaaataaaaactaacaaaaaaggagttgtatggcttgatcaagtatcactcatgcctgaagacacatacaagggacatggtttccgcacagaacttatatccatgcttttggatttgaaaccacggttcttgagatttcctggaggttgttttgtagaaggtgagtggctaagaaatgcattcagatggagagaatctattggtccatgggaagagaggcctggacactttggggatgtttggcattactggactgatgatgggcttggatattatgagtttcttcagcttgcggaggacctgggtgctgccccaatctgggtattcaacaatggaatcagccacaatgatgaagttgatactgtagctattgctccttttgtaaaggatgtattggacagtctagaatttgcaagggggagtgcagattcaacatggggctctgttagggctgcaatgggacaccctgaacctttcccagttaaacatgtcgcgattggaaatgaagattgcgggaaaaagttttaccgtggtaattacctcaaattctacaatgctataagagaggcatatccagacattcaaatgatttcaaactgtgatggttcatctagaccacttgaccatcctgcagatttgtatgacttccatgtctatactgattctaagactttgtttaacatgaggagccaatttgacagaacatcccgtagtggacccaaggcttttgtgagtgagtatgctgtctggagaagtgatgcgggcagaggaagtcttctcgcttcattggctgaagctgctttccttactggtctggagaaaaacagtgacattgttcagatggcaagttacgctccactattcgtgaataacaatgatcaaacgtggaacccggatgctattgtcttcaactcctggcaacattacggaactcctagttactggatgcagacacttttccgtgagtccagtggtgccatgatccatccaattaatatgagttcccggtactcaagctcgctagctgcatctgcaattacgtggcaggactcagagaatagcttccttagagtaaaggttgtaaactttgggtcggacactgttagcctcacgatctccacaagtggacttcaggccagtgtcaactcgctgggatcaaccgccactgttctcacatctggcaacgttatggatgagaactctttcagtaacccaaacaaggttgcgccggtgaaaagccagctgagcaacgctggggagcagatgcaggtcacgctggctcctcactccttcaccacgttcgatctggcgctggctcagtccaagcttgtggcagagatgtga

SEQ ID NO: 10304 - protein, 656 aa, Sorghum bicolor
  misc_feature: Ceres ANNOT ID no. 6112014
  misc_feature (454)..(639): Pfam Id: Alpha-L-AF_C Pfam Desc: Alpha-L-arabinofuranosidase C-terminus
  misc_feature (71)..(229): Pfam Id: CBM_4_9 Pfam Desc: Carbohydrate binding domain
  misc_feature (1)..(656): NCBI GI: 13398414 NCBI Desc: arabinoxylan arabinofuranohydrolase isoenzyme axah-ii [hordeum vulgare]
  misc_feature (10)..(656): NCBI GI: 13398412 NCBI Desc: arabinoxylan arabinofuranohydrolase isoenzyme axah-i [hordeum vulgare]
  misc_feature (1)..(654): NCBI GI: 116310992 NCBI Desc: osigba0138e08-osigba0161l23.8 [oryza sativa (indica cultivar-group)]
  misc_feature (1)..(654): NCBI GI: 38347003 NCBI Desc: osjnbb0058j09.4 [oryza sativa (japonica cultivar-group)]
  misc_feature (1)..(656): NCBI GI: 77548573 NCBI Desc: arabinoxylan arabinofuranohydrolase isoenzyme axah-ii [oryza sativa (japonica cultivar-group)]
  misc_feature: Useful for making plants with altered cell wall content and/or composition
  misc_feature: GREAT-hit functional homolog of the protein sequence encoded by LOCUS at3g10740
  misc_feature: Functional homolog of the protein sequence encoded by LOCUS at5g26120
  misc_feature: Useful for making plants with altered carbohydrate content
  misc_feature: Functional homolog of the protein sequence given in SEQ ID NO 13603
  misc_feature: Useful for making plants with altered cell wall content and/or composition
  misc_feature: Functional homolog of the protein sequence given in SEQ ID NO 13604
MDLKQSFSTTIFCVLLLFCVGCRCRPLEIEATQTATLKVDATPQLARKIPETLFGIFFEEINHAGAGGIWAELVNNRGFEAGGPHTPSNIDPWSIIGDDSSIFVATDRTSCFSRNIVALRMEVLCNDCPAGGVGVYNPGFWGMNIEDGKAYNLVMYVKSPETTDLTVSLTSSDGLQNLASATITVSGTSNWTKVEQKLVAKGTNRTSRLQIKTNKKGVVWLDQVSLMPEDTYKGHGFRTELISMLLDLKPRFLRFPGGCFVEGEWLRNAFRWRESIGPWEERPGHFGDVWHYWTDDGLGYYEFLQLAEDLGAAPIWVFNNGISHNDEVDTVAIAPFVKDVLDSLEFARGSADSTWGSVRAAMGHPEPFPVKHVAIGNEDCGKKFYRGNYLKFYNAIREAYPDIQMISNCDGSSRPLDHPADLYDFHVYTDSKTLFNMRSQFDRTSRSGPKAFVSEYAVWRSDAGRGSLLASLAEAAFLTGLEKNSDIVQMASYAPLFVNNNDQTWNPDAIVFNSWQHYGTPSYWMQTLFRESSGAMIHPINMSSRYSSSLAASAITWQDSENSFLRVKVVNFGSDTVSLTISTSGLQASVNSLGSTATVLTSGNVMDENSFSNPNKVAPVKSQLSNAGEQMQVTLAPHSFTTFDLALAQSKLVAEM

SEQ ID NO: 10305 - DNA, 1980 bp, Sorghum bicolor
  misc_feature: Ceres ANNOT ID no. 6112016
  misc_feature: Encodes the peptide sequence at SEQ ID NO 10306
atggagaactcacaagatgaatcagaaagtgacgagcaagaagaattcttggaaaagaagccattgcggtcattagcaccaatgttcccgcttcctatgggatatgatgtggcaactcaatcaactgatccattgctaatttttgtcacaccattcaggccctgcacatcgccagaacagtctccagcttcatttggtcaacccttaccaaagtcaccaattcctctcaaggctactccaatctcagctgcatttcccatgccacaacacaaagacgaagactacaaacccttttctggtcagaaaaaatcaaccccgctgaagacagccaagaggactcagcaggctgaatgctccaatgcaggtaacaccaagcgcaggtcaatacagagaagcctgaacagagagcttgccttcagttcatccttgtcaagcaacccaaatgaatctgtcgaagaggtgatgataatgtttgattcacttcggcggcgcatactgcaattggatgaaaatgaggacgcaggcaagcgggccgacttgaaggctggaagtctcatgatgcagaatggcctgaggatcaacaattcgaagatcataggacctgtacctggtgttgaaattggagacattttcttcttcaggattgaaatgtgcattgttggtttacatgcacctgccatggctggcattgatcacacctctgctaagcatgctggaaaagatgagattctggcggttagcatcatctcatctggtggttatgagaatgatgacaatgacacggacattttggtgtacacaggtcagggaggcaatagtcggcacaaggataagcatgaccagaaacttgaaggaggtaaccttgctctcatgaatagtatgaaaaagaaaaacctaatcagggttgtgcgcagcgcacaggaccctttctgcaactcgagcaaagtttacatctatgatggactttaccgggtcgaagaatcctggacagaaaaagcaaagaatggttttagtgttttcaagtacaagatgagaagggagccgggacagagagatggaatttcagtttggaagatgactgagaagtggaaagcaaatcctgcgacaagaaacaatgttataagggcagatatatcgtcaaaagctgagaagctacctgtatgccttgttaatgatgtagatgaccagaaagggccaagctacttcaactatgttactggagtggagcattcagggccactcaggaagacaaaacctttacaaagctgcaagtgtcctagtgtgtgcttgcctagtgatactaattgctcatgtgcacaactgaacagtggttatcttccttacagcgccaatggagtgcttgtgaagcacattccaatgctttatgagtgctcctccacgtgccagtgttgtcaaaattgtcgaaacagggtcacacagaaaggtgtcaatcttaactttgaggtcttttggactggggattccggatggggtgtccggtcctgggacccaatccgtgctggcacattcatctgtgagtatgccggtcaaatcattgatgaaacaaatatgaacatgggtgatgaggaagatgaatataccttttgcacatcatggcacagtgacaaggtttcaagatggaatttgggagcagaattacttgaagaaaaaagtgataatgccacaacagagaatctgaagaagctgcctgttgtcataagtgcaaaacgttcaggaaatgtggctcgttttctgaatcatagctgttccccgaacgtcctttggcagcccgtgcagtatgaccatggcgatgacagttacccacatatcatgttttttgcgatgaaacatattcctcccatgactgaactgacgtatgattatggtacaagaggagctcctcctggcattaaggggaagtttccaaatgcttgcaaactcaagaaatgcttatgtggcaagcgtggactaatgcactaa

SEQ ID NO: 10306 - protein, 659 aa, Sorghum bicolor
  misc_feature: Ceres ANNOT ID no. 6112016
  misc_feature (195)..(350): Pfam Id: YDG_SRA Pfam Desc: YDG/SRA domain
  misc_feature (479)..(635): Pfam Id: SET Pfam Desc: SET domain
  misc_feature (377)..(477): Pfam Id: Pre-SET Pfam Desc: Pre-SET motif
  misc_feature (1)..(629): NCBI GI: 108863954 NCBI Desc: ydg/sra domain containing protein [oryza sativa (japonica cultivar-group)]
  misc_feature (92)..(652): NCBI GI: 24021800 NCBI Desc: set domain protein 113 [zea mays]
  misc_feature (11)..(657): NCBI GI: 71743838 NCBI Desc: set domain protein sdg111 [zea mays]
  misc_feature (63)..(653): NCBI GI: 48927668 NCBI Desc: set domain protein [triticum aestivum]
  misc_feature (21)..(657): NCBI GI: 20977606 NCBI Desc: set domain protein 105 [zea mays]
MENSQDESESDEQEEFLEKKPLRSLAPMFPLPMGYDVATQSTDPLLIFVTPFRPCTSPEQSPASFGQPLPKSPIPLKATPISAAFPMPQHKDEDYKPFSGQKKSTPLKTAKRTQQAECSNAGNTKRRSIQRSLNRELAFSSSLSSNPNESVEEVMIMFDSLRRRILQLDENEDAGKRADLKAGSLMMQNGLRINNSKIIGPVPGVEIGDIFFFRIEMCIVGLHAPAMAGIDHTSAKHAGKDEILAVSIISSGGYENDDNDTDILVYTGQGGNSRHKDKHDQKLEGGNLALMNSMKKKNLIRVVRSAQDPFCNSSKVYIYDGLYRVEESWTEKAKNGFSVFKYKMRREPGQRDGISVWKMTEKWKANPATRNNVIRADISSKAEKLPVCLVNDVDDQKGPSYFNYVTGVEHSGPLRKTKPLQSCKCPSVCLPSDTNCSCAQLNSGYLPYSANGVLVKHIPMLYECSSTCQCCQNCRNRVTQKGVNLNFEVFWTGDSGWGVRSWDPIRAGTFICEYAGQIIDETNMNMGDEEDEYTFCTSWHSDKVSRWNLGAELLEEKSDNATTENLKKLPVVISAKRSGNVARFLNHSCSPNVLWQPVQYDHGDDSYPHIMFFAMKHIPPMTELTYDYGTRGAPPGIKGKFPNACKLKKCLCGKRGLMH

SEQ ID NO: 10307 - DNA, 999 bp, Sorghum bicolor
  misc_feature: Ceres ANNOT ID no. 6112018
  misc_feature: Encodes the peptide sequence at SEQ ID NO 10308
atgagttctctgaagaaatccgacaagaaagctgcgctggatttcgcggcgtggagtttcaatgtcactacatctgttggaatcatcatggtcaacaaagctttgatggctacacatgggttcagttttgcaacaacattaaccgggcttcattttgcgactaccaccttgatgaccatcgtatttcggtggttaggcctgagccagccctcccagttaccagtagcagatctaattaaatttgtgatattttcaaacttgtcaatcgttgggatgaatgtgagcttgatgtggaactctgtgggcttttatcagatagcaaagctgtgcatgatacctgcatcatgtcttctggaggttgtctttgatcatgtacactattctcgggacacaaagctgagcataatggttgtgcttacaggagtggcagtctgcactgttactgatgtcagtgtgaatgcaagaggtctaattgcagctgttatagctgtttggagcacagctttgcaacaatattatgttcatttcctccaacgcaagtactctctgaactcgttcaacctgctgggacacacagctcctgcccaagcagggtccctcctgctggcagggccatttgtagattacttgttgaccgggcaaagagtggatcacttcagtttttcatctcttgctctgtttttcctcacactatcatgcttcatcgccattggggtcaatctgagccaattcatctgcatcgggcggttttctgctgtatccttccaagtcctgggccacatgaagaccgtgcttgttctgtcccttgggtttctcttctttggcaaggaaggcctgaatcttcaggtcgtcattgggatggtcctcgctgttcttggaatgatatggtatggaaacgcatctgctaaaccaggtggcaaagagcggcgcagcgtgctgccggtgaggtccgcgagcctcaagggaagttcagaagaaaaggacggtgcggagaaataa

SEQ ID NO: 10308 - protein, 332 aa, Sorghum bicolor
  misc_feature: Ceres ANNOT ID no. 6112018
  misc_feature (156)..(299): Pfam Id: TPT Pfam Desc: Triose-phosphate Transporter family
  misc_feature (2)..(296): NCBI GI: 115487396 NCBI Desc: os12g0154000 [oryza sativa (japonica cultivar-group)]
  misc_feature (1)..(327): NCBI GI: 47497659 NCBI Desc: transmembrane protein-like [oryza sativa (japonica cultivar-group)]
  misc_feature (6)..(326): NCBI GI: 50509221 NCBI Desc: transporter-related-like [oryza sativa (japonica cultivar-group)]
  misc_feature (177)..(328): NCBI GI: 145334687 NCBI Desc: transporter-related [arabidopsis thaliana]
  misc_feature (1)..(302): NCBI GI: 145343050 NCBI Desc: dmt family transporter: phosphate/phosphoenolpyruvate dmt [ostreococcus lucimarinus cce9901]
  misc_feature: The sequence is a functional homolog of SEQ ID NO. 484 in the 11/188,298 US application
  misc_feature: The sequence is a functional homolog of SEQ ID NO. 360 in the 11/188,298 US application
MSSLKKSDKKAALDFAAWSFNVTTSVGIIMVNKALMATHGFSFATTLTGLHFATTTLMTIVFRWLGLSQPSQLPVADLIKFVIFSNLSIVGMNVSLMWNSVGFYQIAKLCMIPASCLLEVVFDHVHYSRDTKLSIMVVLTGVAVCTVTDVSVNARGLIAAVIAVWSTALQQYYVHFLQRKYSLNSFNLLGHTAPAQAGSLLLAGPFVDYLLTGQRVDHFSFSSLALFFLTLSCFIAIGVNLSQFICIGRFSAVSFQVLGHMKTVLVLSLGFLFFGKEGLNLQVVIGMVLAVLGMIWYGNASAKPGGKERRSVLPVRSASLKGSSEEKDGAEK

SEQ ID NO: 10309 - DNA, 918 bp, Sorghum bicolor
  misc_feature: Ceres ANNOT ID no. 6112025
  misc_feature: Encodes the peptide sequence at SEQ ID NO 10310
atggctgaccgcgtccaccccatgccatctccctcctcctccccgcttccacctccgccagggcgacgtccacccgaccaccatcaccaacaaccctccgtcgccgacgacgaccccgaccccgcggcggcggcgccggccacggagacgacgccgctgcacccgtccttcttccacgacgaccacccgctcgcgctctcgccgccgccaggcacgtacatcatccaggtacccaaagaccaggtcctccgctccccaccgccagaccgcgcgcgccgctacaagaagctgtccggccgtcccgcgcggcgccgccgcctccgccgcgcgtgctgcctcgcctgcgccgcgctcctcgccatcctcctcgccgccgccgccttcgtgggcgccgtcttcctcatcttccgcccacgcccgccgtccttctccgtgccttccctcgccgtccgcggcctcgacgccctcgcctcggcctcctctccgccgctctccccttcgctcgacgccgccgtgcgcgcggacaacggccggaacgggaagacgggcgtggagtaccgcggcggcggcgacgtcgcggtgtcgtacgccggggagcggctcgcggcggggacgtggccggcgttccgccaggcgccgcggaacgtgacggtggtcgcggtggccatgcgtggccagggcgtgcggctcacggacgcgcagaggacgcagctcgccgccgaccgggccgtggccgccgtgccgctcacggtggaggcgacggtgcccgtgcggctgcggtttgggaaggtgctccggacgtggaccgtcgacgtcaaggcacggtgcgaggtggccgtcgacaggctggacgggaacgccgcggtggtgaataaggggtgcagcgtcagggtaaagccgctatggtggtggtggtga

SEQ ID NO: 10310 - protein, 305 aa, Sorghum bicolor
  misc_feature: Ceres ANNOT ID no. 6112025
  misc_feature (133)..(276): Pfam Id: Hin1 Pfam Desc: Harpin-induced protein 1 (Hin1)
  misc_feature (26)..(262): NCBI GI: 115483979 NCBI Desc: os11g0130400 [oryza sativa (japonica cultivar-group)]
  misc_feature (4)..(303): NCBI GI: 18844773 NCBI Desc: harpin-induced protein-related-like [oryza sativa (japonica cultivar-group)]
  misc_feature (68)..(302): NCBI GI: 140044063 NCBI Desc: harpin-induced 1 [medicago truncatula]
  misc_feature (101)..(299): NCBI GI: 90399035 NCBI Desc: h0402c08.7 [oryza sativa (indica cultivar-group)]
  misc_feature (101)..(299): NCBI GI: 38344198 NCBI Desc: osjnba0064g10.14 [oryza sativa (japonica cultivar-group)]
MADRVHPMPSPSSSPLPPPPGRRPPDHHHQQPSVADDDPDPAAAAPATETTPLHPSFFHDDHPLALSPPPGTYIIQVPKDQVLRSPPPDRARRYKKLSGRPARRRRLRRACCLACAALLAILLAAAAFVGAVFLIFRPRPPSFSVPSLAVRGLDALASASSPPLSPSLDAAVRADNGRNGKTGVEYRGGGDVAVSYAGERLAAGTWPAFRQAPRNVTVVAVAMRGQGVRLTDAQRTQLAADRAVAAVPLTVEATVPVRLRFGKVLRTWTVDVKARCEVAVDRLDGNAAVVNKGCSVRVKPLWWWW

SEQ ID NO: 10311 - DNA, 1008 bp, Sorghum bicolor
  misc_feature: Ceres ANNOT ID no. 6112029
  misc_feature: Encodes the peptide sequence at SEQ ID NO 10312
atggcgccgctgtcgtggcggcaccacaccctgctgcaggcgctgctccaccgcggcccgctctccgagcgcgacttccacgccgtcttcgccggcgtctctggcaaggaccccgccactcatcaacaactgttcaatgatacacttctcaagatcaataaggacctcgcctatttgcagttcgagttgcgggcatgcataaaccaatatgatggaatggtttattacggagttgttaataacattgttgatgaagaatctaagctcggaacaaagtattctgtgccccagattgcattctacaagggactgttagaagcaatagttcaggaagctggaactgatgggagcataaccagtattgacgctctcaatgtccggcttgaaaaccagattgtaattgtagacggttcagaggacagccaatctcgcgttcctagttccataaagaacttctcactgagccagaaagagaatactcttgatgaactgatacgggatcgttggttgtcatacacctccacaggcaagattggtctgggcaccagatcatttcttgatctccgaagctggttccgtggtaatgatatcccatcttgtgttgtctgcaacgaagcttgtataaaggcatcaagttgtttaaatgagggatgcaatgttagaattcatgagtactgcttaaagaagaaattttcacaaagaaaggcttcaagagcttgttctagttgtggtactgaatggccctgtcaggacggtgaagctgatggtgatgatgatgtaaatgaacctggggaagatcaagtctcatcagccaatcgttcctcgaggaagaagcgcaagagagtcaaagctgaactggtggaagaaaataacaatgcaggcccatcaatggaggtgcctaggaggatcttgagaagtgctaaagccgaagcagtcgaggctgctcaagaggcgtcttctgctggagcttcgcagccagacaggggttccaaaagaaggaagaagtag

SEQ ID NO: 10312 - protein, 335 aa, Sorghum bicolor
  misc_feature: Ceres ANNOT ID no. 6112029
  misc_feature (6)..(188): Pfam Id: SMC_Nse1 Pfam Desc: Nse1 non-SMC component of SMC5-6 complex
  misc_feature (200)..(243): Pfam Id: zf-RING-like Pfam Desc: RING-like domain
  misc_feature (1)..(317): NCBI GI: 115487130 NCBI Desc: os12g0127100 [oryza sativa (japonica cultivar-group)]
  misc_feature (150)..(248): NCBI GI: 37805211 NCBI Desc: mgc68739 protein [xenopus laevis]
  misc_feature (128)..(280): NCBI GI: 50540168 NCBI Desc: zgc:92777 [danio rerio]
  misc_feature (114)..(280): NCBI GI: 119576162 NCBI Desc: non-smc element 1 homolog (s. cerevisiae), isoform cra_d [homo sapiens]
  misc_feature (109)..(280): NCBI GI: 122064621 NCBI Desc: non-structural maintenance of chromosomes element 1 homolog (non-smc element 1 homolog)
MAPLSWRHHTLLQALLHRGPLSERDFHAVFAGVSGKDPATHQQLFNDTLLKINKDLAYLQFELRACINQYDGMVYYGVVNNIVDEESKLGTKYSVPQIAFYKGLLEAIVQEAGTDGSITSIDALNVRLENQIVIVDGSEDSQSRVPSSIKNFSLSQKENTLDELIRDRWLSYTSTGKIGLGTRSFLDLRSWFRGNDIPSCVVCNEACIKASSCLNEGCNVRIHEYCLKKKFSQRKASRACSSCGTEWPCQDGEADGDDDVNEPGEDQVSSANRSSRKKRKRVKAELVEENNNAGPSMEVPRRILRSAKAEAVEAAQEASSAGASQPDRGSKRRKK

SEQ ID NO: 10313 - DNA, 1578 bp, Sorghum bicolor
  misc_feature: Ceres ANNOT ID no. 6112041
  misc_feature: Encodes the peptide sequence at SEQ ID NO 10314
atggctaacatgaagccagaggagattacccaccctcccatcatggatcagctggctggaatggagtactgtgtagactccaacccatcctggggagggtgtattatgctgggtttccagcatttcatcctttgcttggggacggcagtgatgatccccaccttgctggttcccctcatgggaggaaatgcgcatgacaaggcaattgtggtacagacagtgctgtttgtgactggcataaatacactgcttcaaactctgtttggaactcgcctgcctacggttattggtggatcatatgcatttgtaatcccagtcatatcaattatcagtgatccctcgctgatgcaaatttctgatgaccacacaaggttcaaagtagccatgagagccatacagggggcccagataatatcctcctgcattcaaatagtacttggctacagccagttgtgggggttatgctgcaggttcttcagtccacttgggatggttccagttgttgcactggtagggattggcctttttgaaagaggattcccagtgattgcaagctgtgtggaaatcggtcttccgatgctcgtcctgtttgttgcactttctcaatatttgaagcatgtacaaatgtgcaatttcccaatattcgagaggttctcagtgctcatctccgttgcacttgtgtggttatatgcccaaatcctcactgtgagcggagcatacaagcatagtccggtgctcactcagctcaactgccgaactgaccatgccaatctcatcacaactgcaccatggattaggcttccatacccgctgcagtggggtccgccgactttcagtgcagaccattcgttcggtatgatggctgctgtggtggtgtccttgatagagtctaccgcagcatttcaggctgctgcccggttggctagtgcaacgcccccaccaccatttgtcatgagcaggggcattggatgccagggaattgggctgctattggacgggctatttggtactgtgagcggctctaccgtctctgtggagaacgttggtctcctaggatcaacaaggattggcagcagaagagtggtccagatctctgctgctttcatgatcttcttctccatcctagggcgatttggagcgttgttcgcctcgattccattcacactgtttgctgccatgtactgtgtattgtttggctatgttggtgctgtggggctctccttcatgcagttcacaaacatgaactcgacgcgcaacctcttcgtccttggcgtctcgctctacctcggcatctccatcccaaactacttccaccagttcacgacgagctatcagcgtgaaccggcgcacactagagctggatggttcaacgacctcatcaacaccgtcttctcgtcgccggccaccgtcgggttcatcgtctcgatggtgctagacaacaccctgcgggtgaggaatggagacagggaccgtgggatgccatggtgggcgaggttccggacgttccgtggtgacagccggactgtggagttctacaatctgccgttcagtctcaaccgcttcttcccggcgtcgtga

SEQ ID NO: 10314 - protein, 525 aa, Sorghum bicolor
  misc_feature: Ceres ANNOT ID no. 6112041
  misc_feature (32)..(439): Pfam Id: Xan_ur_permease Pfam Desc: Permease family
  misc_feature (78)..(525): NCBI GI: 115440067 NCBI Desc: os01g0759900 [oryza sativa (japonica cultivar-group)]
  misc_feature (5)..(524): NCBI GI: 89330191 NCBI Desc: leaf permease 1 [oryza sativa (japonica cultivar-group)]
  misc_feature (4)..(524): NCBI GI: 30696385 NCBI Desc: xanthine/uracil permease family protein [arabidopsis thaliana]
  misc_feature (7)..(524): NCBI GI: 31711940 NCBI Desc: at5g49990 [arabidopsis thaliana]
  misc_feature (16)..(524): NCBI GI: 144924229 NCBI Desc: xanthine/uracil/vitamin c permease [medicago truncatula]
MANMKPEEITHPPIMDQLAGMEYCVDSNPSWGGCIMLGFQHFILCLGTAVMIPTLLVPLMGGNAHDKAIVVQTVLFVTGINTLLQTLFGTRLPTVIGGSYAFVIPVISIISDPSLMQISDDHTRFKVAMRAIQGAQIISSCIQIVLGYSQLWGLCCRFFSPLGMVPVVALVGIGLFERGFPVIASCVEIGLPMLVLFVALSQYLKHVQMCNFPIFERFSVLISVALVWLYAQILTVSGAYKHSPVLTQLNCRTDHANLITTAPWIRLPYPLQWGPPTFSADHSFGMMAAVVVSLIESTAAFQAAARLASATPPPPFVMSRGIGCQGIGLLLDGLFGTVSGSTVSVENVGLLGSTRIGSRRVVQISAAFMIFFSILGRFGALFASIPFTLFAAMYCVLFGYVGAVGLSFMQFTNMNSTRNLFVLGVSLYLGISIPNYFHQFTTSYQREPAHTRAGWFNDLINTVFSSPATVGFIVSMVLDNTLRVRNGDRDRGMPWWARFRTFRGDSRTVEFYNLPFSLNRFFPAS

SEQ ID NO: 10315 - DNA, 1578 bp, Sorghum bicolor
  misc_feature: Ceres ANNOT ID no. 6112059
  misc_feature: Encodes the peptide sequence at SEQ ID NO 10316
atggagaagagcactggcggcgctaatggcggagaggcggcggaggaggcgaaggtgcctctgctgcagccaagggcggcggcagtaggaggcggaggaggagacagcaaggcggcggcggaggaggaggacagggcggcggtggcagcggaggacgcgtcgtggtcgacgctgccgctgcggcggcgcgcgtgggaggagaacaagaagctgtgggtggtggcggggccgtccatcttcacgcgcttcgcgtccttcggcgtcaccgtcatcagccaggccttcatcggacacatcggcgccaccgagctcgccgcctacgcactcgtctccaccgtcctcatgaggttcagcaacggcatcctgctgggcatggcaagtgcgctggagacactatgtgggcaatcctacggcgcgaagcagtaccacatgctggggatctacctgcagcggtcctggatcatcctcttcgcctgctccgtcgtccttcttccagtctacctcttcacggagccactgctagtggcgctgggccaggacccggagatctcggcggtggcggggaccatctcgctgtggtacatccccgtcatgttctcctacgtctgggcattcacgctgcagatgtacctgcaggcgcagagcaagaacatgatcatcacctacctcgccgtgctcaacctcggcctccacctcgtcctgtcctggctcctggccgtcaggctccagctcggcctcgcgggtgtcatggggtccatggtcatcgccatgtggatccccgtgtttgggcagctcgcctttgtcttctttggtggttgccctctcacgtggacaggcttctcgtctgctgcgtttgctgaccttggtgccatcatcaagctctcgctatcttctggtgtcatgctctgtttggaattgtggtacaacaccatattggtgctcctcacaggatacatgaagaatgcagagattgcactggatgccctttcgatatgccttaatatcaacggttgggagatgatggtttctattggctttttggctgcagcaggagtgcgagtggcaaatgagcttggagctggaagcgcaaggagggccaagtttgcgatttacaatgtcgtcatcatttctttctcgatcggatttgtgttgtttgtgctcttccttttcttccgtggaagccttgcctacatatttactgaaagtcaagcggtagctaaagcagtcgccgacctttcgcctctgctagccttctccatattgttgaacagtgttcaaccagtgctatcaggtgtcgctgttggtgcgggctggcaaagtgtagtcgcctatgttaatgttacgtcatactacctgattggcattcctcttggagcagtcctgggctatgtggtggggcttcatgtaaagggcatttggatcggaatgctgcttggaacactagtccaaactattgtgcttctcttcataacgttaaggactgactgggaaaaacaggtggtgactgctcaagagagactaaagaaatggtacatggaagagaatagaagactgcaggcctctaggagaaatccttga

SEQ ID NO: 10316 - protein, 525 aa, Sorghum bicolor
  misc_feature: Ceres ANNOT ID no. 6112059
  misc_feature (77)..(237): Pfam Id: MatE Pfam Desc: MatE
  misc_feature (297)..(460): Pfam Id: MatE Pfam Desc: MatE
  misc_feature (60)..(515): NCBI GI: 140057052 NCBI Desc: multi antimicrobial extrusion protein mate [medicago truncatula]
  misc_feature (15)..(253): NCBI GI: 115483959 NCBI Desc: os11g0129000 [oryza sativa (japonica cultivar-group)]
  misc_feature (51)..(515): NCBI GI: 92893030 NCBI Desc: multi antimicrobial extrusion protein mate [medicago truncatula]
  misc_feature (29)..(516): NCBI GI: 15223391 NCBI Desc: mate efflux family protein [arabidopsis thaliana]
  misc_feature (58)..(500): NCBI GI: 42571729 NCBI Desc: mate efflux family protein [arabidopsis thaliana]
MEKSTGGANGGEAAEEAKVPLLQPRAAAVGGGGGDSKAAAEEEDRAAVAAEDASWSTLPLRRRAWEENKKLWVVAGPSIFTRFASFGVTVISQAFIGHIGATELAAYALVSTVLMRFSNGILLGMASALETLCGQSYGAKQYHMLGIYLQRSWIILFACSVVLLPVYLFTEPLLVALGQDPEISAVAGTISLWYIPVMFSYVWAFTLQMYLQAQSKNMIITYLAVLNLGLHLVLSWLLAVRLQLGLAGVMGSMVIAMWIPVFGQLAFVFFGGCPLTWTGFSSAAFADLGAIIKLSLSSGVMLCLELWYNTILVLLTGYMKNAEIALDALSICLNINGWEMMVSIGFLAAAGVRVANELGAGSARRAKFAIYNVVIISFSIGFVLFVLFLFFRGSLAYIFTESQAVAKAVADLSPLLAFSILLNSVQPVLSGVAVGAGWQSVVAYVNVTSYYLIGIPLGAVLGYVVGLHVKGIWIGMLLGTLVQTIVLLFITLRTDWEKQVVTAQERLKKWYMEENRRLQASRRNP

SEQ ID NO: 10317 - DNA, 1155 bp, Sorghum bicolor
  misc_feature: Ceres ANNOT ID no. 6112060
  misc_feature: Encodes the peptide sequence at SEQ ID NO 10318
atgccgacgccggtgaagtcggtgcttcccgtggtgctcctcggctgcggcggcgtcggccgctacctcctccgccacatcgtctcctgccgccccctccacgccaaccagggcgtggccatccgggtggtgggcgtcgccgatagctcctccctgctcgtcgccgaagatgtccactccaacggcctcgacgacgcgctcctcacccagctctgcgccgccaagtccgccggctctcccctctcctccctgcttgcccaagggcactgtcagctgttcaagaatcctgaggctaggggcaaagtcatagacgccgctaccacacttggaagaacaactggtctggtgctagttgactgttctgcaacttatgacactgttagtctgctgaatgatgctgtgggtcatggatgctgtattgtattggcaaacaagaaacctcttaccggtgcttatgaggattttcagaagttggtctccaacttccgtcggataagattcgaatctactgttggagcaggtttgcctgtgatagcttctgtaacccgtattattgcatctggagatcctgtttctcgtattgttggcagtttgagtggtacacttgggtatgtgatgagtgagcttgaggatggaaagaaatttagtgaagttgtaaaaaatgccaagtctcttggctatacagaaccagatccacgtgatgatcttggtggaatggatgtggctagaaaggcattgatcctggctaggcttctgggccaacagataagcatggagaatatcaatgttgagagtttatatcctagcgaattaggacctgatgcagtgtccacaaaggacttccttgagagtggtttagtgcaacttgacaagagcatggaagaaagagtcaaagcagcagcatcgagaggaaacgttcttcgctacgtagctgagattgaaagcacagggtgccaagtaggccttaaagagctcccaaaggattctgcactgggtagattgaggggaagtgacaatgtggtggagatatacagcagatgttaccagagctcccctctggtgatccagggcgcaggagctggcaatgacaccactgccgccggcgtccttgctgatataattgacctccaagacctgttccagacaacggcatga

SEQ ID NO: 10318 - protein, 384 aa, Sorghum bicolor
  misc_feature: Ceres ANNOT ID no. 6112060
  misc_feature (176)..(374): Pfam Id: Homoserine_dh Pfam Desc: Homoserine dehydrogenase
  misc_feature (9)..(380): NCBI GI: 74058450 NCBI Desc: homoserine dehydrogenase [glycine max]
  misc_feature (9)..(380): NCBI GI: 92888644 NCBI Desc: homoserine dehydrogenase [medicago truncatula]
  misc_feature (9)..(380): NCBI GI: 79328303 NCBI Desc: homoserine dehydrogenase [arabidopsis thaliana]
  misc_feature (9)..(380): NCBI GI: 21537197 NCBI Desc: homoserine dehydrogenase-like protein [arabidopsis thaliana]
  misc_feature (9)..(380): NCBI GI: 79328311 NCBI Desc: homoserine dehydrogenase [arabidopsis thaliana]
MPTPVKSVLPVVLLGCGGVGRYLLRHIVSCRPLHANQGVAIRVVGVADSSSLLVAEDVHSNGLDDALLTQLCAAKSAGSPLSSLLAQGHCQLFKNPEARGKVIDAATTLGRTTGLVLVDCSATYDTVSLLNDAVGHGCCIVLANKKPLTGAYEDFQKLVSNFRRIRFESTVGAGLPVIASVTRIIASGDPVSRIVGSLSGTLGYVMSELEDGKKFSEVVKNAKSLGYTEPDPRDDLGGMDVARKALILARLLGQQISMENINVESLYPSELGPDAVSTKDFLESGLVQLDKSMEERVKAAASRGNVLRYVAEIESTGCQVGLKELPKDSALGRLRGSDNVVEIYSRCYQSSPLVIQGAGAGNDTTAAGVLADIIDLQDLFQTTA

SEQ ID NO: 10319 - DNA, 678 bp, Sorghum bicolor
  misc_feature: Ceres ANNOT ID no. 6112072
  misc_feature: Encodes the peptide sequence at SEQ ID NO 10320
atggatctcaacgccgtggtggccacctgctacgcccttccggtacttgtctctgtgttcacagtccgcttcttctacgtgctgtggcagagtggccaaccagcatcaaggccacgcaccaccggattgcgttgtctcattgtccttggctccggaggacatactgcagaaatgatgaatattgtgacaacacttcagaaagataggttcacaccaaggtactatgtggctgcacttactgataacatgagtcttcaaaaggcacaggtctatgaacaatcacttattcagagcgatagaatgaagactgccgagagtgctcatttcatgcagatatatcgtagtcgtgaagtaggccagtcttatatcacatccatcgcaacaacattgctagccacattgcatgctatgtggctagtaataagaatcagaccacaagtgatattttgcaatggtccagggacatgctttcctctatgcatctcagctttccttctgaaggtgcttggtttgggatggtcctccattttctacattgaaagtattgcaagagtgaagaagctgtcattgagtggtttgctgttgtacaagctacggatagctgaccagttctttgtgcagtggccccaattgaagcatgagtatcctcgagcatgctatgctggtcgtttgatgtga

SEQ ID NO: 10320 - protein, 225 aa, Sorghum bicolor
  misc_feature: Ceres ANNOT ID no. 6112072
  misc_feature (45)..(224): Pfam Id: Alg14 Pfam Desc: Oligosaccharide biosynthesis protein Alg14 like
  misc_feature (3)..(225): NCBI GI: 53734614 NCBI Desc: zgc:101623 [danio rerio]
  misc_feature (1)..(225): NCBI GI: 74586002 NCBI Desc: udp-n-acetylglucosamine transferase subunit alg14 (asparagine linked glycosylation protein 14)
  misc_feature (6)..(225): NCBI GI: 74635505 NCBI Desc: udp-n-acetylglucosamine transferase subunit alg14 (asparagine linked glycosylation protein 14)
  misc_feature (38)..(211): NCBI GI: 116129926 NCBI Desc: ensangp00000014213 [anopheles gambiae str. pest]
  misc_feature (13)..(225): NCBI GI: 146449901 NCBI Desc: udp-n-acetylglucosamine transferase subunit alg14 [lodderomyces elongisporus nrrl yb-4239]
MDLNAVVATCYALPVLVSVFTVRFFYVLWQSGQPASRPRTTGLRCLIVLGSGGHTAEMMNIVTTLQKDRFTPRYYVAALTDNMSLQKAQVYEQSLIQSDRMKTAESAHFMQIYRSREVGQSYITSIATTLLATLHAMWLVIRIRPQVIFCNGPGTCFPLCISAFLLKVLGLGWSSIFYIESIARVKKLSLSGLLLYKLRIADQFFVQWPQLKHEYPRACYAGRLM

SEQ ID NO: 10321 - DNA, 960 bp, Sorghum bicolor
  misc_feature: Ceres ANNOT ID no. 6112078
  misc_feature: Encodes the peptide sequence at SEQ ID NO 10322
atgggcaggccgccgtgctgcgacaaggtggggatcaagaaggggccatggacgccggaggaggacatcgtcctggtgtcctacatccaggagcacggccccggcaactggcgctccgtgcccatcaacacgggcctcatgcgctgcagcaagagctgccgcctccgctggaccaactacctccgccccggcatccgccgcggcaacttcaccccccacgaggaaggcatcatcgtccacctccagtccttgctcggcaacaggtgggccgccattgcttcttacctcccgcagagaaccgacaacgacatcaagaactactggaacacccacctcaagaagaagcttcagaagcagcaagccatcggcgccatcttcgcgccaccacctccgccctccgaatctcccatcataccggcggtagtacccaccgccaccaccggcagccatgctgattgccatcacgatgacatgatgaccctctccaaggacagctacgggcgcccagccagcagcacaccagctccggctgatgaggtcacccaattcatcggcctgtgctcgccgccgttcgctgccaccaatggtgacaccttctcgtcgccgtacgcctccagcatggacaacatatccaagctgctcaacggcttcatgatgaagagctccccgacacaggatgacgctgctaccaatatcaagccctcctcggtcatcgacatcaaccctttcgatcacaagtccggcggtgcactctccgacgacgtgccactgctgatgccaccaccgcagcagcagcagcagcaggcattggcgggacacggcggttaccacaagcccaagctgcagcagctgtcctccatagagaagtggttgttcgacgaggccgccgagcaggtcgtcgaccaccagctgatggagatctccgacggctgttgctcagttcccagcttgctgctttag

SEQ ID NO: 10322 - protein, 319 aa, Sorghum bicolor
  misc_feature: Ceres ANNOT ID no. 6112078
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(121): NCBI GI: 9802570 NCBI Desc: f22o13.30 [arabidopsis thaliana]
  misc_feature (1)..(149): NCBI GI: 83638483 NCBI Desc: myb transcription factor [cucumis sativus]
  misc_feature (1)..(118): NCBI GI: 117957143 NCBI Desc: myb60-like protein [vitis vinifera]
  misc_feature (1)..(120): NCBI GI: 87240347 NCBI Desc: homeodomain-related [medicago truncatula]
  misc_feature (1)..(121): NCBI GI: 256828 NCBI Desc: myb oncoprotein homolog {clone 306} [antirrhinum majus=snapdragons, j1:522, flowers, peptide, 316 aa]
  misc_feature: The sequence is a functional homolog of SEQ ID NO 796 in the 11/435,388 US patent application
  misc_feature: The sequence is a functional homolog of SEQ ID NO 743 in the 10/666,642 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1004 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 36 in US patent 7193132
  misc_feature: The sequence is a functional homolog of SEQ ID NO 1564 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRPPCCDKVGIKKGPWTPEEDIVLVSYIQEHGPGNWRSVPINTGLMRCSKSCRLRWTNYLRPGIRRGNFTPHEEGIIVHLQSLLGNRWAAIASYLPQRTDNDIKNYWNTHLKKKLQKQQAIGAIFAPPPPPSESPIIPAVVPTATTGSHADCHHDDMMTLSKDSYGRPASSTPAPADEVTQFIGLCSPPFAATNGDTFSSPYASSMDNISKLLNGFMMKSSPTQDDAATNIKPSSVIDINPFDHKSGGALSDDVPLLMPPPQQQQQQALAGHGGYHKPKLQQLSSIEKWLFDEAAEQVVDHQLMEISDGCCSVPSLLL

SEQ ID NO: 10323 - DNA, 960 bp, Sorghum bicolor; identical to SEQ ID NO: 10321
  misc_feature: Ceres ANNOT ID no. 6112080
  misc_feature: Encodes the peptide sequence at SEQ ID NO 10324

SEQ ID NO: 10324 - protein, 319 aa, Sorghum bicolor; identical to SEQ ID NO: 10322
  misc_feature: Ceres ANNOT ID no. 6112080
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(121): NCBI GI: 9802570 NCBI Desc: f22o13.30 [arabidopsis thaliana]
  misc_feature (1)..(149): NCBI GI: 83638483 NCBI Desc: myb transcription factor [cucumis sativus]
  misc_feature (1)..(118): NCBI GI: 117957143 NCBI Desc: myb60-like protein [vitis vinifera]
  misc_feature (1)..(120): NCBI GI: 87240347 NCBI Desc: homeodomain-related [medicago truncatula]
  misc_feature (1)..(121): NCBI GI: 256828 NCBI Desc: myb oncoprotein homolog {clone 306} [antirrhinum majus=snapdragons, j1:522, flowers, peptide, 316 aa]
  misc_feature: The sequence is a functional homolog of SEQ ID NO 796 in the 11/435,388 US patent application
  misc_feature: The sequence is a functional homolog of SEQ ID NO 743 in the 10/666,642 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1004 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 36 in US patent 7193132
  misc_feature: The sequence is a functional homolog of SEQ ID NO 1564 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application

SEQ ID NO: 10325 - DNA, 1830 bp, Sorghum bicolor
  misc_feature: Ceres ANNOT ID no. 6112083
  misc_feature: Encodes the peptide sequence at SEQ ID NO 10326
atggtgcgggagctccgcgtcgactccttctacgcgcgcctccgcgccgcggcggcggcggccgcaggctcgtcgtccccgctcctgatcctcccgtcggcggccgacgccgactcgctgtgcgcggtcagggtgctggcgcacgtcctctccgccgactccatccgcttctccatctaccccgtctcctccgccgcctccgcgaccgccctcctcgcctccttctccgccgcctccgccccgctctgcctcgtcctcgtcaactggggcgcgcaccgggacctgcgcgcgcttctcccccccgccgccacggcctttgttgtcgactcacatcgccccgtccacctccacaacctctgcgcgcgcaacgaccgcgtcgttgtcctcttcaccgccgacgacgagcacaccgcggatctctcctacgacttcgacctctccgcgctcgccgacgcctccgacctcgctgctgacgccaacgccgacgaccacctcggccgcggcggccccgactccgacgcatccgactcggaggattccgacgccgacgaggatgatgacgccggcggcggcggcggcaggaggaagaggcgccgcctctccggcgacggctctgacgaccccgtgaggctctttgggcggctgcgccgcgagtactaccgcctcggcaccttccacggcaagccgtcggggtgtctcatgtacgacctcgcccacgcgatgcggaagaacactaacgagctcctctggctcgcctgcgtcgccctcaccgaccagttcgtccacgaccgcatcaccaacgagcgctaccaggccgccgtcatggagctcgagcagcacatcaacggctccggcaacctcgacccgtccggcgccggctccgtcgtcacgctcaaggacggcaccaagatccgggcgcccgaggcctcgcgcatcgcctacgaggacgagcccaggctcatgctgctaagggagtggagcttgtttgactccatgctctgctcctcgtacgtcgccaccaagctcaagacctggagcgacaatgggctcaagaagctcaagctgctgctcgccaggatgggcttcccgctcgccgactgccagaagaacttccagtacatgagcatggaggtcaagcgcaagatgcgggatgagtttgaccgcttcctgcccgagtatggcctcaccgagttctactaccggagcttcttgagagtgcacggctacaggtccaaagtttctgctgcagatgttgtgtatggtgtcacagcgttgcttgagtcactggatgccgagtccaaggatgcaaaggggtcttcagcagctgagcagttttgggttgcttactctgcattgtcactgagcaatgccgatcagttgcgaaaagggatgcagtccgcaattgagatacagagggcgatactgagacaaggaagctcggcgattactaagacagggtttataaggagtgccaagaagttcaggtgggtgaagcttgatgaccctgtggacactaacaagctttgccatccgcaggcacttaccaagttctgcttctttctgctggatgctctaaaggaaaggggcgcaaggatgaagccactaatctgtgcttgcttagcaaaggagcctgagaaggtgctagttgttggggtatgcgggaagccaaggcttggggctgtccaggggaatgcgtttggtaacgctttcaggtctgcggcagaggagattggcgcggactatttccatgacatgtttgagtcgtcatggattgttctggatgttgttgctgtcagttctttcatgattcgattgacggagaagctatga

SEQ ID NO: 10326 - protein, 609 aa, Sorghum bicolor
  misc_feature: Ceres ANNOT ID no. 6112083
  misc_feature (27)..(610): Pfam Id: CDC45 Pfam Desc: CDC45-like protein
  misc_feature (1)..(609): NCBI GI: 77548491 NCBI Desc: cdc45-like protein [oryza sativa (japonica cultivar-group)]
  misc_feature (6)..(427): NCBI GI: 9967707 NCBI Desc: sna41 [schizosaccharomyces pombe]
  misc_feature (6)..(427): NCBI GI: 19115605 NCBI Desc: cdc45 related protein [schizosaccharomyces pombe]
  misc_feature (136)..(609): NCBI GI: 49116014 NCBI Desc: loc398081 protein [xenopus laevis]
  misc_feature (162)..(609): NCBI GI: 37183060 NCBI Desc: cdc45l [homo sapiens]
MVRELRVDSFYARLRAAAAAAAGSSSPLLILPSAADADSLCAVRVLAHVLSADSIRFSIYPVSSAASATALLASFSAASAPLCLVLVNWGAHRDLRALLPPAATAFVVDSHRPVHLHNLCARNDRVVVLFTADDEHTADLSYDFDLSALADASDLAADANADDHLGRGGPDSDASDSEDSDADEDDDAGGGGGRRKRRRLSGDGSDDPVRLFGRLRREYYRLGTFHGKPSGCLMYDLAHAMRKNTNELLWLACVALTDQFVHDRITNERYQAAVMELEQHINGSGNLDPSGAGSVVTLKDGTKIRAPEASRIAYEDEPRLMLLREWSLFDSMLCSSYVATKLKTWSDNGLKKLKLLLARMGFPLADCQKNFQYMSMEVKRKMRDEFDRFLPEYGLTEFYYRSFLRVHGYRSKVSAADVVYGVTALLESLDAESKDAKGSSAAEQFWVAYSALSLSNADQLRKGMQSAIEIQRAILRQGSSAITKTGFIRSAKKFRWVKLDDPVDTNKLCHPQALTKFCFFLLDALKERGARMKPLICACLAKEPEKVLVVGVCGKPRLGAVQGNAFGNAFRSAAEEIGADYFHDMFESSWIVLDVVAVSSFMIRLTEKL

SEQ ID NO: 10327 - DNA, 960 bp, Sorghum bicolor
  misc_feature: Ceres ANNOT ID no. 6112088
  misc_feature: Encodes the peptide sequence at SEQ ID NO 10328
atgggcaggccgccgtggtgcgaatgcgacaaggcggggatcaagaaggggccatggacgccggaggaggacctcaccctcgtctcctacatccacgagcacggcgccggcaggtggcgcctcgtgcccgccagcacgggcctcctgcgctgcagcaagagctgccgcctccgatggaccaactacctccgccccggcatccgccgcggcaacttcagcccccgcgaggaacgcgtcatcgtccacctccagtccttgctaggcaacaggtgggccgccattgcttcccatctcccacagaggaccgacaacgacatcaagaactactggaacactcacctcaagaagaagctccaggaggaaaaggaaaaacagcaagcagccatcttcgccgccgccggacatgtcgacgacgaccggcgccatcgtcgtcacgacgtgaccgccagtagtcccctctccaaggacgacggcagctacggctacgcgcgcccggcggcctgcagcagctccacagctgctgatgaggtcacccagctactcatcgcccggcggcactcgtcgtcgtcgtcgtcgtcgtacccctctagtatggacaacatatccaagctgctcaaaggcttcctgaagagctccccgccgccggcgcaggatgacgacgctgccgacagcaagctcaagccctcggccatcgacgacgacgtcgtcgtccatcctttcgtaactttcgaccacatgtctggcaccaccggcagtgcgctgccacccatctccgacgtggcatcgacggcgccgccgcagcaagtgctgacgacgggacatggctgtttccacgacgaggcccagcagcagcagcagcagctgtcgtcaatagagaactggttgttcgacgagcccaataagcagcagaggatggagaactccgacggctgctgctcacttcttcccatgctgttttag

SEQ ID NO: 10328 - protein, 319 aa, Sorghum bicolor
  misc_feature: Ceres ANNOT ID no. 6112088
  misc_feature (16)..(63): Pfam Id: Myb_DNA-binding Pfam Desc: Myb-like DNA-binding domain
  misc_feature (69)..(114): Pfam Id: Myb_DNA-binding Pfam Desc: Myb-like DNA-binding domain
  misc_feature (1)..(307): NCBI GI: 117957143 NCBI Desc: myb60-like protein [vitis vinifera]
  misc_feature (1)..(303): NCBI GI: 73761705 NCBI Desc: myb transcription factor myb30 [gossypium hirsutum]
  misc_feature (1)..(298): NCBI GI: 115479147 NCBI Desc: os09g0414300 [oryza sativa (japonica cultivar-group)]
  misc_feature (1)..(219): NCBI GI: 117957141 NCBI Desc: myb60-like protein [citrus macrophylla]
  misc_feature (1)..(213): NCBI GI: 92890762 NCBI Desc: homeodomain-related [medicago truncatula]
  misc_feature: The sequence is a functional homolog of SEQ ID NO 796 in the 11/435,388 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1004 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRPPWCECDKAGIKKGPWTPEEDLTLVSYIHEHGAGRWRLVPASTGLLRCSKSCRLRWTNYLRPGIRRGNFSPREERVIVHLQSLLGNRWAAIASHLPQRTDNDIKNYWNTHLKKKLQEEKEKQQAAIFAAAGHVDDDRRHRRHDVTASSPLSKDDGSYGYARPAACSSSTAADEVTQLLIARRHSSSSSSSYPSSMDNISKLLKGFLKSSPPPAQDDDAADSKLKPSAIDDDVVVHPFVTFDHMSGTTGSALPPISDVASTAPPQQVLTTGHGCFHDEAQQQQQQLSSIENWLFDEPNKQQRMENSDGCCSLLPMLF

SEQ ID NO: 10329 - DNA, 450 bp, Sorghum bicolor
  misc_feature: Ceres ANNOT ID no. 6112097
  misc_feature: Encodes the peptide sequence at SEQ ID NO 10330
atggctgccgtgctgcagcgccccgcagcgggcacggtccagtgcttcgggcggaagaagacggccgtggccgtggcctacaccaagcctgggcgcgggctgatcaaggtgaacggcgtcccgatcgagctcatccggccggagatgctccgcctcaaggccttcgagcccatcctgctggcggggcggtccaggttcaaggacatcgacatgcggatccgcgtcaggggcggcgggaagacgtcgcagatctacgccatccgccaggccgtcgccaaggggctcgtcgcgtactaccagaagtacgttgatgaggccgccaagaaggaggtcaaggacatcttcgcccgctacgaccgtaccctcctcgtcgccgaccccaggcgctgcgagcccaagaagtttggcggtcgcggcgcccgcgccaggttccagaagtcttaccgttga

SEQ ID NO: 10330 - protein, 149 aa, Sorghum bicolor
  misc_feature: Ceres ANNOT ID no. 6112097
  misc_feature (17)..(149): Pfam Id: Ribosomal_S9 Pfam Desc: Ribosomal protein S9/S16
  misc_feature (1)..(149): NCBI GI: 109940156 NCBI Desc: 40s ribosomal protein s16
  misc_feature (1)..(149): NCBI GI: 1096552 NCBI Desc: ribosomal protein s16
  misc_feature (1)..(149): NCBI GI: 538428 NCBI Desc: ribosomal protein s16
  misc_feature (8)..(149): NCBI GI: 2641209 NCBI Desc: ribosomal protein s16 [fritillaria agrestis]
  misc_feature (12)..(149): NCBI GI: 6984222 NCBI Desc: 40s ribosomal protein s16 [euphorbia esula]
MAAVLQRPAAGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFARYDRTLLVADPRRCEPKKFGGRGARARFQKSYR

SEQ ID NO: 10331 - DNA, 1134 bp, Sorghum bicolor
  misc_feature: Ceres ANNOT ID no. 6112098
  misc_feature: Encodes the peptide sequence at SEQ ID NO 10332
atggcaacccgctactggatcgtctctctccccgtgcagtctcccggcgccaccgcgacctcgctgtggccgcgcctgcaggacgccatctcccgccactccttcgacaccccgctgtaccggttcaacgtcccggacctccgcgtcggcaccctcgactccctcctcgccctcagcgacgacctcgtcaagtccaacgtgttcgtcgagggcgtgtcgcacaagatccggaggcagatcgaggacctcgagcgcgcaggaggcgtcgacagcggggcactcaccgtcgatggcgtccccgtcgacacctacctcaccaggttcgtgtgggatgagggcaagtaccccacaatgtcgccgctcaaggagatcgtcggcagcatccagacacaggtcgccaagatcgaggatgacatgaaggttcgagcagcggaatataacaatgtaaggagccagcttagtgcaatcaacagaaagcaaagtgggagcttagcagttcgtgatctttccaatctggtaaaaccagaggatatggtcagctcagagcatctagtaacacttcttgctattgttccaaagtactcccaaaaggactggttgtcaagctatgagtcactcgacacatttgtggtacccaggtcatctaaacagctctatgaagacaatgagtatgccctctacactgtaacactttttgctaaggttgttgacaactttaaggttcgtgctcgcgagaagggtttccagattcgtgattttgagtatagtcctgaagcacaagaaagtagaaagcaggagatggagaagttactgcaagatcaggaagctatgaggacttcgcttctgcaatggtgctatgccagctacagcgaggtattcagttcctggatgcacttctgtgctgtgcgtatctttgtagagagcattcttagatatggtctgccaccatcattcctgtctgccgttcttgctccatctacaaagggcgagaagaaagtaaggagcatcttagaggagctttgtggcaatgtccatagtatttattggaaagccgaagatgatgtggctgttgctggtctgggaggtgaatcagaggtccatccttacgtctcattcactgtaaactttgtctga

SEQ ID NO: 10332 - protein, 377 aa, Sorghum bicolor
  misc_feature: Ceres ANNOT ID no. 6112098
  misc_feature (5)..(370): Pfam Id: V-ATPase_C Pfam Desc: V-ATPase subunit C
  misc_feature (1)..(375): NCBI GI: 111154399 NCBI Desc: vacuolar h+-atpase subunit c [gossypium hirsutum]
  misc_feature (1)..(377): NCBI GI: 87240711 NCBI Desc: v-atpase subunit c [medicago truncatula]
  misc_feature (1)..(335): NCBI GI: 12585487 NCBI Desc: vacuolar atp synthase subunit c (v-atpase c subunit) (vacuolar proton pump c subunit)
  misc_feature (1)..(335): NCBI GI: 6688428 NCBI Desc: vacuolar h+-atpase subunit c [hordeum vulgare subsp. vulgare]
  misc_feature (117)..(375): NCBI GI: 110742012 NCBI Desc: vacuolar atp sythase subunit c [arabidopsis thaliana]
  misc_feature (1)..(375): SWISSPROT Homolog: EC 3.6.3.14 Vacuolar ATP synthase subunit C
MATRYWIVSLPVQSPGATATSLWPRLQDAISRHSFDTPLYRFNVPDLRVGTLDSLLALSDDLVKSNVFVEGVSHKIRRQIEDLERAGGVDSGALTVDGVPVDTYLTRFVWDEGKYPTMSPLKEIVGSIQTQVAKIEDDMKVRAAEYNNVRSQLSAINRKQSGSLAVRDLSNLVKPEDMVSSEHLVTLLAIVPKYSQKDWLSSYESLDTFVVPRSSKQLYEDNEYALYTVTLFAKVVDNFKVRAREKGFQIRDFEYSPEAQESRKQEMEKLLQDQEAMRTSLLQWCYASYSEVFSSWMHFCAVRIFVESILRYGLPPSFLSAVLAPSTKGEKKVRSILEELCGNVHSIYWKAEDDVAVAGLGGESEVHPYVSFTVNFV

SEQ ID NO: 10333 - DNA, 1578 bp, Sorghum bicolor
  misc_feature: Ceres ANNOT ID no. 6112107
  misc_feature: Encodes the peptide sequence at SEQ ID NO 10334
atggagctgtccaccgtcgccgccgcagttgcctcggccgccgcgcgtccacacgggcatttctcctctccccgcgcggcctccgtctccgtctccgtctcgtggaacaacagtccctcgctcgcctccacctcacgacggcaaaggctgctgcggcggctccccgtcacctcggccgtcgtggagctccgccaagccgctgccgggggcggagactcgcttcgtgtcaccgagacgcggcagcctggatccagtgttaagttcagcgtggaggtgcctacttccatcattcacgactgttaccaaaccacgctacaggagtacgcgaaacgttttaaggttcctggatttcggcctgggaagatcattccagaaaacattcttataaactatgtaggaccgcaacatgtacaggatgccacaattgaagctgtcttgaaacatacacttcctcaagcattgtcctcggtagaggagagggcattagaagattctgttcgcattcttactcagtttgatgatatgagaaattctttctcactcgacaatgtgtttaggtatgatgttgctgtggatgttgtccctgaagtccgatggttatccgaagacaaatataagaacctcaaagttgtcgttgaaatagatgaagctgttgatgcagaaaaggcagcagaaaaagagcttcagcgacgtcataaagctctgggcttacttagagttgtggctgacagaggcctccagattggtgatctggtggtactagatatttttgcagacagcattaacagtgatggctctaaaggtgaaaaaatttcatctgccgagagtacaggtttccacttggacactgaggaaactaataaccttgttcctggatttcttggttcattaattgggattcgtcctggtgaagctagatcatttcctattcagttccctgagtcatttgagcaagaaagtctaagaggtgtccatgcacagtttactgttgtgtgtaaagagctcttctacagagagttgccagaaatgggtgactcacttgctgtaaagcttcttccaggatgcactacaatagacgaggttcgaggacgtattttggaaagatgtaaagaagtagagaaaatggccatagaacaagcaaccgataatgcaatccttgatcagctcgggaagttggttgaggttgatgttcctcgtgccttgtttcaagaacaaggccaacaactttacggagccaaacttctgcagcttcaggcagaaaggaagctagataaagaccagctagcatccttatcgacccagaggtcagttcaggcgtacctagaagatgagaaggagaatattacaagaatcattaaacagatgctggctgttggtgatgttttcaaatccgagaatttacagtactctactgaacagctcatcaaggaagttgaaaactccatagcagagttcaaacagtacaatcaagactatgatgaggacaacatcaggcaacaggtccaggatgttctagaggcagcgaaggtgcttgaatggctcaaggagaactgtacagtcgagtatatcaggcgatga

SEQ ID NO: 10334 - protein, 525 aa, Sorghum bicolor
  misc_feature: Ceres ANNOT ID no. 6112107
  misc_feature (74)..(228): Pfam Id: Trigger_N Pfam Desc: Bacterial trigger factor protein (TF)
  misc_feature (334)..(515): Pfam Id: Trigger_C Pfam Desc: Bacterial trigger factor protein (TF) C-terminus
  misc_feature (74)..(525): NCBI GI: 18650596 NCBI Desc: at5g55220/mco15_17 [arabidopsis thaliana]
  misc_feature (74)..(509): NCBI GI: 9758119 NCBI Desc: trigger factor-like protein [arabidopsis thaliana]
  misc_feature (74)..(523): NCBI GI: 126659248 NCBI Desc: trigger factor [cyanothece sp. ccy0110]
  misc_feature (74)..(523): NCBI GI: 113474442 NCBI Desc: trigger factor [trichodesmium erythraeum ims101]
  misc_feature (74)..(523): NCBI GI: 17231173 NCBI Desc: trigger factor [nostoc sp. pcc 7120]
MELSTVAAAVASAAARPHGHFSSPRAASVSVSVSWNNSPSLASTSRRQRLLRRLPVTSAVVELRQAAAGGGDSLRVTETRQPGSSVKFSVEVPTSIIHDCYQTTLQEYAKRFKVPGFRPGKIIPENILINYVGPQHVQDATIEAVLKHTLPQALSSVEERALEDSVRILTQFDDMRNSFSLDNVFRYDVAVDVVPEVRWLSEDKYKNLKVVVEIDEAVDAEKAAEKELQRRHKALGLLRVVADRGLQIGDLVVLDIFADSINSDGSKGEKISSAESTGFHLDTEETNNLVPGFLGSLIGIRPGEARSFPIQFPESFEQESLRGVHAQFTVVCKELFYRELPEMGDSLAVKLLPGCTTIDEVRGRILERCKEVEKMAIEQATDNAILDQLGKLVEVDVPRALFQEQGQQLYGAKLLQLQAERKLDKDQLASLSTQRSVQAYLEDEKENITRIIKQMLAVGDVFKSENLQYSTEQLIKEVENSIAEFKQYNQDYDEDNIRQQVQDVLEAAKVLEWLKENCTVEYIRR

SEQ ID NO: 10335 - DNA, 1383 bp, Sorghum bicolor
  misc_feature: Ceres ANNOT ID no. 6112116
  misc_feature: Encodes the peptide sequence at SEQ ID NO 10336
atggccgtgctcctcctcctcctgcaactggcctccttgtaccccagcgtggtccttgccgacgcggtgcttggccggaaggcgggcctcgtcgtcatggacgacgacgagccggcagcggagaataggctggcgccggctgggccgccgccggggaggtacgccgtgatcttcgacgccggcagcacggggacaaggatgcacgtcttcaggttcgacaacaagatggacctcgtcgggattggccacggcattgagttcttcgccaaggtgaagcctggactaagctcatacgctgagcgaccccaagaggccgcaaactccatattacctctcgtcaagaaggccaagagcattgtcccttcgcagctaacggagagaacccctcttaagctaggagcaactgctgggttgagacttatcggagatgaacaagcggacaagattcttcaagcggttagggatcttgtccacagcaagagccaattccaatacaaccctgactggatcaatgttattgaaggatatcaagaaggatcttatctatgggttgccctaaactatctgttggataaattgggaggggattactcccagacggtaggtgtagttgacatgggtggtggatcgatgcaaatggcctatgccatttctgcaaatgatgctgcaaaggctcctaaagtaccagatggaaaggatcgctatgttacaaaggagtatcttaaaggaaaagattataacatctatgctcacagctacttgcactatggcgctttagcagctcgagtgaagattttaaatgcaaagaatggacaatttagtttgtgcatgctgcgtggattcagaggtaactacacatacaatgggcagcaatacgatgcaactgcctcacctcaaggagcagtgtatgaaaaatgtagagaagagatagctaaggcattgaacatgaatgctccatgtaacacgaagagttgcaccttcgatggtgtgtggaacggaggacgtggagctggacaggacaacctctacctttcatcaagcttccactatgtggccacacgggttgggatcatagatggaaaattacccagtgcaaggtccactccttccgcattcagagttgttgcaaagagggtatgccaaatgagtgttaaagaagtaaaagttgcataccccatggttgaggacatcagtgtgccatacctgtgcttggatcttacttacctgtacacggtgctcgtggacggtttcggcctgaagtcaataaagaagatcacattggtatccaaggtgaaacatggagagtactatgttgaagctgcgtggcctctgggtactgctattgaggccttgtctcccaaaatggggcttgaatatgcatga

SEQ ID NO: 10336 - protein, 460 aa, Sorghum bicolor
  misc_feature: Ceres ANNOT ID no. 6112116
  misc_feature (45)..(460): Pfam Id: GDA1_CD39 Pfam Desc: GDA1/CD39 (nucleoside phosphatase) family
  misc_feature (2)..(452): NCBI GI: 62732856 NCBI Desc: apyrase [oryza sativa (japonica cultivar-group)]
  misc_feature (91)..(452): NCBI GI: 62732863 NCBI Desc: s-type apyrase [oryza sativa (japonica cultivar-group)]
  misc_feature (54)..(454): NCBI GI: 6006797 NCBI Desc: apyrase [dolichos biflorus]
  misc_feature (91)..(418): NCBI GI: 115485341 NCBI Desc: os11g0440200 [oryza sativa (japonica cultivar-group)]
  misc_feature (54)..(454): NCBI GI: 11225137 NCBI Desc: apyrase gs52 [glycine soja]
  misc_feature (54)..(452): SWISSPROT Homolog: EC 3.6.1.5 Apyrase precursor
MAVLLLLLQLASLYPSVVLADAVLGRKAGLVVMDDDEPAAENRLAPAGPPPGRYAVIFDAGSTGTRMHVFRFDNKMDLVGIGHGIEFFAKVKPGLSSYAERPQEAANSILPLVKKAKSIVPSQLTERTPLKLGATAGLRLIGDEQADKILQAVRDLVHSKSQFQYNPDWINVIEGYQEGSYLWVALNYLLDKLGGDYSQTVGVVDMGGGSMQMAYAISANDAAKAPKVPDGKDRYVTKEYLKGKDYNIYAHSYLHYGALAARVKILNAKNGQFSLCMLRGFRGNYTYNGQQYDATASPQGAVYEKCREEIAKALNMNAPCNTKSCTFDGVWNGGRGAGQDNLYLSSSFHYVATRVGIIDGKLPSARSTPSAFRVVAKRVCQMSVKEVKVAYPMVEDISVPYLCLDLTYLYTVLVDGFGLKSIKKITLVSKVKHGEYYVEAAWPLGTAIEALSPKMGLEYA

SEQ ID NO: 10337 - DNA, 1965 bp, Sorghum bicolor
  misc_feature: Ceres ANNOT ID no. 6112121
  misc_feature: Encodes the peptide sequence at SEQ ID NO 10338
atgaaggggcaccagcattcgtcctctccgctgctgccgacgccgccgccgagcaagcgccgctgcagcgggctggcggcggccgtgccggcgctcgtcgtctgctccacgctgctcccgctcgtctacctcctcgtcctccaccgccccgccgcagggtatggatcggacgaccgcgccgccgtggtcatcagcaccgagctggccggcgttggggcgcgtggcaagcggcatctggagaatgggggcgccatgaagcacaagctgctcaaggatgtttccaaaaaggtgtctggatctaatgggattccggctgagagatctactagatcaaagtctaacaaggatcatgctatcaaatcaaaagcaaagctcaagggtgctttctctttaattggactaaataatgacaccttcaaaagtaaaggacctcgtacccccaaaaggtatcaattgaaggacttgtcctggagatcaaaggatacaactgttaatgggaaagagaactatggtcaagaggcagtgcatgaggagtataccaagtcctgtgaacatgaatatgggagttactgcctctggtctactgaacatagggaagtaatgaaggatgccattgtcaagaggcttaaagatcaactttttttggcgagagctcattatcctagcattgcaaaattgaagcaacaggaaagatttacacgtgaactgaagcaaaacatccaagagcatgaacgcatgctgagtgacaccatcacagatgctgatcttccaccattttttgcaaagaagctggagaagatggagcatacaattgagagagccaagtcttgtgaagtaggatgctcgaatgttgagcgaaaacttaggcagctacttgatataactgaagatgaagcttatttccatacaaggcagagtgcatttctatatcatcttggggtccagactacgccgaaaactcaccattgcttgaacatgagattgacagtagaatatttcaaatccagatcaagtcatatggatcagttaaatgagcaggagcttgaaagtcctaccttccatcactatgtaatattttccaagaatgtacttgcagcttccaccactatcaattcagcagttatgaactcccagaactcggaccacattgttttccatttgttcactgatgcacaaaacttttatgcgatgaagcattggtttgatagaaattcatacttggaggcaactgttcatgtaactaacattgaggacaaccagaacctctctaaggatatgcattcccttgagatgcaacagttatggcccgcagaggaatttcgtgtcacaattcgtaatcattctgaaccttcccagaggcagatgaaaactgagtacatatctattttcggccattcacatttcctcttgcctgaccttcttcctagcttgaatagagtagttgttctggatgatgatttgattgtccagaaagacttgtcatctctgtggaacctcgatatgggtggtaaagtgattggtgctgtccagttctgtgaagtgagattaggccagttgaaaccttatatggcagaccataatgtcaatgctaattcatgtgtgtggttatctggcttgaatgtcgttgaattggataaatggagggacatgggcattacaagtttgtatgatcaatcgttccaaaagttgcgaaaggaccgcctgaaatcacagcgatttcaggcactccctgcaagtttacttgcctttcaagatctggtatatcctttggaagattcatgggttcaatcaggccttggacatgattatggaattagtcacgtcgatatagaaaaggctgctactctgcactataatggtgtgatgaaaccttggcttgacttggggatacatgattataagagctactggagggagtacatgactaatggagagaagttcatgacggaatgcaatattcactga

SEQ ID NO: 10338 - protein, 654 aa, Sorghum bicolor
  misc_feature: Ceres ANNOT ID no. 6112121
  misc_feature (323)..(629): Pfam Id: Glyco_transf_8 Pfam Desc: Glycosyl transferase family 8
  misc_feature (17)..(654): NCBI GI: 124360299 NCBI Desc: glycosyl transferase, family 8 [medicago truncatula]
  misc_feature (196)..(654): NCBI GI: 124360882 NCBI Desc: glycosyl transferase, family 8 [medicago truncatula]
  misc_feature (194)..(654): NCBI GI: 86439693 NCBI Desc: glycosyl transferase-like protein [triticum aestivum]
  misc_feature (194)..(654): NCBI GI: 86438644 NCBI Desc: glycosyl transferase-like protein [brachypodium sylvaticum]
  misc_feature (204)..(654): NCBI GI: 92885182 NCBI Desc: nudix hydrolase; glycosyl transferase, family 8 [medicago truncatula]
  misc_feature: Useful for making plants with altered cell wall content and/or composition
  misc_feature: Functional homolog of the protein sequence encoded by LOCUS at2g38650
  misc_feature: Useful for making plants with altered cell wall content and/or composition
  misc_feature: Functional homolog of the protein sequence given in SEQ ID NO 13608
MKGHQHSSSPLLPTPPPSKRRCSGLAAAVPALVVCSTLLPLVYLLVLHRPAAGYGSDDRAAVVISTELAGVGARGKRHLENGGAMKHKLLKDVSKKVSGSNGIPAERSTRSKSNKDHAIKSKAKLKGAFSLIGLNNDTFKSKGPRTPKRYQLKDLSWRSKDTTVNGKENYGQEAVHEEYTKSCEHEYGSYCLWSTEHREVMKDAIVKRLKDQLFLARAHYPSIAKLKQQERFTRELKQNIQEHERMLSDTITDADLPPFFAKKLEKMEHTIERAKSCEVGCSNVERKLRQLLDITEDEAYFHTRQSAFLYHLGVQTTPKTHHCLNMRLTVEYFKSRSSHMDQLNEQELESPTFHHYVIFSKNVLAASTTINSAVMNSQNSDHIVFHLFTDAQNFYAMKHWFDRNSYLEATVHVTNIEDNQNLSKDMHSLEMQQLWPAEEFRVTIRNHSEPSQRQMKTEYISIFGHSHFLLPDLLPSLNRVVVLDDDLIVQKDLSSLWNLDMGGKVIGAVQFCEVRLGQLKPYMADHNVNANSCVWLSGLNVVELDKWRDMGITSLYDQSFQKLRKDRLKSQRFQALPASLLAFQDLVYPLEDSWVQSGLGHDYGISHVDIEKAATLHYNGVMKPWLDLGIHDYKSYWREYMTNGEKFMTECNIH

SEQ ID NO: 10339 - DNA, 2046 bp, Sorghum bicolor
  misc_feature: Ceres ANNOT ID no. 6112136
  misc_feature: Encodes the peptide sequence at SEQ ID NO 10340
atggtgtgtgaagattgccatcaggatctttcttgtgctcctcaagatgggctcctcctcttcccctcgtcgtcctccgccgccgccgccgcacccgcagcctcttttactgccgctactcatgccaccgcctccttattgccgccgctcgcctcccaacaatcccatcaccacctaggccagtaccagcagcaacaacactccgccgccgccgccatggtccgcaagcgccccgcgcccgacgtcgacctcccgccgccgcgccgccacgtcacgggcgacctctccgacgtcaccgccggtgccggcgctgctggtgcgcccccgccgcacctgccgccgttctccgccagcgcgcagctgcccgcgctgcccacccagctgcccaccgcgtaccagttccaggcgcacgcgcaccaacaccaggccgcgggtgtggacgtccccgcggcgcacgcgcaggcggctgaggttgcggcggcggcggcgccctccacgacggcgtgggtcgacggcatcatccgcgacatcatcgggagcagcggcggggccggggtgtccgtggcgcagctcatccacaacgtccgcgagatcatccacccctgcaaccccggcctcgcctccctcctcgagctccgcctccgctccctcctcgcccccgccgaccccgcgccgctgcatccacctctcctgcacgccgctccgcacgtcgccgcgctccctcccgctccaccaccaccgccgccgcttcattccgcagagaagcactgtcctcctccgccgcagcaggaccaggagcccaacaacccgccggcgccatcgcaatcgcccaaggccccgacggcggaggagaccgccgccgccgccgccaaggagcggaaggaggagccgcggcgtcggcagcgggacgaggaagggctccacctgctcaccctcctgctgcagtgcgcggaggccgtgaacgcggacaacctcgacgacgcgcaccggtgcctgctggagatcgcggagctggccacgccgttcggcacctcgacgcaccgcgtggcggcctacttcgcggaggccatgtcggcgcgcctcgtgacctcctgcctgggcatctacgcgccgctgccgccggggaaccccgtggcggcgcgcctgcacggccgcggcgtcgccgcggcggcgttccaggtgttcaacggcatcagccccttcgtcaagttctcgcacttcaccgccaaccaggccatccaggaggcgttcgagcgggaggaccgcgtgcacatcatcgacctcgacatcatgcaggggctgcaatggccggggctcttccacatcctcgcctcccgccccggcggcccgcccagggtcaggctcaccggcctcggcgcgtccatggacgcgctccaggcaacggggaaacgcctctccgacttcgccgacacgctcggcttgcccttcgagttctgcgccgtcgctgagaaggccggcaatgttgacccggagaagctcggcgtcacgcggcgtgaggccgtcgccgtccactggctccaccactcgctctacgacgtcaccggctccgactccaacacgctctggcttatccaaaggctggccccgaaggtggtgacaatggtggagcaggacctgagccagtcagggtccttcctggcgcggttcgtggaggcgatccactactactcggcgctgttcgactcgctggacgcgagctacggcgaggacagccccgagcggcacgtcgtggagcagcagctgctgtcgcgggagatccgcaacgtgctcgccgtcggcgggcccgcccgcacgggcgacgtcaagttcgtcggcagctggcgggagaagctggcgcagtccgggttccgcgccgcctcgctcgccggcggcgccgccgcgcaggcgtcgctgctgctcggcatgttcccctccgatgggtacacgctcgtggaggagaacggcgcgctcaagctcgggtggaaggatctctgcttgctcaccgcctcagcttggcgccctattcatcaggcaccgtgccgttga

SEQ ID NO: 10340 - protein, 681 aa, Sorghum bicolor
  misc_feature: Ceres ANNOT ID no. 6112136
  misc_feature (283)..(582): Pfam Id: GRAS Pfam Desc: GRAS family transcription factor
  misc_feature (46)..(681): NCBI GI: 10178637 NCBI Desc: scarecrow [zea mays]
  misc_feature (18)..(681): NCBI GI: 48290382 NCBI Desc: scarecrow [oryza sativa (japonica cultivar-group)]
  misc_feature (73)..(674): NCBI GI: 1497987 NCBI Desc: scarecrow [arabidopsis thaliana]
  misc_feature (256)..(674): NCBI GI: 56605384 NCBI Desc: scarecrow [cucumis sativus]
  misc_feature (245)..(674): NCBI GI: 124360295 NCBI Desc: flagellar basal body rod protein; gras transcription factor [medicago truncatula]
  misc_feature: The sequence is a functional homolog of SEQ ID NO 1327 in the 10/374,780US patent application
  misc_feature: The sequence is a functional homolog of SEQ ID NO 431 in the 11/479,226US patent application
  misc_feature: Useful for making plants with modulated growth and phenotype characteristics
  misc_feature: The sequence is a functional homolog of SEQ ID NO 1327 in the 20060162006 US patent application
  misc_feature: The sequence is a functional homolog of SEQ ID NO 431 in the 20070022495 US patent application
  misc_feature: The sequence is a functional homolog of SEQ ID NO 431 in the 11/479,226 US patent application
  misc_feature: The sequence is a functional homolog of SEQ ID NO 438 in the 11/435,388 US patent application
MVCEDCHQDLSCAPQDGLLLFPSSSSAAAAAPAASFTAATHATASLLPPLASQQSHHHLGQYQQQQHSAAAAMVRKRPAPDVDLPPPRRHVTGDLSDVTAGAGAAGAPPPHLPPFSASAQLPALPTQLPTAYQFQAHAHQHQAAGVDVPAAHAQAAEVAAAAAPSTTAWVDGIIRDIIGSSGGAGVSVAQLIHNVREIIHPCNPGLASLLELRLRSLLAPADPAPLHPPLLHAAPHVAALPPAPPPPPPLHSAEKHCPPPPQQDQEPNNPPAPSQSPKAPTAEETAAAAAKERKEEPRRRQRDEEGLHLLTLLLQCAEAVNADNLDDAHRCLLEIAELATPFGTSTHRVAAYFAEAMSARLVTSCLGIYAPLPPGNPVAARLHGRGVAAAAFQVFNGISPFVKFSHFTANQAIQEAFEREDRVHIIDLDIMQGLQWPGLFHILASRPGGPPRVRLTGLGASMDALQATGKRLSDFADTLGLPFEFCAVAEKAGNVDPEKLGVTRREAVAVHWLHHSLYDVTGSDSNTLWLIQRLAPKVVTMVEQDLSQSGSFLARFVEAIHYYSALFDSLDASYGEDSPERHVVEQQLLSREIRNVLAVGGPARTGDVKFVGSWREKLAQSGFRAASLAGGAAAQASLLLGMFPSDGYTLVEENGALKLGWKDLCLLTASAWRPIHQAPCR

SEQ ID NO: 10341 - DNA, 438 bp, Sorghum bicolor
  misc_feature: Ceres ANNOT ID no. 6112147
  misc_feature: Encodes the peptide sequence at SEQ ID NO 10342
atggcaactctgaaagatgcagtagtaaggaagcctgtactggcaacactccgtcttaccgtcccagctggtgcagcccgtcctggacaatcacttagtccagtacttggttcctatcggctcaatatgatggctttctgcaatgatttcaatgctaggacccagaaatacaagccagacactccaatgcacgtcaccataaccgcctacaaggatcacaccttcgagtttgtggtcaagtcacccccagtatcatggttcctcaagaaggcggcaggaatagaaaccgctagcggtatacctggccacagaaatgtgtcctccctcactatccgccacgctgaccctttctgcaagcacatgtcgcttgaagcgctgtgcaagtgcatcattggcacagccaactccatgggtattgcgatcgttaaagatctatga

SEQ ID NO: 10342 - protein, 145 aa, Sorghum bicolor
  misc_feature: Ceres ANNOT ID no. 6112147
  misc_feature (16)..(75): Pfam Id: Ribosomal_L11_N Pfam Desc: Ribosomal protein L11, N-terminal domain
  misc_feature (80)..(141): Pfam Id: Ribosomal_L11 Pfam Desc: Ribosomal protein L11, RNA binding domain
  misc_feature (1)..(145): NCBI GI: 15823668 NCBI Desc: mitochondrial ribosomal protein l11 [triticum aestivum]
  misc_feature (1)..(145): NCBI GI: 21618064 NCBI Desc: ribosomal protein l11-like protein [arabidopsis thaliana]
  misc_feature (11)..(143): NCBI GI: 83594031 NCBI Desc: ribosomal protein l11 [rhodospirillum rubrum atcc 11170]
  misc_feature (11)..(141): NCBI GI: 90407969 NCBI Desc: ribosomal protein l11 [psychromonas sp. cnpt3]
  misc_feature (11)..(141): NCBI GI: 118597285 NCBI Desc: 50s ribosomal protein l11
MATLKDAVVRKPVLATLRLTVPAGAARPGQSLSPVLGSYRLNMMAFCNDFNARTQKYKPDTPMHVTITAYKDHTFEFVVKSPPVSWFLKKAAGIETASGIPGHRNVSSLTIRHADPFCKHMSLEALCKCIIGTANSMGIAIVKDL

SEQ ID NO: 10343 - DNA, 594 bp, Sorghum bicolor; identical to SEQ ID NO: 13
  misc_feature: Ceres ANNOT ID no. 6112155
  misc_feature: Encodes the peptide sequence at SEQ ID NO 10344

SEQ ID NO: 10344 - protein, 197 aa, Sorghum bicolor; identical to SEQ ID NO: 14
  misc_feature: Ceres ANNOT ID no. 6112155
  misc_feature (58)..(148): Pfam Id: HIT Pfam Desc: HIT domain
  misc_feature (10)..(197): NCBI GI: 115483895 NCBI Desc: os11g0120600 [oryza sativa (japonica cultivar-group)]
  misc_feature (45)..(197): NCBI GI: 27542770 NCBI Desc: atpase-like protein [sorghum bicolor]
  misc_feature (2)..(197): NCBI GI: 42565467 NCBI Desc: diadenosine tetraphosphate hydrolase [hyacinthus orientalis]
  misc_feature (47)..(196): NCBI GI: 27808510 NCBI Desc: at5g58240 [arabidopsis thaliana]
  misc_feature (45)..(172): NCBI GI: 77548404 NCBI Desc: atpase-like protein [oryza sativa (japonica cultivar-group)]
  misc_feature: Useful for making plants with modulated heat sensitivity
  misc_feature: Functional homolog of the protein sequence given in SEQ ID NO 13204

SEQ ID NO: 10345 - DNA, 366 bp, Sorghum bicolor
  misc_feature: Ceres ANNOT ID no. 6112209
  misc_feature: Encodes the peptide sequence at SEQ ID NO 10346
atgacctcgtcatcctccttcctgctcgtggtggtggtgttggcagcactgtttgccgtcagctcgtgtgacaaccccccggccatcaccttcacgatcggtaaggactccagctccaccaaactatcctttgccaccgacgtcgccatctccgaggtggcggtcaagcagaatggcgccgagaattggtctgacaacctcaaggagtcgcccgtcaagacctttaccctcgacagcaaggatccgatcaagggacctatcaccatccgcttcgctgataaggatggtggctaccatgttcttgttgatatcatccctgccgactttaaggctggctcagtttataaggctttgtcctacgtctaa

SEQ ID NO: 10346 - protein, 121 aa, Sorghum bicolor
  misc_feature: Ceres ANNOT ID no. 6112209
  misc_feature (1)..(116): NCBI GI: 33188338 NCBI Desc: group 3 pollen allergen [zea mays]
  misc_feature (1)..(117): NCBI GI: 38347338 NCBI Desc: osjnba0082e08.9 [oryza sativa (japonica cultivar-group)]
  misc_feature (1)..(117): NCBI GI: 116309489 NCBI Desc: osigba0113k06.3 [oryza sativa (indica cultivar-group)]
  misc_feature (1)..(117): NCBI GI: 115469368 NCBI Desc: os06g0662500 [oryza sativa (japonica cultivar-group)]
  misc_feature (29)..(116): NCBI GI: 115469372 NCBI Desc: os06g0662700 [oryza sativa (japonica cultivar-group)]
MTSSSSFLLVVVVLAALFAVSSCDNPPAITFTIGKDSSSTKLSFATDVAISEVAVKQNGAENWSDNLKESPVKTFTLDSKDPIKGPITIRFADKDGGYHVLVDIIPADFKAGSVYKALSYV

SEQ ID NO: 10347 - DNA, 717 bp, Sorghum bicolor
  misc_feature: Ceres ANNOT ID no. 6112232
  misc_feature: Encodes the peptide sequence at SEQ ID NO 10348
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atggcgtccgcgccttccgcccccgcctccgccgccgtcaaggccgcggtcgtccccatcccaccggtccacccgccatcctccgtggcagtactggcgcggcgcgcgccgacgccggtgccggccgccctgcgcgccctgggcctgggcggcaacgcgcggcatggcgcggcgctggtggcgtccgccgcgctggatgacctgcgcccggccatcgacgagtaccccgagggcatcctgtccggggagtggcccggcaacttctccctcctcagctacgccgacctccgcgcctacctcgagtcccggatcgtcacctccgaccagatgagcccggcggcaaagctcggggacgtgatgtcgcgccccgtgcaggtggccacgccggggcagcgcctcgcggaggtcgatgccatcttcgccgcggagcagttctcgggcctgcctgtggtcgacgaggacggcaggtgcgttggggtgatctccaagaaggacaaggccaaggcgcccaatgggatggagtcaactgtagttgaagtcatgtcatctcctgcgataaccctgacgcccgagaagacagtcttggaggctgcagcactaatgcttaaggagaaggttcacaggataccggttgtgaatgaacagcaacaagtgatcggaattgtgactcgctcggacgtattccaggcacttgaggccaacaacaacaaagcatga

SEQ ID NO: 10348 - protein, 238 aa, Sorghum bicolor
  misc_feature: Ceres ANNOT ID no. 6112232
  misc_feature (118)..(232): Pfam Id: CBS Pfam Desc: CBS domain pair
  misc_feature (1)..(234): NCBI GI: 116317809 NCBI Desc: osigba0147b06.5 [oryza sativa (indica cultivar-group)]
  misc_feature (6)..(234): NCBI GI: 38347506 NCBI Desc: osjnba0095e20.4 [oryza sativa (japonica cultivar-group)]
  misc_feature (61)..(233): NCBI GI: 115449677 NCBI Desc: os02g0818000 [oryza sativa (japonica cultivar-group)]
  misc_feature (61)..(205): NCBI GI: 33771378 NCBI Desc: brown planthopper-induced resistance protein 1 [oryza sativa (indica cultivar-group)]
  misc_feature (163)..(234): NCBI GI: 23127710 NCBI Desc: cog0517: fog: cbs domain [nostoc punctiforme pcc 73102]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MASAPSAPASAAVKAAVVPIPPVHPPSSVAVLARRAPTPVPAALRALGLGGNARHGAALVASAALDDLRPAIDEYPEGILSGEWPGNFSLLSYADLRAYLESRIVTSDQMSPAAKLGDVMSRPVQVATPGQRLAEVDAIFAAEQFSGLPVVDEDGRCVGVISKKDKAKAPNGMESTVVEVMSSPAITLTPEKTVLEAAALMLKEKVHRIPVVNEQQQVIGIVTRSDVFQALEANNNKA

SEQ ID NO: 10349 - DNA, 372 bp, Sorghum bicolor
  misc_feature: Ceres ANNOT ID no. 6112254
  misc_feature: Encodes the peptide sequence at SEQ ID NO 10350
atggcacgcagcatgcagtttgctgtggcgatgatcgccgtcgtcgtggccgcggtgctgctggcagcggcgacgacgacgtcggaggccgccgtcacctgcgggcaggtgaactccgcgattagcccctgcctcgcctacgcccgcggcaccggcaccgcaccctccgcggcctgctgcagcggcgtcaggagcctcaactccgccgccagcagcaccgccgacaagcgcaccgcctgcaactgcctcaagagcgccgccggacgtgtcagcggcctcaacgccggcaacgccgccagcatcccctccaagtgcggcgtcaacatcccctacaccatcagcgcctccatcgactgctccagggtgaactaa

SEQ ID NO: 10350 - protein, 123 aa, Sorghum bicolor
  misc_feature: Ceres ANNOT ID no. 6112254
  misc_feature (34)..(119): Pfam Id: Tryp_alpha_amyl Pfam Desc: Protease inhibitor/seed storage/LTP family
  misc_feature (1)..(123): NCBI GI: 1498597 NCBI Desc: phospholipid transfer protein [zea mays]
  misc_feature (1)..(121): NCBI GI: 75994109 NCBI Desc: phospholipid transfer protein 2 [zea mays subsp. parviglumis]
  misc_feature (1)..(120): NCBI GI: 75994095 NCBI Desc: phospholipid transfer protein 2 [zea mays subsp. parviglumis]
  misc_feature (1)..(121): NCBI GI: 75994115 NCBI Desc: phospholipid transfer protein 2 [zea mays subsp. parviglumis]
  misc_feature (1)..(121): NCBI GI: 75994111 NCBI Desc: phospholipid transfer protein 2 [zea mays subsp. parviglumis]
MARSMQFAVAMIAVVVAAVLLAAATTTSEAAVTCGQVNSAISPCLAYARGTGTAPSAACCSGVRSLNSAASSTADKRTACNCLKSAAGRVSGLNAGNAASIPSKCGVNIPYTISASIDCSRVN

SEQ ID NO: 10351 - DNA, 387 bp, Sorghum bicolor
  misc_feature: Ceres ANNOT ID no. 6112259
  misc_feature: Encodes the peptide sequence at SEQ ID NO 10352
atggctgctccacgcctcgccctggtggtcgcgacgacggtggcggtcctggcggcgctgctgctggcgtcctcggagccggcatcggcggcggtgagctgcagcgacgtgacatcctcggtggcgccgtgcctcgggtacgcgatgggcaccacggcgttcccctccccggcgtgctgcaccggggtgcgctcgctcaacagccgcgcgtcgtcgacggccgaccgccaggccacctgcgcctgcctcaagagcatgacgagcaggctcggcggcggcggcggcgtcagcatgggtaacgccgccagcatcccctccaagtgcggcgtctccgtcggcgtgcccattagtcccaacgtcgactgctccaagtacgacgcctcctag

SEQ ID NO: 10352 - protein, 128 aa, Sorghum bicolor
  misc_feature: Ceres ANNOT ID no. 6112259
  misc_feature (34)..(122): Pfam Id: Tryp_alpha_amyl Pfam Desc: Protease inhibitor/seed storage/LTP family
  misc_feature (1)..(124): NCBI GI: 25990344 NCBI Desc: lipid transfer protein [oryza sativa]
  misc_feature (1)..(124): NCBI GI: 73920240 NCBI Desc: nonspecific lipid-transfer protein 4 precursor (ltp 4)
  misc_feature (5)..(123): NCBI GI: 84617197 NCBI Desc: type 1 non specific lipid transfer protein precursor [triticum aestivum]
  misc_feature (25)..(124): NCBI GI: 902058 NCBI Desc: lipid transfer protein precursor
  misc_feature (5)..(123): NCBI GI: 84617227 NCBI Desc: type 1 non specific lipid transfer protein precursor [triticum aestivum]
MAAPRLALVVATTVAVLAALLLASSEPASAAVSCSDVTSSVAPCLGYAMGTTAFPSPACCTGVRSLNSRASSTADRQATCACLKSMTSRLGGGGGVSMGNAASIPSKCGVSVGVPISPNVDCSKYDAS

SEQ ID NO: 10353 - DNA, 843 bp, Sorghum bicolor
  misc_feature: Ceres ANNOT ID no. 6112281
  misc_feature: Encodes the peptide sequence at SEQ ID NO 10354
atggcggccatggcgaacacctctcgtctccccaccccctacagcctcccaaccgtcaacatcggcggtaagtgcaggaggctagctatggccgccgtcagatgcggccccggcggcagcaggagccaccggaggagccttggggtcttcctgtgtcgatcctcgtccacggccggagcccaagggagcacgaggatggaggactataacaccgccatgaagcggatgatgcgtaacccctacgaataccaccacgatctcggtatgaactatgctgtcataagtgagagcttgattgttggctcacagcctcagaagcctgaagatatcgatcacttgaaagatgaagagcgagtagcctatattctttgtttacagcaggacaaggacatcgaatattggggcattgatttccagtccattctcaataggtgcaaagaacttggcattcagcacatcagaaaaccggcagtggattttgatccagattcattgaggtcacaattgccaaaagcagtttcggctctagaatgggctatatcgcagcgcaaagggcgagtttacatccactgcactgctggacttgggagagcacctgcagttgcaattgcttacatgttttggtttgagaatatggatcttaacacagcttataagaagctaaccaccataagaccctgcggacccagtaagagagctatccgtgctgcaacttatgatctagctaagaatgatccatcgaaagagccttttgagaatcttccagaacatgctttcgagggcatcgcggactgggagaggaagttaattcaggaccgggtgcgtgctcttcgcgaagcatga

SEQ ID NO: 10354 - protein, 280 aa, Sorghum bicolor
  misc_feature: Ceres ANNOT ID no. 6112281
  misc_feature (115)..(240): Pfam Id: DSPc Pfam Desc: Dual specificity phosphatase, catalytic domain
  misc_feature (1)..(280): NCBI GI: 74318856 NCBI Desc: dual-specificity protein-like phosphatase 3 [zea mays]
  misc_feature (53)..(277): NCBI GI: 119358887 NCBI Desc: dsp undefined product (ic) [ostreococcus tauri]
  misc_feature (42)..(275): NCBI GI: 145341998 NCBI Desc: dual specificity phosphatase, probable [ostreococcus lucimarinus cce9901]
  misc_feature (10)..(241): NCBI GI: 14970762 NCBI Desc: protein tyrosine phosphatase [lycopersicon esculentum]
  misc_feature (10)..(241): NCBI GI: 82623389 NCBI Desc: protein tyrosine phosphatase-like [solanum tuberosum]
MAAMANTSRLPTPYSLPTVNIGGKCRRLAMAAVRCGPGGSRSHRRSLGVFLCRSSSTAGAQGSTRMEDYNTAMKRMMRNPYEYHHDLGMNYAVISESLIVGSQPQKPEDIDHLKDEERVAYILCLQQDKDIEYWGIDFQSILNRCKELGIQHIRKPAVDFDPDSLRSQLPKAVSALEWAISQRKGRVYIHCTAGLGRAPAVAIAYMFWFENMDLNTAYKKLTTIRPCGPSKRAIRAATYDLAKNDPSKEPFENLPEHAFEGIADWERKLIQDRVRALREA

SEQ ID NO: 10355 - DNA, 4008 bp, Sorghum bicolor
  misc_feature: Ceres ANNOT ID no. 6112301
  misc_feature: Encodes the peptide sequence at SEQ ID NO 10356
atgaagaacctgcgccttgtgacgaggctcccgcagcagctccagctccagatagacggcgagaccctcgtcgcctccgcgatcgacgcggagcgccgccgcgccttcttcgcctcctccaccaacttcatctacaccgtctcactcccttcgtccttcacccaggaacagcaaccactgcaatggagcaaaattgctactcaacactctgacatggaggaggttgttcttgatcctggagattgtattgttgccatggattatctcatggagagggagtctctgctccttggttcgtcagctggttgcctgctcttgtataacgtggacgagaaaacatctgaagttgtcggaagactggaaggtggtgtcaacaccattgcctctagccccgatggggcccttctctctgtcaccactggactcggccagctgcttgttatcacacaggattgggaagtgctttttgagacttctcttgaccctcaagatgctaccattgacaacatagacagtaccggtggtcagatccgaagtgcaatttcttggcgaggggatggaaagtatttcgctacacttgtagcccccgatagcccttctagccccacaaaacttaatgtctgggaacgtgaatcgggaaaggtgcattcttcttcagatgccaaaacttttatgggagcatcgctagattggatgcctagtggagccaaggttgctacagcccttgataggaggacagagggaaagtgccctctcattgttttctatgagaagaatggcttagagaggagccacttttctattgatgagccagcagaggttgtcattcaagctttaaagtggaactgcaattctgagatccttgctgctctggtttcttctagtcagcatgatgttattaaaatatggacctgcaggaacaatcactggtacttgaaacatgaattgcggtacacaaaggaagagggggtaaagttcttttgggatccaacgaaaccaatgcatctgatttgctggacaatgagtggccaggtcacaattcacaagtttgcttggactacagcggtcagtgagagttcagttgcacttgtgatcgatggttcccatgttcttgttactcctcttatcctgggcctgatgccacctcccatgtctctgttccaccttgcatttccttgtgcagtgaatgaggtttcttttgtgaccaatagctcaaagagccacttggctgcttatctgtcaaatggcagcttgtctattgtggaacttccagcaccagatacatgggaagaatttgaaggcaatgggataagtgttgacctttgctgttctgactttactttgaataactgtatgcacctcacttggatagatacacgcaccttgattggtatctgttgctatagtgaaaactactctttaacaacaatcgggtccagtgaaaccagaaaccttgtaggtaaacatgattcgatgtttttcatcaatgagattgaacttatatgttcagaggattctgtgccaggttcagtgagttcatctggatggcaggctagagtatcaaagaaagtgcaattggagagttcagtcattggagtctctccaaacccagcaaaaagaggctcagccttcattcaaattagtggaggaaggattattgagtactgctcaagtttaattctgtcaaaaatgtgtccaccagcacaattcattgacattggttctgaccattgttttccagcatcatgtccttggatgactgcagttctgtgctatgaaaatggtatggcagaaccctttctctttggactcgatgaaagtggcaagctttatatgggcaaaaggttattgagcaacaactgcagcagcttcacattctactccagtgcttatggagctactgagccagttatgagccacttgcttgtgactactaagcaagatcttctattcattgtggatgtcaatgagatcttacttaaagacattgaggtgacaattgacggccttgtcagtactcctgctcgaggaaagcaaagcaaagagcacatcactgtgtgggaaaagggagcgaagttggttggtgttctccatggtgatgaagcagctgtcataatgcaaacaacacgtggtaacttagagtgtacctaccccaggaagctagtccttgtttcaattgttcaagcactggttcagaggcgtttcaaagatgcaatagacatggtgaggcggcatcggatagatttcaatatcattgttgactattgtggttggaatgcttttatgaattcagcagcagactttgttaaacaagttaataaccttacccacatcactgaatttgtttgctcaatgaagaacagcaatgtcagcagcaaattgtacgaagcctatatatcatttcctgatcagtgtgcagtcccaatggcggatagtgaaagttcacctggtttattggtgggtaacaaagtcacttctgtacttatggcagttcgaaaagcccttgaggaacaaatagaagagagctcatcaagagagctttgtatattgaccactttggcccgtagtgaacctccattgttggagcaggcactgaatagaataaaactcattcgagaatcggaacttcttgggcttgatgatgccaagcgaaagctctacccttctgctgaagagtcactgaagcacttgctttggttaacagatactgaagctgttttcggtgctgctttggggttgtatgatctgaatcttgctgctatcgttgctttgaattcccaaaaagatccaaaagagttccttcctttccttaagagtcttgaaagcctcccccctgctatcatgaggtacacaattgatctaaggcttggaagatatgagagtgctctcagaaacattgtttctgctggcaatgagtaccatgaggattgcatgaaactccttaatggtaatcctcagctgttcccactgggcctccagttatttaacgaaccagataaaaggaatcaaattcttgaggcatggggtgaccatctttctgaagagaaatgctttgaggatgccgcattgacttatcagtgctgttcgtcatatcagaaatcactgagagcttaccgtgcttgtggggactggagaggtgtttttaccgttgcaggccttttggagttaaaaaaggaagaaattgttcaacttgcacacgagttatgtgatgagttccaggcgcttggcaagccaggagatgctgctagagtagcactggagtattgttcagatgccgaaagaggtgtaagttattatatcatggcaagggaatgggaagaggctcttagagttgcctatatgcttagcaggcatgatctggttgaaactgtcagagatgcagcttcagaatgtgccacatcactgatatctgagtaccaggaaggactgttgaagattggtaaatatgtagcacgttatttggctgtccgacagagaagattgtcacttgctgccaaactccagtcagaagatcggtttatggatgttgaagatgacaacgtttcagaagtgagcactagcttcagtgaaatgagtgcatataccacaaggtcaaccagggagtcaagtgcttcggtcatatccagcaatgtcagcaaatcacgaggggcaaggcgggcaaaaaaaggtggcaaaatacgagctggaagtccaggggaggaaatggcccttgtggagcatctcaaggggatggcgctcacaggtggtgcccaaaatgagctgaagagcctgcttgtggttctaatacagctgggaaaagaagagcgagcccgtcaggtgcaggaggctgcaggtaattttgaagtgtctcatactgctgcggtgaagttggccgaggacacagtatgcagcgacaaggtagacgagagcacacacacccttgagcattacgtaaagatgctgaaggctcatgggtcgggtgacagtgagccgggttcatggcgaatcaaagcattgtctcccccgtga

SEQ ID NO: 10356 - protein, 1335 aa, Sorghum bicolor
  misc_feature: Ceres ANNOT ID no. 6112301
  misc_feature (1)..(970): Pfam Id: IKI3 Pfam Desc: IKI3 family
  misc_feature (1)..(1335): NCBI GI: 115472799 NCBI Desc: os07g0563700 [oryza sativa (japonica cultivar-group)]
  misc_feature (821)..(1276): NCBI GI: 12002688 NCBI Desc: ikappabkinase complex-associated protein [homo sapiens]
  misc_feature (821)..(1276): NCBI GI: 38569394 NCBI Desc: inhibitor of kappa light polypeptide gene enhancer in b-cells, kinase complex-associated protein [homo sapiens]
  misc_feature (821)..(1276): NCBI GI: 68533121 NCBI Desc: ikbkap variant protein [homo sapiens]
  misc_feature (821)..(1276): NCBI GI: 21619844 NCBI Desc: inhibitor of kappa light polypeptide gene enhancer in b-cells, kinase complex-associated protein [homo sapiens]
MKNLRLVTRLPQQLQLQIDGETLVASAIDAERRRAFFASSTNFIYTVSLPSSFTQEQQPLQWSKIATQHSDMEEVVLDPGDCIVAMDYLMERESLLLGSSAGCLLLYNVDEKTSEVVGRLEGGVNTIASSPDGALLSVTTGLGQLLVITQDWEVLFETSLDPQDATIDNIDSTGGQIRSAISWRGDGKYFATLVAPDSPSSPTKLNVWERESGKVHSSSDAKTFMGASLDWMPSGAKVATALDRRTEGKCPLIVFYEKNGLERSHFSIDEPAEVVIQALKWNCNSEILAALVSSSQHDVIKIWTCRNNHWYLKHELRYTKEEGVKFFWDPTKPMHLICWTMSGQVTIHKFAWTTAVSESSVALVIDGSHVLVTPLILGLMPPPMSLFHLAFPCAVNEVSFVTNSSKSHLAAYLSNGSLSIVELPAPDTWEEFEGNGISVDLCCSDFTLNNCMHLTWIDTRTLIGICCYSENYSLTTIGSSETRNLVGKHDSMFFINEIELICSEDSVPGSVSSSGWQARVSKKVQLESSVIGVSPNPAKRGSAFIQISGGRIIEYCSSLILSKMCPPAQFIDIGSDHCFPASCPWMTAVLCYENGMAEPFLFGLDESGKLYMGKRLLSNNCSSFTFYSSAYGATEPVMSHLLVTTKQDLLFIVDVNEILLKDIEVTIDGLVSTPARGKQSKEHITVWEKGAKLVGVLHGDEAAVIMQTTRGNLECTYPRKLVLVSIVQALVQRRFKDAIDMVRRHRIDFNIIVDYCGWNAFMNSAADFVKQVNNLTHITEFVCSMKNSNVSSKLYEAYISFPDQCAVPMADSESSPGLLVGNKVTSVLMAVRKALEEQIEESSSRELCILTTLARSEPPLLEQALNRIKLIRESELLGLDDAKRKLYPSAEESLKHLLWLTDTEAVFGAALGLYDLNLAAIVALNSQKDPKEFLPFLKSLESLPPAIMRYTIDLRLGRYESALRNIVSAGNEYHEDCMKLLNGNPQLFPLGLQLFNEPDKRNQILEAWGDHLSEEKCFEDAALTYQCCSSYQKSLRAYRACGDWRGVFTVAGLLELKKEEIVQLAHELCDEFQALGKPGDAARVALEYCSDAERGVSYYIMAREWEEALRVAYMLSRHDLVETVRDAASECATSLISEYQEGLLKIGKYVARYLAVRQRRLSLAAKLQSEDRFMDVEDDNVSEVSTSFSEMSAYTTRSTRESSASVISSNVSKSRGARRAKKGGKIRAGSPGEEMALVEHLKGMALTGGAQNELKSLLVVLIQLGKEERARQVQEAAGNFEVSHTAAVKLAEDTVCSDKVDESTHTLEHYVKMLKAHGSGDSEPGSWRIKALSPP

SEQ ID NO: 10357 - DNA, 999 bp, Sorghum bicolor
  misc_feature: Ceres ANNOT ID no. 6112308
  misc_feature: Encodes the peptide sequence at SEQ ID NO 10358
atggcctccgccgaaatccccaactccagccccgacgccaccaaccgcgccgccgccgccgccgccggccccgacctctcctcttcgccgccgctcccgccgcgcaagcgccgcctttcgccttccccatcccccacgcgctccgcgtcacgctctcggtccccccgctctcgctccccgcgcggccgccgctcccgctcccgctcccgcagccggagccgcagccgcagccgcagcccgcagtacccgcccgatggcaagcggcggcggcacaacgaccttaacgtggaggcgtgccgcgacttcctccgcgacaggtgcacccgctccgacctcgagtgcagatacgcacaccctcacaactccgtttccgtcgaccgggacaataaggtgacggcttgcgcggattctctgaggaataattgcttccgggggaggacatgccgttactaccatccgcctccacatatccaagagcaattgctgagatcaattggtgtggaagacccaaaggtgaagacgcagatctgcagagatttcacacgtgggaagtgttcaagatcagcaaatgagtgccgtttcttgcaccattcatctgttgaagatgttgcaattgtttgccaagatttcttgcgtggacagtgcaatcgcatagcatgtaggtactctcacgtagtagcacatccagtgccaccaatgagccatgttcctatgccataccctgagatgctttacatgccaccaccaccaccaccaccccttggagtaccaatgatggggcctctgccttcgcctcctagaccatttgctgataataagaacagagttgaagtatgcagggacttcttgaagaacatgtgcaatagggaatcctgccggtttgcacaccctgagacacatacaacggcggcgagcgccaatgttgaagtatgccgtgattttaaacgaggagaatgcactcgacctgcctgtcgctattttcatccatatacaagctga

SEQ ID NO: 10358 - protein, 332 aa, Sorghum bicolor
  misc_feature: Ceres ANNOT ID no. 6112308
  misc_feature (1)..(332): NCBI GI: 115458532 NCBI Desc: os04g0438700 [oryza sativa (japonica cultivar-group)]
  misc_feature (1)..(332): NCBI GI: 116309800 NCBI Desc: h0525c06.2 [oryza sativa (indica cultivar-group)]
  misc_feature (1)..(305): NCBI GI: 39545647 NCBI Desc: oj000114_01.2 [oryza sativa (japonica cultivar-group)]
  misc_feature (94)..(329): NCBI GI: 50295893 NCBI Desc: muscleblind-like x-linked protein [takifugu rubripes]
  misc_feature (86)..(161): NCBI GI: 119632185 NCBI Desc: muscleblind-like 3 (drosophila), isoform cra_c [homo sapiens]
MASAEIPNSSPDATNRAAAAAAGPDLSSSPPLPPRKRRLSPSPSPTRSASRSRSPRSRSPRGRRSRSRSRSRSRSRSRSPQYPPDGKRRRHNDLNVEACRDFLRDRCTRSDLECRYAHPHNSVSVDRDNKVTACADSLRNNCFRGRTCRYYHPPPHIQEQLLRSIGVEDPKVKTQICRDFTRGKCSRSANECRFLHHSSVEDVAIVCQDFLRGQCNRIACRYSHVVAHPVPPMSHVPMPYPEMLYMPPPPPPPLGVPMMGPLPSPPRPFADNKNRVEVCRDFLKNMCNRESCRFAHPETHTTAASANVEVCRDFKRGECTRPACRYFHPYTS

SEQ ID NO: 10359 - DNA, 846 bp, Sorghum bicolor
  misc_feature: Ceres ANNOT ID no. 6112309
  misc_feature: Encodes the peptide sequence at SEQ ID NO 10360
atggtggagagggaaagagacgagggagaagcagccagggccctgaccaccgggccaccgcagcagcagcagcaggaggaggaggaggaggaggaaggagcagcggagggcgagagcgacgaggaagcgggagacgagcgggaagaggaggaggatcatcgagacgacgacgaagccgtggagtggtcggagatacggctcgccatcgaggagctgtccccgccggcccgtctcaagcacggcggcggcggcgacgatggcaaggcggccgcgtcgtcggtgcccactctgcgcttcctggcgctgtcgcacctcctcctccgcgtgctcgataagatcgggccgaccatggccgtgctgaggctcgacgtccaacggaacatcgagaggctgcaggagctgtacctgttggacccagccaagtactctaccctaacggaggtagtggagaaggaagtcaaggagggcactgcaaggaaggtcgatagctgtgcaagggctgtcctgtggcttgctagatccatggacttcacaattgcgctgttagtgagcatagaagaggactctgatgagcagcagcagcagagcctcgcgcagcttgtcgaagccgcgtacgaggcctgcctgaagccatggcatggctggatctcttcggcggcgtgcaagatagcgctgaagctcatccctgagaggaaggtcttcaccagcctgctgctggggatgggccaagactgctctgatctcaaggatgagatcaggaggctcgcgttgctgctccgccccctccttgatgacatccactccatgatggccaagttcagactggacaggctcaagtcgacgtga

SEQ ID NO: 10360 - protein, 281 aa, Sorghum bicolor
  misc_feature: Ceres ANNOT ID no. 6112309
  misc_feature (79)..(277): Pfam Id: GLTP Pfam Desc: Glycolipid transfer protein (GLTP)
  misc_feature (26)..(281): NCBI GI: 116309799 NCBI Desc: h0525c06.1 [oryza sativa (indica cultivar-group)]
  misc_feature (26)..(281): NCBI GI: 38344077 NCBI Desc: osjnba0006b20.21 [oryza sativa (japonica cultivar-group)]
  misc_feature (1)..(185): NCBI GI: 115458530 NCBI Desc: os04g0438600 [oryza sativa (japonica cultivar-group)]
  misc_feature (63)..(281): NCBI GI: 115474419 NCBI Desc: os08g0108700 [oryza sativa (japonica cultivar-group)]
  misc_feature (138)..(280): NCBI GI: 18402939 NCBI Desc: glycolipid transfer protein-related [arabidopsis thaliana]
  misc_feature: Useful for making plants with modulated oxidative stress sensitivity
  misc_feature: Functional homolog of the protein sequence given in SEQ ID NO 13075
MVERERDEGEAARALTTGPPQQQQQEEEEEEEGAAEGESDEEAGDEREEEEDHRDDDEAVEWSEIRLAIEELSPPARLKHGGGGDDGKAAASSVPTLRFLALSHLLLRVLDKIGPTMAVLRLDVQRNIERLQELYLLDPAKYSTLTEVVEKEVKEGTARKVDSCARAVLWLARSMDFTIALLVSIEEDSDEQQQQSLAQLVEAAYEACLKPWHGWISSAACKIALKLIPERKVFTSLLLGMGQDCSDLKDEIRRLALLLRPLLDDIHSMMAKFRLDRLKST

SEQ ID NO: 10361 - DNA, 501 bp, Sorghum bicolor
  misc_feature: Ceres ANNOT ID no. 6112310
  misc_feature: Encodes the peptide sequence at SEQ ID NO 10362
atggctgtcacggcgacggcggcggcggcgtcgttgttcgagaccctggacaaggacggcgacggcaaggtgtcggcgtcggagctgcttggctgcgcggcggcggagctggacgaggaggaggccgcggcggtcgtcgcggtcgcggacgccgacggcgacggcctgctgtgccgcgacgagttcctcgggctggcgcgcgaggctgcggcgtcggcggaccagcaggccgaagacaggcggcggtgcctcagggtggcgttcgggatgttcgcggcggacgcggacggcggcgccacggcggcggagcagtgcatcacgccggcgagcctgcagcggatgctcggccggctggcggtgggggcgaagcagcagcagcagcagctggccttggacttggacgagtgccgggccatgatctgcaggttcgatctcgacggcgatggcgtcatttctttcgaagagtttagggtcatgatgcatgatggcctcttcttatga

SEQ ID NO: 10362 - protein, 166 aa, Sorghum bicolor
  misc_feature: Ceres ANNOT ID no. 6112310
  misc_feature (135)..(163): Pfam Id: efhand Pfam Desc: EF hand
  misc_feature (3)..(161): NCBI GI: 20161868 NCBI Desc: b1139b11.9 [oryza sativa (japonica cultivar-group)]
  misc_feature (12)..(160): NCBI GI: 22136314 NCBI Desc: calmodulin-like protein [arabidopsis thaliana]
  misc_feature (7)..(165): NCBI GI: 38346226 NCBI Desc: oj990528_30.6 [oryza sativa (japonica cultivar-group)]
  misc_feature (7)..(165): NCBI GI: 115459158 NCBI Desc: os04g0492800 [oryza sativa (japonica cultivar-group)]
  misc_feature (12)..(160): NCBI GI: 55773691 NCBI Desc: calmodulin-like protein [oryza sativa (japonica cultivar-group)]
MAVTATAAAASLFETLDKDGDGKVSASELLGCAAAELDEEEAAAVVAVADADGDGLLCRDEFLGLAREAAASADQQAEDRRRCLRVAFGMFAADADGGATAAEQCITPASLQRMLGRLAVGAKQQQQQLALDLDECRAMICRFDLDGDGVISFEEFRVMMHDGLFL

SEQ ID NO: 10363 - DNA, 2283 bp, Sorghum bicolor
  misc_feature: Ceres ANNOT ID no. 6112312
  misc_feature: Encodes the peptide sequence at SEQ ID NO 10364
atggacgtgaacgaggaggcaatggcggcacacaagcgcgccttcctcgacttcctcgaccaagacgtcgggaagggggtttacatgcaggccgtccgcgacatggtgcagaacaagcgccaccgcctcatcatcggcatggacgacctccgcaatcacaacctcgatctcgcccgcagggtgattcggagccccggggagtatatgcagccggcgtcggacgcggtgtcggaggtggccaagaacctggaccccaagttcttgaaggaaggggagcgcgtgatggtgggcttctcggggccgttcgggttccacagggtcacgcccagggatctcatgtcctccttcatcggcaccatggtctgcgttgagggcatcgtcaccaaatgctcgttggtaaggccaaaagttgttaagagtgttcacttctgccctgtgactggggcttttctgtcacgtgaatacagggacatcacttcttttgtaggcttgcctactggctctgtttatccaacaagggatgacaatggtaacttgttggtcactgagtatggaatgtgtgaatacaaggatcaccagacattgtccatgcaagaagtgcctgaaaattctgcacctggacagctcccaagaaccgtcgatgttattgttgaagatgatcttgtggattgttgcaaacccggcgaccgtgtctcaattgttggtgtatacaaggctctaccagggaaaagcaagggaagtgttagtggggtgttcagaactgtccttattgcaaataatgtgtcacttcttaacaaagaggcaaatgcacctgtctatactcgggaagatctgaagcggatgaaagaaatatcaaggagaaatgacacctttgacttgctgggaaactcacttgctccatccatatatggtcatctgtggataaagaaggcagtagtactattgatgcttggtggcgttgagaagaatctaaaaaatggaactcacttgagaggagatataaacatgatgatggtgggagatccttcagttgccaagtcccagctcctaagagctgtcatgaacattgcccctttggctatctcaacaactggcaggggttcatctggtgttggtttgactgctgctgtgacttctgatcaagagactggggaaagaaggcttgaagctggtgccatggttcttgcagatcgtggtgttgtctgcattgatgagtttgataaaatgaatgatcaagaccgagttgctattcatgaagttatggaacagcaaactgtaaccattgcaaaggcaggaatacatgcctcgctaaatgcgaggtgtagtgtaatttatgatcgttcattgacgccaacaaagaacatcgggcttccggattcactgctctctcgttttgatttactttttattgttcttgatcaaatggatcctgagattgatcggcaaatttcagaacacgttgcacgaatgcatagatattgcactgatgatggaggagcaaggtctcttgataaagagggatatgctgaagaagatggtgatgctaatgcagccatttttgttaagtatgatagaatgctccatggtcaggatagaagaagaggaaagaaagccaagcaagacaggctaactgtcaaatttctgaagaaatatattcattatgcgaagaaccttattcaaccgaagcttactgatgaggcatctgatcatattgcaacttcatatgctgagctcagggatggtagtgcaaatgcaaagtctggtggaggtacactcccaattacagcaaggacattggaaaccataattcgtctatctacagctcatgccaagatgaaactgaggcatgaggttctgaaatccgatgttgaggctgcattgcaagttctaaattttgcaatataccacaaggagttgactgatatggaagagcgtgaacagagagaaatggagatgaaacagcaagctgatcatgatgcagttgcaactggtggcactgtggatggacatggaagctctggaaacgatccaatggatgtggatgtaggaaacacttcaagaaatcaggatgttccagcagagagaattgaagcatttgaagcaattctcggtcagcatgtgttggcaaaccatgtagatcaaatgtcaattgatgaaatcgagcagacgattaatagggagtcaactgcaccttacaccagaagccaagtagagtttattttggagaggatgcaagatgcaaacagggtaatgatacgagatggtattgttcgaatcatataa

SEQ ID NO: 10364 - protein, 760 aa, Sorghum bicolor
  misc_feature: Ceres ANNOT ID no. 6112312
  misc_feature (277)..(635): Pfam Id: MCM Pfam Desc: MCM2/3/5 family
  misc_feature (1)..(760): NCBI GI: 5725518 NCBI Desc: replication origin activator 2 [zea mays]
  misc_feature (1)..(760): NCBI GI: 5725520 NCBI Desc: replication origin activator 3 [zea mays]
  misc_feature (1)..(760): NCBI GI: 114049619 NCBI Desc: roa protein [zea mays]
  misc_feature (1)..(760): NCBI GI: 115464471 NCBI Desc: os05g0476200 [oryza sativa (japonica cultivar-group)]
  misc_feature (169)..(760): NCBI GI: 2497820 NCBI Desc: dna replication licensing factor mcm3 homolog (replication origin activator) (roa protein)
MDVNEEAMAAHKRAFLDFLDQDVGKGVYMQAVRDMVQNKRHRLIIGMDDLRNHNLDLARRVIRSPGEYMQPASDAVSEVAKNLDPKFLKEGERVMVGFSGPFGFHRVTPRDLMSSFIGTMVCVEGIVTKCSLVRPKVVKSVHFCPVTGAFLSREYRDITSFVGLPTGSVYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIYDRSLTPTKNIGLPDSLLSRFDLLFIVLDQMDPEIDRQISEHVARMHRYCTDDGGARSLDKEGYAEEDGDANAAIFVKYDRMLHGQDRRRGKKAKQDRLTVKFLKKYIHYAKNLIQPKLTDEASDHIATSYAELRDGSANAKSGGGTLPITARTLETIIRLSTAHAKMKLRHEVLKSDVEAALQVLNFAIYHKELTDMEEREQREMEMKQQADHDAVATGGTVDGHGSSGNDPMDVDVGNTSRNQDVPAERIEAFEAILGQHVLANHVDQMSIDEIEQTINRESTAPYTRSQVEFILERMQDANRVMIRDGIVRII

SEQ ID NO: 10365 - DNA, 1485 bp, Sorghum bicolor
  misc_feature: Ceres ANNOT ID no. 6112321
  misc_feature: Encodes the peptide sequence at SEQ ID NO 10366
atgaaggacccggcgcaccgcacgaaggtggtgctccggcggctgccgccggcgatcgcgcagcaggccgtcgtggaccaggtcgacgcgcgcttcgctgggcggtacgactgggcgtgcttccgccccggcaatgccagccaaaagaatcataggtattctcgactttacctcaatttcaagcgcccagaggatgttgttgagtttgctgaggtcttcaatgggcacgtatttgtgaatgaaaagggtgctcaatttaaagcttttgtggaatattcaccatcacaacaggttcccaaatcaaatatcaagaaggatggccgtgaaggaactattatgaaagatccggagtacttggagtttcttgagcttatttcaaagcctactgagcatctgcctagtgctgaaattcagctcgaaaggaaagaagctgaaagggcagctgctggaaaggaggcacctgttgtgacacctcttatgatgtatgtccgccagcaaagggcagctaagagtatggctcagagacctggaagtagacttagcagaaaagttgcaggtgtcgtaactagcagttccagtcctaaaaggtcttctgagaagcgcagatcctccacgtatgttgtacgagacagtactaaggaaaagccaacctatatcatggtgccaaagagagaggagcatacacacagggaaaaagccattgctggaaattcaggtgatgccacaagtgggggaacatctggatctggtcaggctggtgaggctaaaagggacaaaattgtcattttgaaaggaagaggaaggacacctgatggagcaactcagcagtcatcaacccctgtgaagagtgtaccgccggcgacttctagactagaccagcgacctgaagccagtggaagaattattaaaactatactttcaaacaaggaaatccgcagttcaaatccatctcaacatgagcaggaaggtcatgtgtttaatactgagaaggataagcggccaccacgggctgtcaaccctcgtaccattgtgaaagatcagttagttgaaaattctgagagaagccattttgatgagaagactaatcatcttcatggctctgctccaattggtgagaaggttgaaaggcatgccagaaacagagatagacctgatcgtggtgtatgggcgcctcgccgctatgacaaatctacatctgggggtggttcacatgcctcatcgtcagatttccctcaaatacagtcacattctggagataatgtttcgcaaatagcagatggtcatggagacagaaagacagacacaaggggtcatggtggtagccgtggtgttcctgttgaaaatggacataggcatgccaaccgtcgtggtcctccacgtggtccaaaggaaactgaaatatctgctagcgtgcctgatggaaagaattcaaagaggggctctgctagttatggtgctcatgagaagtcaagttcaggctcgtga

SEQ ID NO: 10366 - protein, 494 aa, Sorghum bicolor
  misc_feature: Ceres ANNOT ID no. 6112321
  misc_feature (1)..(170): Pfam Id: Smg4_UPF3 Pfam Desc: Smg-4/UPF3 family
  misc_feature (1)..(489): NCBI GI: 116309808 NCBI Desc: h0525c06.10 [oryza sativa (indica cultivar-group)]
  misc_feature (1)..(489): NCBI GI: 115458546 NCBI Desc: os04g0440100 [oryza sativa (japonica cultivar-group)]
  misc_feature (1)..(331): NCBI GI: 39545659 NCBI Desc: oj000114_01.14 [oryza sativa (japonica cultivar-group)]
  misc_feature (7)..(488): NCBI GI: 92893882 NCBI Desc: nonsense-mediated decay upf3 [medicago truncatula]
  misc_feature (8)..(391): NCBI GI: 119610248 NCBI Desc: upf3 regulator of nonsense transcripts homolog b (yeast), isoform cra_a [homo sapiens]
MKDPAHRTKVVLRRLPPAIAQQAVVDQVDARFAGRYDWACFRPGNASQKNHRYSRLYLNFKRPEDVVEFAEVFNGHVFVNEKGAQFKAFVEYSPSQQVPKSNIKKDGREGTIMKDPEYLEFLELISKPTEHLPSAEIQLERKEAERAAAGKEAPVVTPLMMYVRQQRAAKSMAQRPGSRLSRKVAGVVTSSSSPKRSSEKRRSSTYVVRDSTKEKPTYIMVPKREEHTHREKAIAGNSGDATSGGTSGSGQAGEAKRDKIVILKGRGRTPDGATQQSSTPVKSVPPATSRLDQRPEASGRIIKTILSNKEIRSSNPSQHEQEGHVFNTEKDKRPPRAVNPRTIVKDQLVENSERSHFDEKTNHLHGSAPIGEKVERHARNRDRPDRGVWAPRRYDKSTSGGGSHASSSDFPQIQSHSGDNVSQIADGHGDRKTDTRGHGGSRGVPVENGHRHANRRGPPRGPKETEISASVPDGKNSKRGSASYGAHEKSSSGS

SEQ ID NO: 10367 - DNA, 1758 bp, Sorghum bicolor
  misc_feature: Ceres ANNOT ID no. 6112344
  misc_feature: Encodes the peptide sequence at SEQ ID NO 10368
atgtcgcagccggcggcgacggtggccgcggcggcgcagccgcagggtcgcggccccgcggggcgccagggcggcggcggcggcctggggcagaacatcgccggcatcgtgcggatggcggtgttctggtacttcgcggccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcatgagtccaacataccatatgcagtctggggacctaccagtactagaacacgatcattaacatactatccttcagagactctcaagcataatggctctttgtatgctcatgtttactttgcccgctcgggttaccctgtggaccctacagatccagaatatgagcagaaatctgcatttgggaggacacatcctgttgtggcattcttgccgaaatcaaaagctggtaaaaagaagagcttgcttggagattcagaagagcttgaagagcaagcaccacctaaggagaataaagaatttgaggataaagatgagggtcctactgaatatatatcttattggaaaccaaatgtaacaataaatcttgttgaagacttcacacgattgacagatctgaatgtggatccagctacgggcgattattatcctacagtattcttcaatgagttttggctactgagggataaattaatagcgcttaatgagactgtggaggaattgcctttaaaccttgaagttggtcctattagcatgaccaagtggcagttgtttttacagattgagcagtccttccaggttcatcgtagttatggaagtatgcttgaaggcgaggctgatgaactcaagagggttttccttgaaggaaatccttatcttcttggattgactatggttgtttctctattacattctctgtttgatttcctggccttcaaaaatgatatccagttctggaacaagaacaagtccatggaaggtttatcggcaaaatctgtggttctgaattttgtgtgtcaactagttgttttcctgtaccttcttgacaatgacacttcatggatgatccttgctagctctggaattggtgtgtgcattgaattttggaaaatcggaaaggcgatgcatattgaggtcgatagaagtggaaaaattcccatgttgaggttccgagaccgcgaatcatatgcacagaataagaccaaagagtacgatgccattgcaatgaagtaccttacctatgttcttttcctacttgtgatcggtttctctatctattcacttaagtatgaaaagcacaagagctggtactcatggatactttcttccatgacaagttgtgtgtacatgtttggtttcattatgatgtgcccccaattatttatcaactacaagctgaagtctgttgctcatatgccatggagacaaatgacctacaagttcctcaacactataattgatgacctttttgcatttgtcattaaaatgccaatgcttcatcgtctctcagttttcagagatgatgttatcttcttgatatacctctatcagaggtggaaatatccggttgacaagaagcgtgtcaatgagtttggcttcggaggcgaggacgaaccggcagcccagggggctctggaaggaagtgcagcccagccaacggaggctgaggccgaggacaagaaaaccaagtga

SEQ ID NO: 10368 - protein, 585 aa, Sorghum bicolor
  misc_feature: Ceres ANNOT ID no. 6112344
  misc_feature (30)..(561): Pfam Id: CLPTM1 Pfam Desc: Cleft lip and palate transmembrane protein 1 (CLPTM1)
  misc_feature (1)..(585): NCBI GI: 38346578 NCBI Desc: osjnba0064d20.9 [oryza sativa (japonica cultivar-group)]
  misc_feature (12)..(585): NCBI GI: 115458556 NCBI Desc: os04g0441900 [oryza sativa (japonica cultivar-group)]
  misc_feature (1)..(560): NCBI GI: 20466780 NCBI Desc: cleft lip and palate associated transmembrane protein-like [arabidopsis thaliana]
  misc_feature (63)..(583): NCBI GI: 60467873 NCBI Desc: cleft lip and palate transmembrane 1 protein [dictyostelium discoideum]
  misc_feature (1)..(583): NCBI GI: 50417368 NCBI Desc: zgc:100803 protein [danio rerio]
MSQPAATVAAAAQPQGRGPAGRQGGGGGLGQNIAGIVRMAVFWYFAAKFFGPKRPPADPGMLMSNLFQKGEPMDMWMYLSENEKFNDFANEDALIWHESNIPYAVWGPTSTRTRSLTYYPSETLKHNGSLYAHVYFARSGYPVDPTDPEYEQKSAFGRTHPVVAFLPKSKAGKKKSLLGDSEELEEQAPPKENKEFEDKDEGPTEYISYWKPNVTINLVEDFTRLTDLNVDPATGDYYPTVFFNEFWLLRDKLIALNETVEELPLNLEVGPISMTKWQLFLQIEQSFQVHRSYGSMLEGEADELKRVFLEGNPYLLGLTMVVSLLHSLFDFLAFKNDIQFWNKNKSMEGLSAKSVVLNFVCQLVVFLYLLDNDTSWMILASSGIGVCIEFWKIGKAMHIEVDRSGKIPMLRFRDRESYAQNKTKEYDAIAMKYLTYVLFLLVIGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYLYQRWKYPVDKKRVNEFGFGGEDEPAAQGALEGSAAQPTEAEAEDKKTK

SEQ ID NO: 10369 - DNA, 1041 bp, Sorghum bicolor
  misc_feature: Ceres ANNOT ID no. 6112371
  misc_feature: Encodes the peptide sequence at SEQ ID NO 10370
  misc_feature: Down-regulated in root tissues in response to aminocyclopropane carboxylic treatment
  misc_feature: Up-regulated in root tissues in response to salicylic acid treatment
atggagaccccgccgctctcctcgttgcaggaggagggggaggaggagcccaccgtcgaggactcgtccgccttctccgccgccgccgtcccgcctcgccccgccacgcacagccactcgctccacaagtacgcgccgctggactggtccgcctacttcgacgaggagcgccgcgtagccatcctcgacaccgacgacgttttcaatgtgtacacggccggatcggaggggcccgtcgtgttctgcctgcacggaggtggctactcagggctttcatttgctctagcagcaagtcgaatgaaggacaagactcgtgttgttgccatggatctacggggacatgggaaatcaacaacgaatgatgatctggatttgtccatcgaaactcttaccaatgatgtcatagctgttatacgtacaatgtatggagatctgccaccagcaattatactcgttgggcatagcatgggtggttcagtggctgtacatgtggctgcaagaaaagaaattcgaaatcttcatgggcttgttgtagttgatgttgttgagggaacagcaatggcttcactggttcatatgcagaagatcttagcaaatcgggcacagcattttcctagcattgaaaaagcaattgagtggagtgtcaaaggtgggccattaaggaacgtcgagtctgctcgtgtgtccattccatctaccttgaaatatgatgaatcacgagaatgctatacatatagcactcctcttgagcaaacagaaaagtactggaaaggatggtatgaaggtctttcagacaagttcctatcttgcccagtgcaaaagatcctattgttagctggtaccgacagactagacagagctttaacaattggtcaaatgcaaggaaagtttcaaatggtggtggttcggcacactggacatgccatacaggaagatgtacctgaagagtttgcatcgcacatactgaatttcatatcccgcaacaaaataggcccaaacggtgttgagatacctgggcttattaaaaaatggcagcactag

SEQ ID NO: 10370 - protein, 346 aa, Sorghum bicolor
  misc_feature: Ceres ANNOT ID no. 6112371
  misc_feature (104)..(323): Pfam Id: Abhydrolase_1 Pfam Desc: alpha/beta hydrolase fold
  misc_feature (1)..(346): NCBI GI: 115458578 NCBI Desc: os04g0443500 [oryza sativa (japonica cultivar-group)]
  misc_feature (6)..(345): NCBI GI: 20148343 NCBI Desc: lipase-like protein [arabidopsis thaliana]
  misc_feature (170)..(346): NCBI GI: 32479665 NCBI Desc: p0041a24.6 [oryza sativa (japonica cultivar-group)]
  misc_feature (44)..(238): NCBI GI: 20809834 NCBI Desc: protein phosphatase methylesterase 1 [mus musculus]
  misc_feature (44)..(238): NCBI GI: 7706645 NCBI Desc: protein phosphatase methylesterase-1 [homo sapiens]
  misc_feature: Down-regulated in root tissues in response to aminocyclopropane carboxylic treatment
  misc_feature: Up-regulated in root tissues in response to salicylic acid treatment
METPPLSSLQEEGEEEPTVEDSSAFSAAAVPPRPATHSHSLHKYAPLDWSAYFDEERRVAILDTDDVFNVYTAGSEGPVVFCLHGGGYSGLSFALAASRMKDKTRVVAMDLRGHGKSTTNDDLDLSIETLTNDVIAVIRTMYGDLPPAIILVGHSMGGSVAVHVAARKEIRNLHGLVVVDVVEGTAMASLVHMQKILANRAQHFPSIEKAIEWSVKGGPLRNVESARVSIPSTLKYDESRECYTYSTPLEQTEKYWKGWYEGLSDKFLSCPVQKILLLAGTDRLDRALTIGQMQGKFQMVVVRHTGHAIQEDVPEEFASHILNFISRNKIGPNGVEIPGLIKKWQH

SEQ ID NO: 10371 - DNA, 651 bp, Sorghum bicolor
  misc_feature: Ceres ANNOT ID no. 6112375
  misc_feature: Encodes the peptide sequence at SEQ ID NO 10372
atggaccaaatgggcaagcacgtccacgtcctgcagatggcttccatggcgagcggcggcggctgccagtcgttgtcgtcgtcgtcgtcgcagcagcagcagcagcagcagtaccggggcgtgcggaagcggaagtggggcaagtgggtgtcggagatcaggcagccgggcaccaagacgcgcatctggctgggcagcttcgagtcggcggagatggcggccgtggcgcacgacgtggccgcgctgcgcctgcggggccgcgacgcgcagctcaacttccccgggtgcgtcgcctggctgccccgcccggcgacctcgaacccggccgacgtccgcgccgccgcggccgaggccgccgaccgggtgcgctgcgacccggcgctgctgctgctgcagcaagtgcaggcgcaggcgcaggcggcggcacggggccacgaccacgacgagttcggagccgggccggggccggggcccgtggtggtcgagctcgggagcgacgaggagttcgagctggacctggactcgcccaggctgtgggccgagatggcggaggccatgctcctcgacccgccgggatgggccaccgccgtcggcgaggccgaggtggcccagcagtgctggtcacacggctccctctgggacgcctgctag

SEQ ID NO: 10372 - protein, 216 aa, Sorghum bicolor
  misc_feature: Ceres ANNOT ID no. 6112375
  misc_feature (36)..(87): Pfam Id: AP2 Pfam Desc: AP2 domain
  misc_feature (14)..(216): NCBI GI: 21742878 NCBI Desc: osjnba0058g03.2 [oryza sativa (japonica cultivar-group)]
  misc_feature (34)..(119): NCBI GI: 125995281 NCBI Desc: embryonic element binding factor 2 [daucus carota]
  misc_feature (19)..(125): NCBI GI: 38605844 NCBI Desc: osjnbb0034g17.2 [oryza sativa (japonica cultivar-group)]
  misc_feature (34)..(179): NCBI GI: 125995279 NCBI Desc: embryonic element binding factor 1 [daucus carota]
  misc_feature (24)..(122): NCBI GI: 9279711 NCBI Desc: transcription factor tiny-like protein [arabidopsis thaliana]
  misc_feature: The sequence is a functional homolog of SEQ ID NO 1222 in the 10/374,780US patent application
  misc_feature: The sequence is a functional homolog of SEQ ID NO 1226 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1411 in the 10/412,699US patent application
  misc_feature: The sequence is a functional homolog of SEQ ID NO 147 in the 11/479,226US patent application
  misc_feature: The sequence is a functional homolog of SEQ ID NO 164 in the 11/375,241US patent application
  misc_feature: The sequence is a functional homolog of SEQ ID NO 2214 in the 10/374,780US patent application
  misc_feature: The sequence is a functional homolog of SEQ ID NO 2233 in the 10/666,642US patent application
  misc_feature: The sequence is a functional homolog of SEQ ID NO 290 in the 10/374,780US patent application
  misc_feature: The sequence is a functional homolog of SEQ ID NO 6 in the 10/225,066US patent application
  misc_feature: The sequence is a functional homolog of SEQ ID NO 692 in the 10/225,066US patent application
  misc_feature: The sequence is a functional homolog of SEQ ID NO 706 in the 11/435,388US patent application
  misc_feature: The sequence is a functional homolog of SEQ ID NO 712 in the 11/435,388US patent application
  misc_feature: The sequence is a functional homolog of SEQ ID NO 718 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with modulated growth and phenotype characteristics
  misc_feature: The sequence is a functional homolog of SEQ ID NO 1411 in the 20040045049 US patent application
  misc_feature: The sequence is a functional homolog of SEQ ID NO 6 in the 20050160493 US patent application
  misc_feature: The sequence is a functional homolog of SEQ ID NO 692 in the 20050160493 US patent application
  misc_feature: The sequence is a functional homolog of SEQ ID NO 96 in the 20060015972 US patent application
  misc_feature: The sequence is a functional homolog of SEQ ID NO 1226 in the 20060162006 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
MDQMGKHVHVLQMASMASGGGCQSLSSSSSQQQQQQQYRGVRKRKWGKWVSEIRQPGTKTRIWLGSFESAEMAAVAHDVAALRLRGRDAQLNFPGCVAWLPRPATSNPADVRAAAAEAADRVRCDPALLLLQQVQAQAQAAARGHDHDEFGAGPGPGPVVVELGSDEEFELDLDSPRLWAEMAEAMLLDPPGWATAVGEAEVAQQCWSHGSLWDAC

SEQ ID NO: 10373 - DNA, 624 bp, Sorghum bicolor
  misc_feature: Ceres ANNOT ID no. 6112377
  misc_feature: Encodes the peptide sequence at SEQ ID NO 10374
atgggcaacgaattcgattacctgttcaagcttctcttgatcggcgattcctcggtgggcaagtcctgcttcctcctccgtttcgctgacgactcctatgtagacagctacatcagcacgattggtgttgactttaaaatccgcacgatcgagatggagggcaagaccataaagctgcagatttgggacacggcagggcaggagcggttcaggaccattacaagcagctactaccgaggagctcatgggataattattgtttatgacatcacagacatggagagcttcaacaatgtgaagcagtggcttagtgagattgatcgatacgccaatgacaccgtatgcaagcttcttgttggcaacaaatgtgatcttgctgagagcaggactgtcgatacttcagtagcacaggcttatgctgaagagataggcatcccgttccttgaaactagtgctaaagactcgatcaatgtcgaggaggcgttcttggcaatgtctgctgcaattaagaacagtaaagcacggagtcaggcagccctggagaggaagccctccaatatagttcagatgaaagggcagccaattcagcaagagcagcagaagagtagatgctgttcaacatga

SEQ ID NO: 10374 - protein, 207 aa, Sorghum bicolor
  misc_feature: Ceres ANNOT ID no. 6112377
  misc_feature (10)..(171): Pfam Id: Ras Pfam Desc: Ras family
  misc_feature (10)..(124): Pfam Id: Miro Pfam Desc: Miro-like protein
  misc_feature (1)..(187): Pfam Id: Arf Pfam Desc: ADP-ribosylation factor family
  misc_feature (1)..(207): NCBI GI: 89027972 NCBI Desc: small gtp binding protein rab1a [saccharum officinarum]
  misc_feature (1)..(207): NCBI GI: 89027974 NCBI Desc: small gtp binding protein rab1a [saccharum officinarum]
  misc_feature (1)..(207): NCBI GI: 287833 NCBI Desc: yptm1 [zea mays]
  misc_feature (1)..(207): NCBI GI: 227603 NCBI Desc: guanine nucleotide binding protein
  misc_feature (1)..(205): NCBI GI: 4096662 NCBI Desc: rab1-like small gtp-binding protein [petunia x hybrida]
  misc_feature: Useful for making plants with altered lignin content
  misc_feature: Functional homolog of the protein sequence given in SEQ ID NO 12946
  misc_feature: Useful for making plants with modulated oxidative stress sensitivity
  misc_feature: Functional homolog of the protein sequence given in SEQ ID NO 13074
  misc_feature: The sequence is a functional homolog of SEQ ID NO. 400 in the 11/188,298 US application
MGNEFDYLFKLLLIGDSSVGKSCFLLRFADDSYVDSYISTIGVDFKIRTIEMEGKTIKLQIWDTAGQERFRTITSSYYRGAHGIIIVYDITDMESFNNVKQWLSEIDRYANDTVCKLLVGNKCDLAESRTVDTSVAQAYAEEIGIPFLETSAKDSINVEEAFLAMSAAIKNSKARSQAALERKPSNIVQMKGQPIQQEQQKSRCCST

SEQ ID NO: 10375 - DNA, 1080 bp, Sorghum bicolor
  misc_feature: Ceres ANNOT ID no. 6112386
  misc_feature: Encodes the peptide sequence at SEQ ID NO 10376
atggccagcggcggcgctaacactgtccccctcgccactccctacaagatgggaaaatttgatctttcccacagggtagttctcgcaccactgacgagacagcggtcctacggcaatgttcctcaacctcatgccatactgtattatcaacagagaacgactaaaggaggtcttctaattgctgaggccactggagtgtcagacactgctcaagggtacaaagacacccctggcatttggaccaatgagcaagtcgaagcttggaagccaatcgtagatggggttcatcagaaaggagggatatttttctgtcagatttggcacgtagggagagtctctaattccagttttcagcctaatgggcaggctccaatttcaagcactgataagccactaaaacctcaagtgagagccaatggtgtagatgtggctactttcacacctcctagacgcttagagactgatgaaatccctttggtcatcaatgatttcagggtagctgctagaaatgcaattgaagctgggtttgatggtgttgaaatccatggagctcacggttacttgattgatcagtttctaaaggatcaggtcaatgatcgcacagacaaatatggtggcagtttagagaatcgttgccggtttgcactagaaatagttcaagctgtagttgatgaaattggtgctgacaaggtcgggataaggctgtcaccctttgccagttattctgaagcaccggactcaaaccctgaagctcttggcctgtatatggcaaggcactggataaatttggaattctctattgccacatggtggagccgcggatgtcttcgtccaatgagggatgctttcaagggaacatttatagttgctgggggctacaccagggaggatggaaatgacgcaatctccactgggtatgctgatttgattgcatatgggcgcttgtttttgtctaatcctgacttgcctcgaaggttggaaatagatggtccccttaacaagtacaacagagatacattttacatccctgatccagttattggatatacagactacccatttctttcatcagatgtgtga

SEQ ID NO: 10376 - protein, 359 aa, Sorghum bicolor
  misc_feature: Ceres ANNOT ID no. 6112386
  misc_feature (10)..(333): Pfam Id: Oxidored_FMN Pfam Desc: NADH:flavin oxidoreductase / NADH oxidase family
  misc_feature (1)..(359): NCBI GI: 63021727 NCBI Desc: 12-oxo-phytodienoic acid reductase [zea mays]
  misc_feature (9)..(355): NCBI GI: 40645459 NCBI Desc: ledi-5c protein [lithospermum erythrorhizon]
  misc_feature (1)..(357): NCBI GI: 56382003 NCBI Desc: at1g76680 [arabidopsis thaliana]
  misc_feature (1)..(175): NCBI GI: 42572133 NCBI Desc: 12-oxophytodienoate reductase (opr1) [arabidopsis thaliana]
  misc_feature (1)..(357): NCBI GI: 21593388 NCBI Desc: 12-oxophytodienoate reductase (opr1) [arabidopsis thaliana]
  misc_feature (1)..(357): SWISSPROT Homolog: EC 1.3.1.42 12-oxophytodienoate reductase 1
  misc_feature: Useful for making plants with modulated water use efficiency
  misc_feature: Functional homolog of the protein sequence given in SEQ ID NO 13609
MASGGANTVPLATPYKMGKFDLSHRVVLAPLTRQRSYGNVPQPHAILYYQQRTTKGGLLIAEATGVSDTAQGYKDTPGIWTNEQVEAWKPIVDGVHQKGGIFFCQIWHVGRVSNSSFQPNGQAPISSTDKPLKPQVRANGVDVATFTPPRRLETDEIPLVINDFRVAARNAIEAGFDGVEIHGAHGYLIDQFLKDQVNDRTDKYGGSLENRCRFALEIVQAVVDEIGADKVGIRLSPFASYSEAPDSNPEALGLYMARHWINLEFSIATWWSRGCLRPMRDAFKGTFIVAGGYTREDGNDAISTGYADLIAYGRLFLSNPDLPRRLEIDGPLNKYNRDTFYIPDPVIGYTDYPFLSSDV

SEQ ID NO: 10377 - DNA, 1113 bp, Sorghum bicolor
  misc_feature: Ceres ANNOT ID no. 6112387
  misc_feature: Encodes the peptide sequence at SEQ ID NO 10378
atgacgagcaatgacgacggtgccaacaacaatggccccctcctcaccccttacaagatgggcaagtttcgtctttcccacagggtggttcttgcaccactaacgaggcagcgttcatacggtaatgttcctcagcctcatgccatactgtattatcaacagagaacaactgaaggagggcttctgatctccgaggccactggagtgtctgacacagctcaagggtacaaggatactcccggcatctggacaaaggagcaagtggaagcgtggaagccaatagtagacggggttcatgccaaaggaggaacatttttctgtcagatttggcacgtagggagagtctccaattccacttttcagcctaatgggcaggctccaatttcaagcactgataagccagtacagtcaaaacatgtggataagttcactcctcttcctcctagaagattagagaccgatgaaatcccttttatcgtcaacgatttcagggtagccgctagaaatgcaattgaagctggatttgatggtgttgaaattcatggagctcacggttacttgatcgatcaatttttaaaggaccatgtcaatgatcgcacagacatatatggtgccagcttagagaaccgttgccggtttgcagtagaaataattcaggcggtagttgatgagattggagctgacaaggttgggataaggctttcaccttttgcaaattattcgggagcagtagactcaaacccggaagctctaggcctgtatatggcaaatgcactgaacaattttggagttctctattgtcatgtggtggtgccacggatggtgaaaaatggtgaaaattttgaaactcccagccatattgggttaatgaggagtgcttttaaaggaacaatcattgttgctggcggctacagtagggaggatggagattatgcagtctctagtggctatgctgatttggttgcatatgggcgcttatttctgtccaatcctgacttgcctcggaggtttgaaattgatgctaccctgaacaagtacaacagcgagactttttacactcctgatccagttatcggatatactgactacccatttcttccatcagatgtctaa

SEQ ID NO: 10378 - protein, 370 aa, Sorghum bicolor
  misc_feature: Ceres ANNOT ID no. 6112387
  misc_feature (13)..(344): Pfam Id: Oxidored_FMN Pfam Desc: NADH:flavin oxidoreductase / NADH oxidase family
  misc_feature (7)..(370): NCBI GI: 63021727 NCBI Desc: 12-oxo-phytodienoic acid reductase [zea mays]
  misc_feature (13)..(366): NCBI GI: 40645459 NCBI Desc: ledi-5c protein [lithospermum erythrorhizon]
  misc_feature (9)..(366): NCBI GI: 2232254 NCBI Desc: old-yellow-enzyme homolog [catharanthus roseus]
  misc_feature (13)..(366): NCBI GI: 44917012 NCBI Desc: 12-oxophytodienoic acid 10,11-reductase [pisum sativum]
  misc_feature (8)..(368): NCBI GI: 56382003 NCBI Desc: at1g76680 [arabidopsis thaliana]
  misc_feature (8)..(368): SWISSPROT Homolog: EC 1.3.1.42 12-oxophytodienoate reductase 1
  misc_feature: Useful for making plants with modulated water use efficiency
  misc_feature: Functional homolog of the protein sequence given in SEQ ID NO 13609
MTSNDDGANNNGPLLTPYKMGKFRLSHRVVLAPLTRQRSYGNVPQPHAILYYQQRTTEGGLLISEATGVSDTAQGYKDTPGIWTKEQVEAWKPIVDGVHAKGGTFFCQIWHVGRVSNSTFQPNGQAPISSTDKPVQSKHVDKFTPLPPRRLETDEIPFIVNDFRVAARNAIEAGFDGVEIHGAHGYLIDQFLKDHVNDRTDIYGASLENRCRFAVEIIQAVVDEIGADKVGIRLSPFANYSGAVDSNPEALGLYMANALNNFGVLYCHVVVPRMVKNGENFETPSHIGLMRSAFKGTIIVAGGYSREDGDYAVSSGYADLVAYGRLFLSNPDLPRRFEIDATLNKYNSETFYTPDPVIGYTDYPFLPSDV

SEQ ID NO: 10379 - DNA, 918 bp, Sorghum bicolor
  misc_feature: Ceres ANNOT ID no. 6112398
  misc_feature: Encodes the peptide sequence at SEQ ID NO 10380
atgtcagcgttgccggagaacatcgtcgcaggcggcagtggcccggcgccggtcccgtggtggagcgcttcctcgccggtgggcggcgacgtcgtcctctccggcgtagtcctcctcttcgccgccctggccttcgcgttcgtcctgtaccactacttcacagtcacggtcgtcagtcgccgcggtggcagtggcacgcgggagcgggagcgggacggcgcggcggtggggccgccatcgagcgctgcccagcagcgcggcacgttgttgggagggcgcgatggccatggccttgacccgtcgtcggtgctccgggcgttgccgctgacggtttacaaggcgaagggccgggcagcaggcgaggcgctggagtgcgcggtgtgcctcgccgaactcaccgacggcgaggccgccaggttcctgccccggtgccagcacggcttccacgccgagtgcatcgacctgtggctgcgcggccactccacgtgcccgctatgccgcgtcgacgtcgacctgctccctcctgcgccgccgtcgtcgtcgtcgtcgtcctcggccctccctccggcgctgccggagcccgccaactaccccatgaacctgccgacgaacgtcctgttctggggatcccaggacgcggtcaccgtggcgagactgagagcctccgggacgaggacgacgacggtacacagcggcccgagcgctccgagtggagcgtcgccgccgctggccatccatgtcagggaagcgacaccaccggcagtggcaccgccgacgcgtgaaggcgacgcggcgaaagcccaggggttgttggcgaggctgagttctctcaggcggctgtggagcagagggtcgacgcatgatgcggcggctattggacacacgctcccatgcagggcaacaaaccacctagtttag

SEQ ID NO: 10380 - protein, 305 aa, Sorghum bicolor
  misc_feature: Ceres ANNOT ID no. 6112398
  misc_feature (125)..(166): Pfam Id: zf-C3HC4 Pfam Desc: Zinc finger, C3HC4 type (RING finger)
  misc_feature (10)..(241): NCBI GI: 60389473 NCBI Desc: e3 ubiquitin ligase el5
  misc_feature (10)..(241): NCBI GI: 46391016 NCBI Desc: el5 [oryza sativa (japonica cultivar-group)]
  misc_feature (15)..(284): NCBI GI: 21645888 NCBI Desc: ring-h2 zinc finger protein [zea mays]
  misc_feature (15)..(284): NCBI GI: 99866708 NCBI Desc: ring-h2 zinc finger protein [zea mays]
  misc_feature (12)..(284): NCBI GI: 55741078 NCBI Desc: znf [zea mays]
  misc_feature: The sequence is a functional homolog of SEQ ID NO 1131 in the 10/666,642US patent application
  misc_feature: Useful for making plants with modulated growth and phenotype characteristics
  misc_feature: The sequence is a functional homolog of SEQ ID NO 1131 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MSALPENIVAGGSGPAPVPWWSASSPVGGDVVLSGVVLLFAALAFAFVLYHYFTVTVVSRRGGSGTRERERDGAAVGPPSSAAQQRGTLLGGRDGHGLDPSSVLRALPLTVYKAKGRAAGEALECAVCLAELTDGEAARFLPRCQHGFHAECIDLWLRGHSTCPLCRVDVDLLPPAPPSSSSSSSALPPALPEPANYPMNLPTNVLFWGSQDAVTVARLRASGTRTTTVHSGPSAPSGASPPLAIHVREATPPAVAPPTREGDAAKAQGLLARLSSLRRLWSRGSTHDAAAIGHTLPCRATNHLV

SEQ ID NO: 10381 - DNA, 1473 bp, Sorghum bicolor
  misc_feature: Ceres ANNOT ID no. 6112407
  misc_feature: Encodes the peptide sequence at SEQ ID NO 10382
atgtcggagtccgaggcgacgctggaggacacgccgacatggatcgtggcgtccgtgtgctccgtcatcgtcctcatctccttcgtcttcgagcgcgcgctccatcgcctcggcaaggcactgcagcgccggaggaagaccctgtacgaggcgctgctgaagctcaaagaagagctgatgctgctggggttcgtctcgctgctgctcgtcgtcttccaggagctgatacagaagatctgcatcgacgagggcctcatggagcactggctgccgtgccggggcgcgagcgccaccaccacctcggcgtcggaggcgacggttcgtcacggcgtctcctcctccgcagtcgtcgtcggtggcgggaggaggatgctcaaaggcggcggggcagcttttgggcactgttcaagcaagggaaaagtcccgttgctatcacttcacgccttggagcaggtacacattttcatcttcgtcctagccatcagtcaagtcgttctcagcgtcgccaccgtcctcctgggacttctacagatgcggatatggatgcactgggagaacaccattcaggaagagggcagctctgctcccaagatgatcgcccgtgtgcagaaaatcaggttcgtccaggactggtgtaaggggtacgagaagttctacggatcagtatccaacgacgactacattgcgatgaggcttggtttcgtcatggagcactttagggggcaccccaagttcaatttttatgactacatgatcaaagctctcgagaaagatttcaagagagtagttagtataaaatggtattactggatttttgtgatgatctttttgctactcaacatcaccgggtggcattcctacttctggatctcattagttccgttggctctgctgcttctgattggaacaaagctggagcacatcataaacaagctggcctacgaggtggcctccaagcacgccgctgggcaagggggtgaagggggcatcgtcgtgagcccttcagacgagctgttctggtttcacagcccacggctggtgctcgtcctcatccacttcatcctctttcagaacgccttcgagttcgcgtatttcttctggacactggcgatgttcggcgtcaactcctgcattatggacagtctaggatacagcgtatcgcgaatcatcatatgcgtcgtcgtccaggtgctctgcagctacagcacgctcccgctctacgccattgtgtcccatatggggagttcgttcaagagcgccgtgttcgcggacgacgtcgccgagcatctcagaggctgggccgacggcgctcggaggcgcgtgcgaagatcagccacggatgtcgacgccaccgccagttgcctgggtacgccggcggcgggacgacggggctgggaaggcgctgccgccggctggagattggtggccgggaggagccgcccaacgcagcagcctcggagcatctccttctga

SEQ ID NO: 10382 - protein, 490 aa, Sorghum bicolor
  misc_feature: Ceres ANNOT ID no. 6112407
  misc_feature (4)..(483): Pfam Id: Mlo Pfam Desc: Mlo family
  misc_feature (1)..(490): NCBI GI: 13784979 NCBI Desc: seven transmembrane protein mlo3 [zea mays]
  misc_feature (8)..(453): NCBI GI: 46405143 NCBI Desc: mlo3 [hordeum vulgare subsp. vulgare]
  misc_feature (2)..(461): NCBI GI: 13784989 NCBI Desc: seven transmembrane protein mlo8 [zea mays]
  misc_feature (1)..(452): NCBI GI: 42571225 NCBI Desc: seven transmembrane mlo family protein / mlo-like protein 15 (mlo15) [arabidopsis thaliana]
  misc_feature (1)..(452): NCBI GI: 14091600 NCBI Desc: membrane protein mlo15 [arabidopsis thaliana]
  misc_feature: Useful for making plants with modulated biotic stress sensitivity
  misc_feature: Functional homolog of the protein sequence given in SEQ ID NO 13417
  misc_feature: Useful for making plants with modulated biotic stress sensitivity
  misc_feature: Functional homolog of the protein sequence given in SEQ ID NO 13615
MSESEATLEDTPTWIVASVCSVIVLISFVFERALHRLGKALQRRRKTLYEALLKLKEELMLLGFVSLLLVVFQELIQKICIDEGLMEHWLPCRGASATTTSASEATVRHGVSSSAVVVGGGRRMLKGGGAAFGHCSSKGKVPLLSLHALEQVHIFIFVLAISQVVLSVATVLLGLLQMRIWMHWENTIQEEGSSAPKMIARVQKIRFVQDWCKGYEKFYGSVSNDDYIAMRLGFVMEHFRGHPKFNFYDYMIKALEKDFKRVVSIKWYYWIFVMIFLLLNITGWHSYFWISLVPLALLLLIGTKLEHIINKLAYEVASKHAAGQGGEGGIVVSPSDELFWFHSPRLVLVLIHFILFQNAFEFAYFFWTLAMFGVNSCIMDSLGYSVSRIIICVVVQVLCSYSTLPLYAIVSHMGSSFKSAVFADDVAEHLRGWADGARRRVRRSATDVDATASCLGTPAAGRRGWEGAAAGWRLVAGRSRPTQQPRSISF

SEQ ID NO: 10383 - DNA, 2277 bp, Sorghum bicolor
  misc_feature: Ceres ANNOT ID no. 6112413
  misc_feature: Encodes the peptide sequence at SEQ ID NO 10384
atggcccacgagcgggagccgctcctgcagcaacgacagaccggcgtcggcaatgccgccgccggtgctaagggctcgtcctcggcgccggcgccggcggcctctgccgcgctgccgtcgctggctaggaccgtgctcaagttcctgatgtgggcggtgttcctcacctgggccgcggggatcttcctgtacccgaccaagcccgtgcaggcagtgttcacgaagtgggtcaggctcagcaaggagtccatgttcggcatcgccgggggtattttcctggccttcagcgcgcccattctgatcattgcgcttctggcatatgtctacatctcattcttcccgagtgagcgtgtggtggaaaaaaagaagctgcggtcactgagtttcaggctctggactttccctgttcttgtagacggcccctttggagttgtctctgcagctgagttcatcggaattgtcctgtttataatttttgttgtctactcaatgacctattatgccgtggagagcgtgagccttgtctcaaaatttgaccttccatcaatgactcagagtgaattgatactggatgtcattggcgcccgttttggggcggttgggttgttctgcatgctcttcctcttcctgccagtcgcaagaggctcagttctcctccggcttatcgatattccatttgagcatgctacaagataccacgtctggttgggtcatctcactatggctctctttacattgcatggcttgttctttgtgatctcatggtccatggaagggcgcctccgtgaagaaatgagagaatggaatgaaactggagtagcaaacctgcctggtgtgatcagcttggcagccggcctacttatgtgggtgacatcacttcacccagtgaggaagaggttctttgagctcttcttctacacccaccagctctacgtcatcttcatcgtgttcttggcgttccatgtcggcaacttcctcttcagtatttcggccggggttgtgttcctcttcatgctcgaccgctttttaaggttctggcagtcaagggccaaagttgacatcatttcagccgcctgccgcccatgtgggacggtggagctagtattttcaaaaccaccaggcctccgctacaatgctttgagtttcatcttcattcaagtgcgcgagctatcgttcttgcagtggcatccgttcagtgtatcttcaagtcccatggatgggagataccacatgtcggttctcataaaaatactcggcacatggactgaaaaactgaggagcatcatcaccgatgtccaggacaagaacaggggtgactctgagttgcaatgcggacgcatgacagcctgcgtggaaggcccgtatgggtacgagaatctcatcttggtggcaggaggcattggaatatcgccgttcttggcgatcttgagcgacataatccacaggatcgaggagggcaagcaatgcatgcccaagaacgtgctggtcctttggtcagtcaagaagtccaaggagctttctctcttgtccgctgttgatgctcagaccatcagttcatctgtctcggacaggttgaaactggacatccaggccttcgtgactcaagaatccttgcccccattggaggacggcatcgtcgtggacgaccgcaaagtccctggcatgttcgtcaagaacggttcgaccatgtctggtctggtcggcaccggggacaacttctgggcggccatgtacttcctggcgtccacgctcggcttcctcctggcgttcaccctggtggaggcttactacgtgaagccgcacaacgtggtggcgtggtggtaccggagcctcctgttcatgctgtgcatggttgccggcgtcgccctacccggcggcctcgtggttctcctgtggcatctgtcggagaagcagaggatggagggcgacaagtgggacgccgccgccgattcccagtcaccgcgcgccgagcagacaggccccgcggctgcggcaggtggcggtgacgacgacgctgtccccggcgtcagcctcgccgccctgcggacgacccggtacgggtgccggccgaacttcgaagcggagttcgcggcgttcgcggagcgcgccggggacgcggcggacgtgggcgtgctggtgtgcggaccgccggggctgcagacgagcgtggcgagggagtgcagggcgcggaacctccgccgccgcggcggcggcggggcggagaagagcaggagcagcgcggtcttccatttcaacagccacagcttcgacctctaa

SEQ ID NO: 10384 - protein, 758 aa, Sorghum bicolor
  misc_feature: Ceres ANNOT ID no. 6112413
  misc_feature (197)..(319): Pfam Id: Ferric_reduct Pfam Desc: Ferric reductase like transmembrane component
  misc_feature (349)..(459): Pfam Id: FAD_binding_8 Pfam Desc: FAD-binding domain
  misc_feature (457)..(728): Pfam Id: NAD_binding_6 Pfam Desc: Ferric reductase NAD binding domain
  misc_feature (1)..(758): NCBI GI: 38344538 NCBI Desc: osjnba0027p08.6 [oryza sativa (japonica cultivar-group)]
  misc_feature (1)..(758): NCBI GI: 47169677 NCBI Desc: ferric reductase [oryza sativa (japonica cultivar-group)]
  misc_feature (1)..(758): NCBI GI: 115458592 NCBI Desc: os04g0444800 [oryza sativa (japonica cultivar-group)]
  misc_feature (26)..(758): NCBI GI: 30695741 NCBI Desc: ferric reductase-like transmembrane component family protein [arabidopsis thaliana]
  misc_feature (40)..(758): NCBI GI: 87241054 NCBI Desc: ferric reductase-like transmembrane component [medicago truncatula]
MAHEREPLLQQRQTGVGNAAAGAKGSSSAPAPAASAALPSLARTVLKFLMWAVFLTWAAGIFLYPTKPVQAVFTKWVRLSKESMFGIAGGIFLAFSAPILIIALLAYVYISFFPSERVVEKKKLRSLSFRLWTFPVLVDGPFGVVSAAEFIGIVLFIIFVVYSMTYYAVESVSLVSKFDLPSMTQSELILDVIGARFGAVGLFCMLFLFLPVARGSVLLRLIDIPFEHATRYHVWLGHLTMALFTLHGLFFVISWSMEGRLREEMREWNETGVANLPGVISLAAGLLMWVTSLHPVRKRFFELFFYTHQLYVIFIVFLAFHVGNFLFSISAGVVFLFMLDRFLRFWQSRAKVDIISAACRPCGTVELVFSKPPGLRYNALSFIFIQVRELSFLQWHPFSVSSSPMDGRYHMSVLIKILGTWTEKLRSIITDVQDKNRGDSELQCGRMTACVEGPYGYENLILVAGGIGISPFLAILSDIIHRIEEGKQCMPKNVLVLWSVKKSKELSLLSAVDAQTISSSVSDRLKLDIQAFVTQESLPPLEDGIVVDDRKVPGMFVKNGSTMSGLVGTGDNFWAAMYFLASTLGFLLAFTLVEAYYVKPHNVVAWWYRSLLFMLCMVAGVALPGGLVVLLWHLSEKQRMEGDKWDAAADSQSPRAEQTGPAAAAGGGDDDAVPGVSLAALRTTRYGCRPNFEAEFAAFAERAGDAADVGVLVCGPPGLQTSVARECRARNLRRRGGGGAEKSRSSAVFHFNSHSFDL

SEQ ID NO: 10385 - DNA, 2166 bp, Sorghum bicolor
  misc_feature: Ceres ANNOT ID no. 6112416
  misc_feature: Encodes the peptide sequence at SEQ ID NO 10386
atgtctgcagagtatgagttgaatgagatagatgctgcggacaccttgcatggctctgtggggagcaggctctccctgtttgcgagggagctcaagtcgaggagaagcagctggcagagcagcagcgccctcaggcttccacaaaactgcttctatggcagcttcgtcatacaccctaatggaaggtggtacaggatctggtcgaccgcgatgttcctgtggtccatctactccaccttcttcaccccattcgagttcggcttcttccggggcctcccggagcacctgctggacctcgagtgcgttcagctcgtcttcctcgccgacgtcgccgtccacttcttcctcgcctacagggacgcccacacctaccggatggtgtacgacaagcgcaagatcgctctgcgctacatcaaaggaagcttcgctcttgacatcctcggctgcttcccatgggacttcatatacaaggcgacggggaggacggaggtggtgcggtgcctggtgtggctgcgcctgtacagggcccggaacatcctggccttcttcaagcggatggagaaggacatccggatcagctacctcttcacgcgcatcgtgaagctcatcaccgtggagctccacttcacgcacaccgccgcctgcgtcttctactacctcgccaccacgctgccgccggcgcgcgagggcggcacctggatcggcagcctcacgctcgggggcaccaggtacatcagcttcagggagatggacctgctcacccgctacgtcacctcgctctacctcgccatcgtcaccatggccacggtcgggtacggcgatgtccatgcggtgaacccgagggagatggtcttcaccgtcgtctacatctccttcagcatcctcctcagcgcgtacctgatcggcaacatgacggcgctcatcgtgaaggggtcgaagaccgagaggttcagggacaagatgaccgacctcatcaggtacatgaacaggaacaagctgggcgccggcatcaggtcacaggtgaaggatcacctgctgctgcagtacgagagcagctacaccagggacagagtcgtcgacgacatcccggtcgctgtacgatccaagatgtcccagacactgtatctggacatggtttcaagagtgcacctgttcagaggatgctcagaagacttccttagccagattgtggtaaagttgcatgaagaattcttcctccctggggaggttatcttagagcaaggcactgtggtggatcaaatttatattgtggtacacggatgcttggaagaggtggccacgggagaagatggatcagaggagatcatctcagagctcctgccctacgacatcatcggcgatgtctccgtagtctgcaatgttccacaaccacacacagtcagggtctgtgagctttgtagcctcctgagaattgacaagcagtccctgaccagcatcctgcagatttacttcaaagatagccgtcagatcttgagcaacctactcaaggggcgagcaaccgagtccaaggggaagcagttggaatcagatatcacttacctgatatcaaggcaagaagcagagctggtgcttggagtgaacaatgccgcgtaccatggagatttgttccgtctgaaaggactgatcagtgcaggagcagatccgagtaaacctgatcatgatggaaggactgcactgcatgttgctgcgttaagaggatatgaagatatcgtcaggttcctaattcagcggggagccaatgtcaacagcatagataaatttggtaattcaccgttgctgctagcactgaaatcagggcatgagaggatcacctctctcctagtgaagcacggtgcgaccctgaacctagaggatgccggagggtacctgtgcagggtcgtcacggacggcaaggtcgatctgctcaagaggctgctcaggttcggcgtcgaccccaactgcaagaactacgaccagaggacgccgcttcacgtcgccgctgccgagggcctgcacctcgtcgccaccatgctcgtagacttcggagcagatgttctcgccaaggacaggtggggaaacacaccgctggacgaaggtcggagatgcagcagcagaccactggtcaggattctagagcaggctaggactgttgcagtcacgctgtga

SEQ ID NO: 10386 - protein, 721 aa, Sorghum bicolor
  misc_feature: Ceres ANNOT ID no. 6112416
  misc_feature (561)..(593): Pfam Id: Ank Pfam Desc: Ankyrin repeat
  misc_feature (594)..(626): Pfam Id: Ank Pfam Desc: Ankyrin repeat
  misc_feature (658)..(690): Pfam Id: Ank Pfam Desc: Ankyrin repeat
  misc_feature (402)..(492): Pfam Id: cNMP_binding Pfam Desc: Cyclic nucleotide-binding domain
  misc_feature (98)..(304): Pfam Id: Ion_trans Pfam Desc: Ion transport protein
  misc_feature (231)..(310): Pfam Id: Ion_trans_2 Pfam Desc: Ion channel
  misc_feature (1)..(718): NCBI GI: 116310225 NCBI Desc: osigba0140o07.2 [oryza sativa (indica cultivar-group)]
  misc_feature (1)..(718): NCBI GI: 38344540 NCBI Desc: osjnba0027p08.8 [oryza sativa (japonica cultivar-group)]
  misc_feature (53)..(720): NCBI GI: 6728977 NCBI Desc: stelar k+ outward rectifying channel (skor) [arabidopsis thaliana]
  misc_feature (53)..(720): NCBI GI: 3810676 NCBI Desc: skor [arabidopsis thaliana]
  misc_feature (53)..(720): NCBI GI: 3641845 NCBI Desc: stelar k+ outward rectifying channel [arabidopsis thaliana]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO. 503 in the 11/188,298 US application
MSAEYELNEIDAADTLHGSVGSRLSLFARELKSRRSSWQSSSALRLPQNCFYGSFVIHPNGRWYRIWSTAMFLWSIYSTFFTPFEFGFFRGLPEHLLDLECVQLVFLADVAVHFFLAYRDAHTYRMVYDKRKIALRYIKGSFALDILGCFPWDFIYKATGRTEVVRCLVWLRLYRARNILAFFKRMEKDIRISYLFTRIVKLITVELHFTHTAACVFYYLATTLPPAREGGTWIGSLTLGGTRYISFREMDLLTRYVTSLYLAIVTMATVGYGDVHAVNPREMVFTVVYISFSILLSAYLIGNMTALIVKGSKTERFRDKMTDLIRYMNRNKLGAGIRSQVKDHLLLQYESSYTRDRVVDDIPVAVRSKMSQTLYLDMVSRVHLFRGCSEDFLSQIVVKLHEEFFLPGEVILEQGTVVDQIYIVVHGCLEEVATGEDGSEEIISELLPYDIIGDVSVVCNVPQPHTVRVCELCSLLRIDKQSLTSILQIYFKDSRQILSNLLKGRATESKGKQLESDITYLISRQEAELVLGVNNAAYHGDLFRLKGLISAGADPSKPDHDGRTALHVAALRGYEDIVRFLIQRGANVNSIDKFGNSPLLLALKSGHERITSLLVKHGATLNLEDAGGYLCRVVTDGKVDLLKRLLRFGVDPNCKNYDQRTPLHVAAAEGLHLVATMLVDFGADVLAKDRWGNTPLDEGRRCSSRPLVRILEQARTVAVTL

SEQ ID NO: 10387 - DNA, 651 bp, Sorghum bicolor
  misc_feature: Ceres ANNOT ID no. 6112419
  misc_feature: Encodes the peptide sequence at SEQ ID NO 10388
atgtcgaggagaaccgcagcgttggcgctcgcgtgcctcgccgtgacgacggcggcgctggcggacggcgctctgcttccgtggttcggcgacggcaggcgcggcgggcgcgacgaggcggcggcggtgtcgccgctgtccgacgtgggactcctggcggacccgttccggatcctggagcacgtccccttcgggttcgaccgggacgacgtggccatggtgtccatggcgcgcgtggactggcgcgagacccccgacgcgcacgagatcgtggtggacgtgcccgggatgcgcagggaggacctcaagatcgaggtggaggacaaccgggtgctgcgcgtgagcggcgagcggcggcgcgtcgaggagcagaagggcgaccactggcaccgcgaggagcggtcctacggcaggttctggcgccagttccgcctccccgagaacgccgacctcgactccgtcgccgccagcctcgacaacggcgtcctcaccgtgcggttccggaagctggcgcccgagcagatcaagggcccgcgcgtcgtcgggatcgccgggggagacggagacggcggcgacgccaagaagagcatcggcgctggcgctggcgccggcgccggggacgatcatcagaccaagaaggtggagctctga

SEQ ID NO: 10388 - protein, 216 aa, Sorghum bicolor
  misc_feature: Ceres ANNOT ID no. 6112419
  misc_feature (80)..(184): Pfam Id: HSP20 Pfam Desc: Hsp20/alpha crystallin family
  misc_feature (2)..(216): NCBI GI: 116310226 NCBI Desc: osigba0140o07.3 [oryza sativa (indica cultivar-group)]
  misc_feature (54)..(192): NCBI GI: 18661 NCBI Desc: heat shock protein [glycine max]
  misc_feature (23)..(184): NCBI GI: 28466919 NCBI Desc: at4g10250 [arabidopsis thaliana]
  misc_feature (54)..(187): NCBI GI: 710436 NCBI Desc: hsp22.5
  misc_feature (54)..(187): NCBI GI: 477111 NCBI Desc: heat shock protein hsp22.7 - garden pea
  misc_feature: The sequence is a functional homolog of SEQ ID NO. 374 in the 11/188,298 US application
MSRRTAALALACLAVTTAALADGALLPWFGDGRRGGRDEAAAVSPLSDVGLLADPFRILEHVPFGFDRDDVAMVSMARVDWRETPDAHEIVVDVPGMRREDLKIEVEDNRVLRVSGERRRVEEQKGDHWHREERSYGRFWRQFRLPENADLDSVAASLDNGVLTVRFRKLAPEQIKGPRVVGIAGGDGDGGDAKKSIGAGAGAGAGDDHQTKKVEL

SEQ ID NO: 10389 - DNA, 1905 bp, Sorghum bicolor
  misc_feature: Ceres ANNOT ID no. 6112429
  misc_feature: Encodes the peptide sequence at SEQ ID NO 10390
atggaacccaccgcagcactgccccgctccttcagcaaccacctctgcccaacgctccacctcgacggcagccaagacgataatgttctccccttcatcgcgcgcatgctcatggaggacgacgccgtcgatgagttcttgtaccagcagtaccctgaccacaatcccgccctcctccagacccagcagctattcgcccaggtccttttcgacacctcctccaccagcgccctcgccgccgtgcaggccggcgcccaaggcaacgacctccaggatccaccctccttgaacagcacagccatgggtgccgtggagccggccaacaccttgtcgccagcggagggcagcaactgcttcaaggacgcggtgagcatggcgttcttaagaggcatggaagaggccaacaaattcttgcccggcgccggcggcggctatacggcggatttcaggggcaggaagaagaggcttgacgtcgacggagatgacgagcaggtggagggaaggagcagcaagcaaatggcagctgacggtgatgaggagtcggaggaagccgccgtgcgagagatgctagacaagctgatgctcaacggcgacgacgaacccatcctcgccgacgacatgcaggagctgcgtgctgccatggacatggcgaagacgccgccgccgccagggaggccggccggcaccagggcggatcaggttcagcagcagcaggcggtggacgtggacctccactccatgctcatccgctgcgcggacgccgtggccaacaacgaccgccgcaccgcgtccgatcttctacagcggatcaggcgccactcctcgccgagtggggacgccacgaagcggctggcgcactacttggccgaggcgctggaggtccggctgaacggcacggggagcctgcagtaccggccgtcgtcggtaatggcgaaaaacgcctcctccgcgggcgtccagctcaaggcgcagcagttcttcatggcctcgtgctgctttctcccggtgaacatcctcttctccaacaagaccatctacaacgctgccgcggggaggaagaagctgcacatcgtgcactacggtctggaccacgggctccagtgggcgaccctgctccggtggctcgcgcgcagggagggcgggccaccggaggtgcggctcaccggcatcgacgtcccacagcccgggttccgtccagcgcggctcatcgaggaggcggggcgccggctcaccacctgcgcgcggcagctcggcgtgccgttcaggttccgcggcatcgcggcgagatcggaggcggtccgcgcgggcgacctgggcatcgacgaccccgacgaggtgctcgtcgtcagcagcctgttccatttcaggacgctgacggacgagggcacggtggccgctgacggcggcgaggcaggcgcggaccccatcggcgcggtgctcggcgccatcagggagatgaagccgtccgtgttcgtccacgcggtcctcaacgcgtcgtacagcaccgccttcttcgcgacgcggttccgggaggcgctctacaacttcacggcgctgttcgacatgatggacaccatcttgccccgggacaacggcaggaggctgctgttcgagcgggacgtcctcgcgcggagcgccgtgaacgtcatagcctgcgagggcgcggaccgggtgcagcaccctcggagctacaagcagtggcaggcgaggagccgccgggcagggctgcggcagctgccgttggattgtgacattgttcagatgctcaaagacaaggtgaagaggggataccacgagaatttcgtgatcactgaggatcagcagtggcttctccaggcatggaaagggagggtgctctacgccatttccacgtggacggcagggaatgaattggcagggacttaa

SEQ ID NO: 10390 - protein, 634 aa, Sorghum bicolor
  misc_feature: Ceres ANNOT ID no. 6112429
  misc_feature (218)..(535): Pfam Id: GRAS Pfam Desc: GRAS family transcription factor
  misc_feature (15)..(619): NCBI GI: 115486811 NCBI Desc: os11g0705800 [oryza sativa (japonica cultivar-group)]
  misc_feature (145)..(626): NCBI GI: 32813435 NCBI Desc: scarecrow-like protein [lilium longiflorum]
  misc_feature (11)..(625): NCBI GI: 89474466 NCBI Desc: gras4 [solanum lycopersicum]
  misc_feature (150)..(625): NCBI GI: 125743148 NCBI Desc: scarecrow-like protein 1 [castanea sativa]
  misc_feature (159)..(625): NCBI GI: 15222433 NCBI Desc: scarecrow-like transcription factor 14 (scl14) [arabidopsis thaliana]
MEPTAALPRSFSNHLCPTLHLDGSQDDNVLPFIARMLMEDDAVDEFLYQQYPDHNPALLQTQQLFAQVLFDTSSTSALAAVQAGAQGNDLQDPPSLNSTAMGAVEPANTLSPAEGSNCFKDAVSMAFLRGMEEANKFLPGAGGGYTADFRGRKKRLDVDGDDEQVEGRSSKQMAADGDEESEEAAVREMLDKLMLNGDDEPILADDMQELRAAMDMAKTPPPPGRPAGTRADQVQQQQAVDVDLHSMLIRCADAVANNDRRTASDLLQRIRRHSSPSGDATKRLAHYLAEALEVRLNGTGSLQYRPSSVMAKNASSAGVQLKAQQFFMASCCFLPVNILFSNKTIYNAAAGRKKLHIVHYGLDHGLQWATLLRWLARREGGPPEVRLTGIDVPQPGFRPARLIEEAGRRLTTCARQLGVPFRFRGIAARSEAVRAGDLGIDDPDEVLVVSSLFHFRTLTDEGTVAADGGEAGADPIGAVLGAIREMKPSVFVHAVLNASYSTAFFATRFREALYNFTALFDMMDTILPRDNGRRLLFERDVLARSAVNVIACEGADRVQHPRSYKQWQARSRRAGLRQLPLDCDIVQMLKDKVKRGYHENFVITEDQQWLLQAWKGRVLYAISTWTAGNELAGT

SEQ ID NO: 10391 - DNA, 444 bp, Sorghum bicolor
  misc_feature: Ceres ANNOT ID no. 6112431
  misc_feature: Encodes the peptide sequence at SEQ ID NO 10392
atgacgagcccaatggtggccaccccggtccagctccgcacaaccggccgcctcaccttctgctgctcctccttccccagcgcaccagggacagccaccaccaccaggcggccgcggcgattcgcggcggcgagggcgtccgcggagacgatggcgacggagaagctgggcatcaaggtggagcgcaacccgcccgagtcccgcctctccgagctcggcgtccgccagtggcccaagtgggggtgcgacaagagcaagttcccgtggacctactccgccaaggagacgtgctacctgctgcaggggaaggtgaaggtgtaccccgagggtcacggcgaggagttcgtggagatcgccgcgggggaccttgtcgtcttccccaagggcatgagctgcacctgggacgtcgccgaggccgtcgacaagcactacaacttcgagtag

SEQ ID NO: 10392 - protein, 147 aa, Sorghum bicolor
  misc_feature: Ceres ANNOT ID no. 6112431
  misc_feature (69)..(144): Pfam Id: Cupin_3 Pfam Desc: Protein of unknown function (DUF861)
  misc_feature (6)..(147): NCBI GI: 115458600 NCBI Desc: os04g0445200 [oryza sativa (japonica cultivar-group)]
  misc_feature (23)..(147): NCBI GI: 115459358 NCBI Desc: os04g0509400 [oryza sativa (japonica cultivar-group)]
  misc_feature (51)..(147): NCBI GI: 140044133 NCBI Desc: cupin, rmlc-type [medicago truncatula]
  misc_feature (56)..(146): NCBI GI: 72383222 NCBI Desc: enzyme of the cupin superfamily [prochlorococcus marinus str. natl2a]
  misc_feature (56)..(146): NCBI GI: 116075489 NCBI Desc: enzyme of the cupin superfamily protein [synechococcus sp. rs9916]
  misc_feature: Useful for making plants with modulated cold sensitivity
  misc_feature: Functional homolog of the protein sequence given in SEQ ID NO 13616
MTSPMVATPVQLRTTGRLTFCCSSFPSAPGTATTTRRPRRFAAARASAETMATEKLGIKVERNPPESRLSELGVRQWPKWGCDKSKFPWTYSAKETCYLLQGKVKVYPEGHGEEFVEIAAGDLVVFPKGMSCTWDVAEAVDKHYNFE

SEQ ID NO: 10393 - DNA, 2775 bp, Sorghum bicolor
  misc_feature: Ceres ANNOT ID no. 6112463
  misc_feature: Encodes the peptide sequence at SEQ ID NO 10394
atggcgtcggcgatggagctggttgggagatctttcttgccgggctctgccgccgcggcgtcgccggcgggccgggagcggcggcgaggcgggccctgcttcgccgcggtcggaagggaggggagtgcgcacaagcggcggccgtcgctgaggtcgaccgcgccggtgggcgcgctggccgagcgcgtcgtggtgaccccggcgccgccggaggagagggccgggacggccccgccggagccgcacccgcagagcgtggccgcgcgcgccgtggtcaccgtgcggcggaggcgcaaggaggacgccaagcgccgcgtcgccgagcagctggacgcctacgccgacagggtcggccgcagcgtcctcctcgagctcatcagcacggagaccgacccaagaaaagggggccccaagaagagccggcggtcggcgctggtggggtggttcgagaagaaggacgtcaaggcggagcgggtggtgtacacggcggacttcaccgtcgacgggtgcttcggcgagcctggcgccgtcaccgtgctcaaccggcaccagcgcgagttcttcatcgagagcatcgtggtggagggctttccctcgggccccgcgcacttcacctgcaactcgtgggtgcagcccacccgcgtggaccgcaacccgcgcgtgttcttcaccaacaagccctacctgccggccgagacgccgccggggctgcaggagctccgccgccaggagctcagcgacctgaggggcgagggcggcgccgacaccaccggcgagcgcaggatcaccgaccgggtgtgggagtacgacgtgtacaacgacctcggcaacccggacaagggcgccgagttcgcgcgcccgatcctcggcggcgagcagcagctgccgtacccgcgccggatgcgaacgggccggcccaagaccttcacagacgatcgcgcggagagcagggtggagtacccggagcccatctacgtgtcccgggacgaggagttcgaggagggcaagaacgagatgctgtcggagggcgcgctcaaggcgctgctccacaacttcatgccgctgctggtgagctccgtgtcgccggacatccgcgacttcgccggcttccacgacgtggacaacctcttcaaggagggcctccggctgaagcaggcactgcaggaccagctgttccagaagatccccttcgtgcgcaagatccaggagaacagcgagggcctcctccgctacgacacgcccgacatcatcaagaaggacaagtttgcgtggctgcgcgacgacgagttcgcgaggcaggcgctggctggcatcaaccccgtcaacatcgagcggcttcaggcgttcccgccgatgagcaagctggacccggccgtgtacggcccgccggagtcggccatcacggaggagcacatcatcgggcagctggacggcatgtcggtgcggcaggcgctgcaggacaaccggctgtacatgctggactaccacgacatcttcctgccgttcctggaccggatcaacgcgcaggacgggcggaaggcctacggcacgcgcacgctcttcttcctgacggcggcgggcacgctcaagcccatcgccatcgagctgtgcctgccgcccatgaccgacgggtgcgcgcgcgccaagcgggtgttcacgccgcccgccgacgccaccagcaactggctgtggcagctcgccaaggcgcacgtctgctccaacgacgccggcgtccaccagctcatcaaccactggctgaggacgcacgcgtgcatggagccgttcatcatctcggcgcaccggcagctgagcgcgatgcaccccatcttcaagctgctcaagccgcacatgcgctacacgctcaagatcaacgcgctggcgcggcagatcctcatcaacggcgacggcgtcatcgagtccggcttcacccccggccgctactgcatggagatgagctcgttcgcgtaccaggagctctggcggctcgaccaggagggcctccctgccgatctcatcagaagaggaatggccgtggaggacccgacgcagccgcacggtctccggctgctgatcgaggactacccgtacgccaccgacgggctgctcctctgggacgccatcacgcggtggtgcgacgcgtacgtggccatgtactacccgtccgaccaagccgtgcagggcgacacggagctgcagtcgtggtacagggaggcggtgcagacggggcacgcggacaagcgcggcgcgccgtggtggccgcgcctgtcgacgccgggcgacctggcgtcgctgctcaccacgctgctgtggctcacctcggcgcagcacgcggcgctcaacttcgggcagtacccgctgggcggctacatcccgaaccgaccgccgctcatgcggcggctggtgcccgccgacggcgacccggagtacgcgcacctggtggccgacccgcaccgcttcttcctgtcggcgctgcccagcctgacgcagacgaccaccttcatgaccgtcatcgacacgctgtccacgcactccgccgacgagcagtacctcggggagcggcccgacgaggcgtggacggccgacccggcggcgctggcggcggcgcgcgagttcgcggacgaggtgcgccgcgccgaggaggagatcgaccggcgcaacgcggacacgggacgccgcaaccggtgcggcgccggcgtgctgccgtacgagctcatggcgcccacgtccgggccgggcatcacctgccgcggcatccccaacagcgtcaccatttag

SEQ ID NO: 10394 - protein, 924 aa, Sorghum bicolor
  misc_feature: Ceres ANNOT ID no. 6112463
  misc_feature (234)..(908): Pfam Id: Lipoxygenase Pfam Desc: Lipoxygenase
  misc_feature (121)..(222): Pfam Id: PLAT Pfam Desc: PLAT/LH2 domain
  misc_feature (1)..(924): NCBI GI: 84626291 NCBI Desc: lipoxygenase [zea mays]
  misc_feature (29)..(924): NCBI GI: 38344820 NCBI Desc: osjnba0064h22.1 [oryza sativa (japonica cultivar-group)]
  misc_feature (29)..(924): NCBI GI: 116310177 NCBI Desc: osigba0152k17.1 [oryza sativa (indica cultivar-group)]
  misc_feature (15)..(924): NCBI GI: 115458626 NCBI Desc: os04g0447100 [oryza sativa (japonica cultivar-group)]
  misc_feature (5)..(924): NCBI GI: 62867565 NCBI Desc: lipoxygenase-like protein [hordeum vulgare subsp. vulgare]
MASAMELVGRSFLPGSAAAASPAGRERRRGGPCFAAVGREGSAHKRRPSLRSTAPVGALAERVVVTPAPPEERAGTAPPEPHPQSVAARAVVTVRRRRKEDAKRRVAEQLDAYADRVGRSVLLELISTETDPRKGGPKKSRRSALVGWFEKKDVKAERVVYTADFTVDGCFGEPGAVTVLNRHQREFFIESIVVEGFPSGPAHFTCNSWVQPTRVDRNPRVFFTNKPYLPAETPPGLQELRRQELSDLRGEGGADTTGERRITDRVWEYDVYNDLGNPDKGAEFARPILGGEQQLPYPRRMRTGRPKTFTDDRAESRVEYPEPIYVSRDEEFEEGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPMSKLDPAVYGPPESAITEEHIIGQLDGMSVRQALQDNRLYMLDYHDIFLPFLDRINAQDGRKAYGTRTLFFLTAAGTLKPIAIELCLPPMTDGCARAKRVFTPPADATSNWLWQLAKAHVCSNDAGVHQLINHWLRTHACMEPFIISAHRQLSAMHPIFKLLKPHMRYTLKINALARQILINGDGVIESGFTPGRYCMEMSSFAYQELWRLDQEGLPADLIRRGMAVEDPTQPHGLRLLIEDYPYATDGLLLWDAITRWCDAYVAMYYPSDQAVQGDTELQSWYREAVQTGHADKRGAPWWPRLSTPGDLASLLTTLLWLTSAQHAALNFGQYPLGGYIPNRPPLMRRLVPADGDPEYAHLVADPHRFFLSALPSLTQTTTFMTVIDTLSTHSADEQYLGERPDEAWTADPAALAAAREFADEVRRAEEEIDRRNADTGRRNRCGAGVLPYELMAPTSGPGITCRGIPNSVTI

SEQ ID NO: 10395 - DNA, 999 bp, Sorghum bicolor
  misc_feature: Ceres ANNOT ID no. 6112474
  misc_feature: Encodes the peptide sequence at SEQ ID NO 10396
atggcgtcaccaacaaggagggtcgtcggcaccagcaactcggagatcccaacgttcccggtgagctccgccggccggccggttccggccgtggggctcggcacggcatcgttcccgttcgtggaggaagacgtcagggcctccgtcctcgctgcactggagttcggataccgccacctcgataccgcttcgctctacggcaccgagggtgccgtcggcgacggcgtggccgaggcggcgcggcgcgggatcgtggcgtccagggaggaggtgttcgtgacgaccaagatatggtgctcgcagtcccacccggagctcgtgctaccttccctcaaggagagcttgcagaaccttcaaatggattatgttgatttgtacctggttcatttcccggtggctgcaaagcccggcaatccacaattcccgattaaaagggaggacatcatgcccatcgacctaagcggtgtatggcgtgcaatggaggaatgtcatcggcttggccttgctagaatgattggtgtcagcaatttcacgactaagaagcttcaagagttactggccattgctgaaatccccccagcagtaaatcaggttgaaatgaatccaatttggcagcaaaaaaggttaactgagttttgcaaagataagggtattcatttgactgcctattctcccctaggaggccaaataagcgcctttgaggccaatccagtactgcagtctgaggttctgcaagaggttgcaaaggctagaggaaagtcagtggctcagatttcgctaagatggatctatgagcaaggcgctagcatggttgtcaagagtgtgaaaagggatagactcaaggcaaacatggaaatcttcgattgggaactcacaaacaaagaccggcgtaagattagtcagataccgcaacacaagacggtcacggtgtcaggggtcctcagcccacatggcgtctccaacatggattttgctgagcttgatattgttgaaacgtag

SEQ ID NO: 10396 - protein, 332 aa, Sorghum bicolor
  misc_feature: Ceres ANNOT ID no. 6112474
  misc_feature (21)..(304): Pfam Id: Aldo_ket_red Pfam Desc: Aldo/keto reductase family
  misc_feature (24)..(331): NCBI GI: 38344824 NCBI Desc: osjnba0064h22.5 [oryza sativa (japonica cultivar-group)]
  misc_feature (24)..(331): NCBI GI: 115458636 NCBI Desc: os04g0447700 [oryza sativa (japonica cultivar-group)]
  misc_feature (26)..(331): NCBI GI: 38344823 NCBI Desc: osjnba0064h22.4 [oryza sativa (japonica cultivar-group)]
  misc_feature (26)..(331): NCBI GI: 116310180 NCBI Desc: osigba0152k17.4 [oryza sativa (indica cultivar-group)]
  misc_feature (12)..(318): NCBI GI: 40781603 NCBI Desc: reductase 1 [hydrangea macrophylla]
  misc_feature (15)..(316): SWISSPROT Homolog: EC 2.3.1.170 NAD(P)H-dependent 6'-deoxychalcone synthase
  misc_feature: Useful for making plants with modulated drought sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13495
MASPTRRVVGTSNSEIPTFPVSSAGRPVPAVGLGTASFPFVEEDVRASVLAALEFGYRHLDTASLYGTEGAVGDGVAEAARRGIVASREEVFVTTKIWCSQSHPELVLPSLKESLQNLQMDYVDLYLVHFPVAAKPGNPQFPIKREDIMPIDLSGVWRAMEECHRLGLARMIGVSNFTTKKLQELLAIAEIPPAVNQVEMNPIWQQKRLTEFCKDKGIHLTAYSPLGGQISAFEANPVLQSEVLQEVAKARGKSVAQISLRWIYEQGASMVVKSVKRDRLKANMEIFDWELTNKDRRKISQIPQHKTVTVSGVLSPHGVSNMDFAELDIVET

SEQ ID NO: 10397 - DNA, 993 bp, Sorghum bicolor
  misc_feature: Ceres ANNOT ID no. 6112475
  misc_feature: Encodes the peptide sequence at SEQ ID NO 10398
atggcatcaccaacaaggagggtcggcaccagcagctcggagatcccagagttcccggtggaccccgccggccggccggtgccggccgtggggctcggcacggcatccttcccgttcgtggaggacgacgtcagggccgccgtcctcgcggcactggagctcggataccgccacctcgataccgcttcgctctaccgctccgagcgtgccgtcggcgaggccgtggccgaggcggcgcggctcgggatcgtggcgtccagggaggaggtgttcgtgacgaccaagatgtggtgctcgcagtgccacccggagctcgtgctaccttccctcaaggagagcttgcagaaccttcaaatgaattatgttgatctgtacctgcttcattggcctgtggctgcaaagcctggggagccacaattcccgattaaaagggaggacatcatgcccattgacctaagcggtgtatggcgtgcaatggaggaatgccatcggcttggccttgctagaatgattggtgtcagcaatttcacaacaaagaagcttcaacagctactggacattgctgaaatccccccggcagtaaatcaggttgaaatgaatccaacttggcagcaaaaaaggttaagtgagttctgcaaagataagggtattcatttgactgcctattctccactaggaggtcaaagcatgtctatggccaatccagtactacagtctgaggttttgcaagaggttgcaaaggctagaggaaagtccgtggctcaggtttcgctaaggtggatctacgagcaaggcgctagcatggttgtcaagagttttaaaaggaatagactcaaggataacatggaaatctttgattgggagctgaccaatgaagaccgatgtaagattagtcagatattgcaacacaagagagtcacaatatcggggatcctcagctcaaatggtgtctccagcgtggatcttgctgagcttgagattgttgaaatatag

SEQ ID NO: 10398 - protein, 330 aa, Sorghum bicolor
  misc_feature: Ceres ANNOT ID no. 6112475
  misc_feature (21)..(302): Pfam Id: Aldo_ket_red Pfam Desc: Aldo/keto reductase family
  misc_feature (25)..(329): NCBI GI: 38344823 NCBI Desc: osjnba0064h22.4 [oryza sativa (japonica cultivar-group)]
  misc_feature (25)..(329): NCBI GI: 116310180 NCBI Desc: osigba0152k17.4 [oryza sativa (indica cultivar-group)]
  misc_feature (15)..(329): NCBI GI: 38344824 NCBI Desc: osjnba0064h22.5 [oryza sativa (japonica cultivar-group)]
  misc_feature (15)..(329): NCBI GI: 115458636 NCBI Desc: os04g0447700 [oryza sativa (japonica cultivar-group)]
  misc_feature (8)..(316): NCBI GI: 40781603 NCBI Desc: reductase 1 [hydrangea macrophylla]
  misc_feature (14)..(307): SWISSPROT Homolog: EC 2.3.1.170 NAD(P)H-dependent 6'-deoxychalcone synthase
  misc_feature: Useful for making plants with modulated drought sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13495
MASPTRRVGTSSSEIPEFPVDPAGRPVPAVGLGTASFPFVEDDVRAAVLAALELGYRHLDTASLYRSERAVGEAVAEAARLGIVASREEVFVTTKMWCSQCHPELVLPSLKESLQNLQMNYVDLYLLHWPVAAKPGEPQFPIKREDIMPIDLSGVWRAMEECHRLGLARMIGVSNFTTKKLQQLLDIAEIPPAVNQVEMNPTWQQKRLSEFCKDKGIHLTAYSPLGGQSMSMANPVLQSEVLQEVAKARGKSVAQVSLRWIYEQGASMVVKSFKRNRLKDNMEIFDWELTNEDRCKISQILQHKRVTISGILSSNGVSSVDLAELEIVEI

SEQ ID NO: 10399 - DNA, 1359 bp, Sorghum bicolor
  misc_feature: Ceres ANNOT ID no. 6112482
  misc_feature: Encodes the peptide sequence at SEQ ID NO 10400
  misc_feature: Down-regulated in shoot tissues in response to aminocyclopropane carboxylic treatment
atggagtcagtagcacggttgcttctcgtggtggccgtggtggtggccgcggcggccagtggtggcgccctggccgcgacggcgacgccgccgcaccacctcaagctcaagggcggcctgcgggtgcgcctgacgcacgtcgacgcgcacggcaactactcgaggctgcagctgctgcagcgggccgcgcgccggagccaccaccgcatgtcgcgcctcgtcgcgcgtgccaccggcgtgaaggccgtcgccgggggaggggaccttcaggtgcccgtccacgcggggaacggcgagttcctgatggacgtggcgatcggcaccccggcgctgtcgtacgcggcgatcgtggacaccggcagcgacctggtgtggacgcagtgcaagccgtgcgtggactgcttcaagcagagcacgccggtgttcgacccgtcgtcgtcctccacctacgccaccgtgccgtgctccagcgccctgtgcagcgacctgcccacctccacctgcacgtcggcgtccaagtgcggctacacctacacctacggcgacgcgtcgtcgacgcagggcgtgctggcgagcgagaccttcacgctggggaaggagaagaagaagctccccggcgtggcgttcgggtgcggcgacacgaacgagggcgacgggttcacgcagggcgccgggctcgtggggctcggccgcggcccgctctcgctcgtctcccagctcggcctcgacaagttctcctactgcctcacctcgctcgacgacggcgacggcaagagcccgctgctgctgggcggctccgcggcggccatctcggagagcgcggcgacggcgcccgtgcagaccaccccgctggtgaagaacccgagccagccgtccttctactacgtgtccctgacggggctcaccgtggggtccacgcgcatcacgctcccggcctcggcgttcgcgatccaggacgacggcacgggcggcgtcatcgtcgactccggtacctccatcacgtacctggagctgcagggctaccgcgcgctgaaaaaggcgttcgtggcccagatggcgctgcccaccgtggacggctccgagatcgggctggacctgtgcttccagggccccgccaagggagtggacgaggtgcaggtgcccaagctggtgctccacttcgacggcggcgccgacctcgacctccccgccgagaactacatggtgctcgactccgcctccggcgcgctctgcctcacggtggcgccgtcgagggggctctccatcatcggcaacttccagcagcagaacttccagttcgtgtacgacgtcgccggcgacacgctctcgttcgcgcccgtgcagtgcaacaagttgtga

SEQ ID NO: 10400 - protein, 452 aa, Sorghum bicolor
  misc_feature: Ceres ANNOT ID no. 6112482
  misc_feature (99)..(447): Pfam Id: Asp Pfam Desc: Eukaryotic aspartyl protease
  misc_feature (5)..(452): NCBI GI: 115458644 NCBI Desc: os04g0448300 [oryza sativa (japonica cultivar-group)]
  misc_feature (11)..(452): NCBI GI: 38344829 NCBI Desc: osjnba0064h22.10 [oryza sativa (japonica cultivar-group)]
  misc_feature (11)..(452): NCBI GI: 116310063 NCBI Desc: h0818e04.1 [oryza sativa (indica cultivar-group)]
  misc_feature (3)..(449): NCBI GI: 61214233 NCBI Desc: aspartic proteinase nepenthesin-1 precursor (nepenthesin-i)
  misc_feature (3)..(449): NCBI GI: 61214232 NCBI Desc: aspartic proteinase nepenthesin-2 precursor (nepenthesin-ii)
  misc_feature: Down-regulated in shoot tissues in response to aminocyclopropane carboxylic treatment
MESVARLLLVVAVVVAAAASGGALAATATPPHHLKLKGGLRVRLTHVDAHGNYSRLQLLQRAARRSHHRMSRLVARATGVKAVAGGGDLQVPVHAGNGEFLMDVAIGTPALSYAAIVDTGSDLVWTQCKPCVDCFKQSTPVFDPSSSSTYATVPCSSALCSDLPTSTCTSASKCGYTYTYGDASSTQGVLASETFTLGKEKKKLPGVAFGCGDTNEGDGFTQGAGLVGLGRGPLSLVSQLGLDKFSYCLTSLDDGDGKSPLLLGGSAAAISESAATAPVQTTPLVKNPSQPSFYYVSLTGLTVGSTRITLPASAFAIQDDGTGGVIVDSGTSITYLELQGYRALKKAFVAQMALPTVDGSEIGLDLCFQGPAKGVDEVQVPKLVLHFDGGADLDLPAENYMVLDSASGALCLTVAPSRGLSIIGNFQQQNFQFVYDVAGDTLSFAPVQCNKL

SEQ ID NO: 10401 - DNA, 1362 bp, Sorghum bicolor
  misc_feature: Ceres ANNOT ID no. 6112483
  misc_feature: Encodes the peptide sequence at SEQ ID NO 10402
atggagctgctggtgctcctgctcttcctcgccctccccgtcctcccggcgcgcggcggcggcggctcgtcgtcggtgcctccgcggcgttcgctccacctcgagctggcgcgcgtggacgacgccgcggcggccgccaacctcacggaccacgagctcatccggcgcgccgtgcagcgcagcctcgaccggccgggggtcgcggcgcgcaaccgcaaggcggtcgtgggcgaggcccctctggtgccgcggggcggcgagtacctggtcaagctcgggatcggcacgccgcagcactacttctcggcggccatcgacacggccagcgacctcgtctggctgcagtgccagccctgcgtcagctgctaccgccagctcgaccccatcttcaaccccaggctctcctcctcctacgccgtcgtgccatgcagcagcgacacctgctcccagctggacggccacagatgtgacgaggacgacgaccaagcgtgccggtacaactacaagtacagcgggaacgcggtgacgaacggcaccctggccatagacaagctggccgtcggcggcaacgtgttccacgccgtcgtcctgggctgcagcgactccagcgtcgggggacctccgccgcaggcctcggggctggtcggcctcgcccgcggcccgctctcgctgctgtcccagctctcggtccgtcggttcatgtactgcctgccgccgcccatgtccaggacaccggggaagctcgtgctcggcgccggcgccggcgccgacgccgtccggaacgtgtcggaccgggtcaccgtcaccatgtcgtccagcacgcgctacccgtcctactactacctcaacttcgacgggctggccgtgggcgaccagaccccgggcacgatcaggaggccgacgtcgccgccggccacgggtggaggagtaggcggcggcggcggcgatggcggcagtggggcgaacgcgtacgggatgatcgtggacgtggcgtcgacgatctcgttcctggaggcgtcgctgtacgacgagctggcggacgacctggaggaggagatacggctgccccgcgccacgccgtcgacgcgcctggggctggacctctgcttcatcctgccggaaggggtggggatagaccgggtgtacgtgccgacggtgtccatgtcgttcgacggacggtggctggagctggaaagggaccggctgttcctggaggacggcaggatgatgtgcctgatgatcggcaggacgagcggggtgtccatccttggaaactaccagcagcagaacatgcacgtcctctacaacctgcgccggggcaagatcaccttcgccaaggccagctgcgactccttgccatag

SEQ ID NO: 10402 - protein, 453 aa, Sorghum bicolor
  misc_feature: Ceres ANNOT ID no. 6112483
  misc_feature (87)..(447): Pfam Id: Asp Pfam Desc: Eukaryotic aspartyl protease
  misc_feature (1)..(452): NCBI GI: 116310064 NCBI Desc: h0818e04.2 [oryza sativa (indica cultivar-group)]
  misc_feature (1)..(452): NCBI GI: 38344830 NCBI Desc: osjnba0064h22.11 [oryza sativa (japonica cultivar-group)]
  misc_feature (30)..(452): NCBI GI: 38344829 NCBI Desc: osjnba0064h22.10 [oryza sativa (japonica cultivar-group)]
  misc_feature (30)..(452): NCBI GI: 115458644 NCBI Desc: os04g0448300 [oryza sativa (japonica cultivar-group)]
  misc_feature (30)..(452): NCBI GI: 116310063 NCBI Desc: h0818e04.1 [oryza sativa (indica cultivar-group)]
MELLVLLLFLALPVLPARGGGGSSSVPPRRSLHLELARVDDAAAAANLTDHELIRRAVQRSLDRPGVAARNRKAVVGEAPLVPRGGEYLVKLGIGTPQHYFSAAIDTASDLVWLQCQPCVSCYRQLDPIFNPRLSSSYAVVPCSSDTCSQLDGHRCDEDDDQACRYNYKYSGNAVTNGTLAIDKLAVGGNVFHAVVLGCSDSSVGGPPPQASGLVGLARGPLSLLSQLSVRRFMYCLPPPMSRTPGKLVLGAGAGADAVRNVSDRVTVTMSSSTRYPSYYYLNFDGLAVGDQTPGTIRRPTSPPATGGGVGGGGGDGGSGANAYGMIVDVASTISFLEASLYDELADDLEEEIRLPRATPSTRLGLDLCFILPEGVGIDRVYVPTVSMSFDGRWLELERDRLFLEDGRMMCLMIGRTSGVSILGNYQQQNMHVLYNLRRGKITFAKASCDSLP

SEQ ID NO: 10403 - DNA, 564 bp, Sorghum bicolor
  misc_feature: Ceres ANNOT ID no. 6112484
  misc_feature: Encodes the peptide sequence at SEQ ID NO 10404
atgtctccgatctgggtgttcgggtacggctcgctgatctggaaccccggcttcgcctacgacgcccgcgtcgtcggcttcgtcagggactaccgccgcgtcttctaccaggggagcacggaccacaggggcacgccgcagttccccgggaggaccgtcaccctcgagcaccagcccggagcgacctgctggggagttgcttatagtataaaggaggaagataaggagatagctatggagtaccttgaagtcagggagaagcaatatgatgagaaggtttacctggacttgtatactgattcatcgcccaaagtaccagctgtcgaaaatgtgatggtatacttcgccaccgctaataaggagaccaatgaaaactaccttggtcctgcacctctggatgaaatggccaggcaaatttgccttgctcaaggcccatctggacctaacagagagtatgtgttcaaacttgaggatgctttaaacaaattaggagttgtagaccaacatgtccaagaactggcgaatgctgtgcgtgagtattctgacaccgagttatctaagtga

SEQ ID NO: 10404 - protein, 187 aa, Sorghum bicolor
  misc_feature: Ceres ANNOT ID no. 6112484
  misc_feature (4)..(180): Pfam Id: ChaC Pfam Desc: ChaC-like protein
  misc_feature (4)..(186): NCBI GI: 38344831 NCBI Desc: osjnba0064h22.12 [oryza sativa (japonica cultivar-group)]
  misc_feature (4)..(186): NCBI GI: 116310065 NCBI Desc: h0818e04.3 [oryza sativa (indica cultivar-group)]
  misc_feature (4)..(184): NCBI GI: 140052237 NCBI Desc: chac-like protein [medicago truncatula]
  misc_feature (5)..(179): NCBI GI: 82623379 NCBI Desc: chac-like family protein-like [solanum tuberosum]
  misc_feature (5)..(179): NCBI GI: 76573349 NCBI Desc: meloidogyne-induced giant cell protein-like protein [solanum tuberosum]
  misc_feature: Useful for making plants with modulated nitrogen use efficiency
  misc_feature: GREAT-hit functional homolog of the protein sequence given in SEQ ID NO 13242
  misc_feature: Useful for making plants with modulated nitrogen use efficiency
  misc_feature: Functional homolog of the protein sequence given in SEQ ID NO 13242
MSPIWVFGYGSLIWNPGFAYDARVVGFVRDYRRVFYQGSTDHRGTPQFPGRTVTLEHQPGATCWGVAYSIKEEDKEIAMEYLEVREKQYDEKVYLDLYTDSSPKVPAVENVMVYFATANKETNENYLGPAPLDEMARQICLAQGPSGPNREYVFKLEDALNKLGVVDQHVQELANAVREYSDTELSK

SEQ ID NO: 10405 - DNA, 2019 bp, Sorghum bicolor
  misc_feature: Ceres ANNOT ID no. 6112487
  misc_feature: Encodes the peptide sequence at SEQ ID NO 10406
atggcgctgctctccgccacttcacccgccaaggcgcacttctcggcgctcctcttctgccacgacgagccgcagcagcaccagcaccagcacgcgctccccggcggcggtaacagggccaggcaaaagcgggcgcggggcaggtgcgcggcggcgccatcaatgcggcctcccgacgcgtccgtcgctcccgcgcccgcggccgcggccgcggccggcgaggcgcggcggaagaagaggccccgggtgctggtggccggcggcggcatcggcgggctggtgttggcgctggcggcgcggcgcaaggggtacgacgtgacggtgttcgagcgcgacatgagcgcggtgcgcggggaagggcagtaccgcggtcccatccagatccagagcaacgcgctggccgcgctcgaggccatcgacatgtccgtcgccgaggaggtcatgcgcgtcggctgcgtcaccggcgaccgcatcaacggcctcgtcgacggcatgtccggctcctggtacatcaagtttgatacgtttactcctgcagctgagcgggggctcccagtcacaagggtcattagccgcatgacactgcaacaaatccttgctcgagcagttggcgatgatgctatattgaatggaagccatgtagtcgattttatagatgatggcagtaaggttactgccatattggaggacggtagaaaatttgaaggcgaccttttggttggtgccgatggaatatggtcaaaggtgaggaagacactattcgggcattcagacgccacctattcaggttacacttgctacacagggattgcagattttgtgccacctgatatcgatacagttgggtaccgagtatttcttggtcacaaacaatacttcgtctcttcagatgtcggtgctggtaaaatgcaatggtatgcttttcacaatgaagaggccggtggcactgaccctgaaaatggcaaaaagaaaagattgcttgagatatttgacggatggtgtgataatgtcgttgatttgataaacgcaactgatgaagaagcggttcttcgccgggatatatacgaccgcccacctactattaattgggggaaaggtcgtgtcaccttgcttggtgattctgtccatgctatgcagccaaatctgggtcaaggtggctgcatggctattgaggatggttaccagctggctgtagagctagagaatgcctggcaagagagtgtcaagactgaaactcctatggacatagtttcctccttgaggcgttatgagaaagagagaaggctgcgtgttgctgttatacatggactggcaagaatggccgcaatcatggctaccacctatagaccttatttgggtgttggtctaggacctttatcgtttttgaccaagttgcggataccacaccctggaagagttggtggcagattcttcatcaaatatggaatgcctgcgatgctgagctgggtgcttggtggcaacagctcaaagctagagggaaggcctttaagctgccgactttctgacaaggcaaatgaccagctttatcgatggtttgaggatgatgatgcgctggaacaagctatgggtggagaatggtacctcttcccaacaagtgaaggaaacagcaatagcttccagcccattcgtttaattagggacgagcagaggtcactctctgttggaagccagtcagatcctaatgacacagattcttccctatcattgccgtttccacagatatcagaaaggcatgctacaatcacatgcaagaataaggctttctatctgactgatcatgggagtgaacatggtacctggattaccgacaatgaaggtagacgttaccgtgtgccaccaaacttcccagttcgtttccatccctccgatgtcattgagtttggttctgataagaaggctatgttccgggtgaaggtgctgaacacgctcccatatgaatccgcaagaagtgggaagcagcaggggcagcagcaacagcaagtccttcaggcggcatga

SEQ ID NO: 10406 - protein, 672 aa, Sorghum bicolor
  misc_feature: Ceres ANNOT ID no. 6112487
  misc_feature (559)..(635): Pfam Id: FHA Pfam Desc: FHA domain
  misc_feature (80)..(438): Pfam Id: FAD_binding_3 Pfam Desc: FAD binding domain
  misc_feature (1)..(660): NCBI GI: 115458652 NCBI Desc: os04g0448900 [oryza sativa (japonica cultivar-group)]
  misc_feature (1)..(629): NCBI GI: 13442816 NCBI Desc: zeaxanthin epoxidase [oryza sativa (japonica cultivar-group)]
  misc_feature (41)..(660): NCBI GI: 38344835 NCBI Desc: osjnba0064h22.16 [oryza sativa (japonica cultivar-group)]
  misc_feature (41)..(660): NCBI GI: 116310069 NCBI Desc: h0818e04.7 [oryza sativa (indica cultivar-group)]
  misc_feature (60)..(656): NCBI GI: 38112202 NCBI Desc: zeaxanthin epoxidase [vitis vinifera]
  misc_feature (60)..(660): SWISSPROT Homolog: EC 1.14.13.90 Zeaxanthin epoxidase, chloroplast precursor
  misc_feature: Useful for making plants with altered alkaloid content
  misc_feature: GREAT-hit functional homolog of the protein sequence given in SEQ ID NO 13312
  misc_feature: Useful for making plants with altered alkaloid content
  misc_feature: Useful for making plants with modulated water use efficiency
  misc_feature: Functional homolog of the protein sequence given in SEQ ID NO 13312
MALLSATSPAKAHFSALLFCHDEPQQHQHQHALPGGGNRARQKRARGRCAAAPSMRPPDASVAPAPAAAAAAGEARRKKRPRVLVAGGGIGGLVLALAARRKGYDVTVFERDMSAVRGEGQYRGPIQIQSNALAALEAIDMSVAEEVMRVGCVTGDRINGLVDGMSGSWYIKFDTFTPAAERGLPVTRVISRMTLQQILARAVGDDAILNGSHVVDFIDDGSKVTAILEDGRKFEGDLLVGADGIWSKVRKTLFGHSDATYSGYTCYTGIADFVPPDIDTVGYRVFLGHKQYFVSSDVGAGKMQWYAFHNEEAGGTDPENGKKKRLLEIFDGWCDNVVDLINATDEEAVLRRDIYDRPPTINWGKGRVTLLGDSVHAMQPNLGQGGCMAIEDGYQLAVELENAWQESVKTETPMDIVSSLRRYEKERRLRVAVIHGLARMAAIMATTYRPYLGVGLGPLSFLTKLRIPHPGRVGGRFFIKYGMPAMLSWVLGGNSSKLEGRPLSCRLSDKANDQLYRWFEDDDALEQAMGGEWYLFPTSEGNSNSFQPIRLIRDEQRSLSVGSQSDPNDTDSSLSLPFPQISERHATITCKNKAFYLTDHGSEHGTWITDNEGRRYRVPPNFPVRFHPSDVIEFGSDKKAMFRVKVLNTLPYESARSGKQQGQQQQQVLQAA

SEQ ID NO: 10407 - DNA, 999 bp, Sorghum bicolor
  misc_feature: Ceres ANNOT ID no. 6112497
  misc_feature: Encodes the peptide sequence at SEQ ID NO 10408
atgtcgagcgccacgacgacggccggtgcaggggacgacgacggcgacgaggtcgtgcacgacttcgccccgctactcctggtgtacaagagcggccgcctcgagcggccactcgcgatgcctcaggtcccgccgggccgcgacgccgccacgggcgtcgtgtccaaggacgtggccctctcgccgcacaccttcgtgcgcctgtacctcccgcccgccgccgccgtagcggaaagggaacggaagctcctccccgtggtggtctacttccacggcggcggcttcgtgatcgggtcggccgggtccgccgcgtaccaccgctgcctcaacgacctcgccgcggcctgcccggcagtggccgtctccgtggactaccgcctcgcgccggagcacccggtccccgccgcgtacgaggactccctggcggcgctcaaatgggcgctgtcgtcgctgtcgtcgtcgtcgtccgcggccgaggccgacccgtggctcgcggcgcacggcgaccccgcacgcgtgttcctcgccggcgacagcgcgggggccaacatctgccaccacctcgcgatgcaccgggacatccgagacgccggcggactcaagggcgtcgtgctcatccacccctggttctggggcaaggaccccatcggcggggagccgcggagcccctcgaagcagaaggagcagcagaagggcctgtgggagttcgtgtgccccggcgcggtggacggcgtggacgacccgcggatgaacccgacggcgcccggcgcgctggggctggagaacctggcgtgccggaaggtgatggtgtgcgtggctgagggggacgtccttcggtggcgcgggaagctgtacgcggaggcggcggcgcgggccaagaaggacgtggagctgttcgagtcccatggagtcgggcatgtgttctacctgctggagcccgccaaggagaaggccaaggagctgctggacaggatcgcggcatttgtcagtacggaatga

SEQ ID NO: 10408 - protein, 332 aa, Sorghum bicolor
  misc_feature: Ceres ANNOT ID no. 6112497
  misc_feature (87)..(310): Pfam Id: Abhydrolase_3 Pfam Desc: alpha/beta hydrolase fold
  misc_feature (7)..(332): NCBI GI: 38344841 NCBI Desc: osjnba0064h22.22 [oryza sativa (japonica cultivar-group)]
  misc_feature (7)..(332): NCBI GI: 116310075 NCBI Desc: h0818e04.13 [oryza sativa (indica cultivar-group)]
  misc_feature (14)..(330): NCBI GI: 82697977 NCBI Desc: cxe carboxylesterase [actinidia eriantha]
  misc_feature (16)..(330): NCBI GI: 82697943 NCBI Desc: cxe carboxylesterase [malus pumila]
  misc_feature (17)..(329): NCBI GI: 115476872 NCBI Desc: os08g0475000 [oryza sativa (japonica cultivar-group)]
MSSATTTAGAGDDDGDEVVHDFAPLLLVYKSGRLERPLAMPQVPPGRDAATGVVSKDVALSPHTFVRLYLPPAAAVAERERKLLPVVVYFHGGGFVIGSAGSAAYHRCLNDLAAACPAVAVSVDYRLAPEHPVPAAYEDSLAALKWALSSLSSSSSAAEADPWLAAHGDPARVFLAGDSAGANICHHLAMHRDIRDAGGLKGVVLIHPWFWGKDPIGGEPRSPSKQKEQQKGLWEFVCPGAVDGVDDPRMNPTAPGALGLENLACRKVMVCVAEGDVLRWRGKLYAEAAARAKKDVELFESHGVGHVFYLLEPAKEKAKELLDRIAAFVSTE

SEQ ID NO: 10409 - DNA, 1272 bp, Sorghum bicolor
  misc_feature: Ceres ANNOT ID no. 6112499
  misc_feature: Encodes the peptide sequence at SEQ ID NO 10410
atgcagatggcggcgaccaccaccgactcccaggcggccgtgccgcctcaccaccctcacgcccacccccacgtgcccccgcagcatggtcacccgcaccaccacatgccgccgcagccacggtgggtcgtcatcccgtacccgccgccgccgcccatggtggccgcgccaccgccgccgccgccgcagtttgccaagcactttgctgctgggcctcccccgccgccccaagctgcggccgggcgccgcacgccgaccccacccgcggccggatccggcgggaacgggtgcgaggagaataagaccatttgggtcggcgacctccagtactggatggacgagaactacctccacagctgcttcgggcccagcggcgaggtggttacaataaaagttatccgcaataggcaaacaggacagtcagaggggtatggatttgttgagttcttttctcacgcatcagcagaaaaggctcttcagaattttactggtcatgtgatgccaaacactgaccgggcatttaagttgaactgggcatcatatagcatgggtgaaaagcgatctgaagtagcttctgaccactcaatatttgttggtgatctagctgctgatgttactgatgaaatgctgctggagcttttctctagcaagtaccgctcggtgaaaggagctaaagttattattgatgcaaacacaggccgttctaggggctatggatttgttaggtttggagatgacaacgacaaatctcatgcaatgtctgaaatgaatggtgtatattgctctactaggccaattcgtataggacctgcgactcccagaagatcttcaggagattctggctcctcgactcctggtcattcagatggtgattcttctaatagaacggtatatgttggtgggcttgaccccaatgtcagtgaagatgaacttagaaaagcctttgccaaatatggtgatcttgcctctgtgaaaattcctctaggaaagcaatgtggctttgttcaatttgctagcagaactgatgctgaagaagcactacaaggattaaatggatcactcattgggaagcaggcagttcgcctttcatggggccgcagcccatcgcataagcagtcgaggggtgactccggcaacaggaggaacaacatgtactatggcacaccattctatggcggatatggctatgcctccccagtgccacacccaaacatgtacgccgcagcgtatggcgcgtaccccatgtatggcaaccagcagctagtgagctag

SEQ ID NO: 10410 - protein, 423 aa, Sorghum bicolor
  misc_feature: Ceres ANNOT ID no. 6112499
  misc_feature (103)..(174): Pfam Id: RRM_1 Pfam Desc: RNA recognition motif. (a.k.a. RRM, RBD, or RNP domain)
  misc_feature (196)..(268): Pfam Id: RRM_1 Pfam Desc: RNA recognition motif. (a.k.a. RRM, RBD, or RNP domain)
  misc_feature (297)..(362): Pfam Id: RRM_1 Pfam Desc: RNA recognition motif. (a.k.a. RRM, RBD, or RNP domain)
  misc_feature (1)..(423): NCBI GI: 115458668 NCBI Desc: os04g0449900 [oryza sativa (japonica cultivar-group)]
  misc_feature (1)..(423): NCBI GI: 116310076 NCBI Desc: h0818e04.14 [oryza sativa (indica cultivar-group)]
  misc_feature (71)..(423): NCBI GI: 115479619 NCBI Desc: os09g0462700 [oryza sativa (japonica cultivar-group)]
  misc_feature (165)..(423): NCBI GI: 115446801 NCBI Desc: os02g0567900 [oryza sativa (japonica cultivar-group)]
  misc_feature (6)..(420): NCBI GI: 15594035 NCBI Desc: nucleic acid binding protein [nicotiana tabacum]
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO. 339 in the 11/188,298 US application
MQMAATTTDSQAAVPPHHPHAHPHVPPQHGHPHHHMPPQPRWVVIPYPPPPPMVAAPPPPPPQFAKHFAAGPPPPPQAAAGRRTPTPPAAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLLELFSSKYRSVKGAKVIIDANTGRSRGYGFVRFGDDNDKSHAMSEMNGVYCSTRPIRIGPATPRRSSGDSGSSTPGHSDGDSSNRTVYVGGLDPNVSEDELRKAFAKYGDLASVKIPLGKQCGFVQFASRTDAEEALQGLNGSLIGKQAVRLSWGRSPSHKQSRGDSGNRRNNMYYGTPFYGGYGYASPVPHPNMYAAAYGAYPMYGNQQLVS

SEQ ID NO: 10411 - DNA, 1248 bp, Sorghum bicolor
  misc_feature: Ceres ANNOT ID no. 6112549
  misc_feature: Encodes the peptide sequence at SEQ ID NO 10412
atggcggcgctgcttacccgagccggcgcccgcctcaagcgatccggctccggcttccacctccgctccgtcctcgcggggcacggactcttctcatctgaagccgcgacgaccgctgctcctgcggcctccgtggacgaccgcgcggtcgctgtcgcggccacgggcgaggaggatggggacgacctgcgcagccgcatcttccggctgggcctggcgaagcggagcgcgacagcggcgctcgacaagtggtccggtgagggacgcgccgcacccgcggcggagctccgccgcatcgcgcgcgacctcagccgcgtccgtcgctacaagcacgcactcgaggtagcagactggatgaagacacatcatgagtctgatttatctgagagtgactatggaatgcgcattgacttgattaccaaagtttttggtgctagtgctgctgaagatttctttgagaagcttccacctggagccaaatcgctagaagcctacacagctcttctccattcttatggccgatcaaagatgacagataaagctgaaaggctgtttgagagaatgaaggatgcaaacctgtctatggatgccctggtttataatgagatgatgaccttgtatatttctgtcggggagcttgataaagtggagatcattgcagaagaactaaaaaggcaaaacgtctctccagatctcttcacttacaatctccgggtcagtgcagcggctgcgtccatggatctcgagggcttcaaaggaattctcgacgagatgtcgaaagatccaaactccaaagaagggtggacactgtaccgaaacctcgcctccgtatacgttgacgcgagccagcttgtgggctctggaaactcgctggtggaggcggaggcaaagatcagtcagagggagtggataacctatgacttcctcgtcatcttacacgccggcctcggcaaccaagagaggatcaaggacatttggaagtccatggtaatgacctcgcagcgcatgacgagccggaactacatctgcgtgatctcctcctacctgatgtgcgggcagctgaaggatgccggggagatcgtcgaccagtggcagcgttctaaggcccccgaattcgacatctctgcctgcaacaggctgctggacgcccttctgagcgccggtctcaccgacacggcggataggtttagggaactgatgctgcagaagagctgtatactgactagcagggcaactgtggttgagtga

SEQ ID NO: 10412 - protein, 415 aa, Sorghum bicolor
  misc_feature: Ceres ANNOT ID no. 6112549
  misc_feature (163)..(197): Pfam Id: PPR Pfam Desc: PPR repeat
  misc_feature (1)..(410): NCBI GI: 21740710 NCBI Desc: osjnba0086b14.3 [oryza sativa (japonica cultivar-group)]
  misc_feature (1)..(410): NCBI GI: 116310079 NCBI Desc: h0818e04.17 [oryza sativa (indica cultivar-group)]
  misc_feature (124)..(410): NCBI GI: 115458674 NCBI Desc: os04g0450200 [oryza sativa (japonica cultivar-group)]
  misc_feature (6)..(403): NCBI GI: 32488964 NCBI Desc: osjnbb0038f03.9 [oryza sativa (japonica cultivar-group)]
  misc_feature (77)..(402): NCBI GI: 29028736 NCBI Desc: at1g02150/t7i23.8 [arabidopsis thaliana]
MAALLTRAGARLKRSGSGFHLRSVLAGHGLFSSEAATTAAPAASVDDRAVAVAATGEEDGDDLRSRIFRLGLAKRSATAALDKWSGEGRAAPAAELRRIARDLSRVRRYKHALEVADWMKTHHESDLSESDYGMRIDLITKVFGASAAEDFFEKLPPGAKSLEAYTALLHSYGRSKMTDKAERLFERMKDANLSMDALVYNEMMTLYISVGELDKVEIIAEELKRQNVSPDLFTYNLRVSAAAASMDLEGFKGILDEMSKDPNSKEGWTLYRNLASVYVDASQLVGSGNSLVEAEAKISQREWITYDFLVILHAGLGNQERIKDIWKSMVMTSQRMTSRNYICVISSYLMCGQLKDAGEIVDQWQRSKAPEFDISACNRLLDALLSAGLTDTADRFRELMLQKSCILTSRATVVE

SEQ ID NO: 10413 - DNA, 1107 bp, Sorghum bicolor
  misc_feature: Ceres ANNOT ID no. 6112582
  misc_feature: Encodes the peptide sequence at SEQ ID NO 10414
atggtcatgggagccagcggctccaagcttgagaaggccctcggtgaccagttcccggaaggcgagcgctacttcggcctcgagaacttcggcaacacctgctactgcaacagtgtccttcaggcactctatttttgcattccatttagggagcagttactggaatattatgcaaataacaaaactccaggtgacgctgaagaaaatcttttgacctgtttggccgacctttttatgcagataagccaagcaaagaaaaagactggcgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgccaaggattcaccccaattgtcatctcctgaaaaagctccaaatggcccagttcaacctttagccaatggagttaaaaaagaacctccagttactctggtccataaaaatttccagggcatattgaccaacgaaacaagatgcttaagatgtgaaacagtaactgcaagggatgaaacatttcttgatcttagtgttgacattgaacaaaatagttctatcacaagctgcctgaaaaatttctgttctactgagactttaaatgcagaggataaattcttctgcgacaaatgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggaaacacagaccatgggtatatcttattttacgaggggcttggcgggaagagttag

SEQ ID NO: 10414 - protein, 368 aa, Sorghum bicolor
  misc_feature: Ceres ANNOT ID no. 6112582
  misc_feature (22)..(361): Pfam Id: UCH Pfam Desc: Ubiquitin carboxyl-terminal hydrolase
  misc_feature (1)..(368): NCBI GI: 115458702 NCBI Desc: os04g0452400 [oryza sativa (japonica cultivar-group)]
  misc_feature (3)..(365): NCBI GI: 4567196 NCBI Desc: ubiquitin-specific protease 4 (ubp4) [arabidopsis thaliana]
  misc_feature (3)..(365): NCBI GI: 18958042 NCBI Desc: at4g39910/t5j17_80 [arabidopsis thaliana]
  misc_feature (3)..(365): NCBI GI: 21593319 NCBI Desc: ubiquitin-specific protease 4 (ubp4) [arabidopsis thaliana]
  misc_feature (3)..(362): NCBI GI: 119625840 NCBI Desc: ubiquitin specific peptidase 46, isoform cra_b [homo sapiens]
  misc_feature (3)..(365): SWISSPROT Homolog: EC 3.1.2.15 Ubiquitin carboxyl-terminal hydrolase 4
MVMGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQLSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 10415 - DNA, 1533 bp, Sorghum bicolor
  misc_feature: Ceres ANNOT ID no. 6112584
  misc_feature: Encodes the peptide sequence at SEQ ID NO 10416
atggccggaggtgtcattgttccgagcgatggccctgccgcggactacggcggaggcctgacgctctcggtgttcatgacctgccttgtggctgcctccggcggcctcatcttcggctacgacatcggcatctcaggcggtgtgtccgagatggagccgttcctgcggcgcttcttcccgcacgtcctgcaaaagatggcgtcggccaagggcaacgagtactgcctctacgacagccagacgctgacggccttcacgtcgtcgctgtacgtggccgggctgttcgcgtcgctcgtggccagccgcgtcaccagggcgctgggccggcaggccgtcatgctcatgggcggcgccctcttcttcgccggcggcgccgtgacgggcgccgccgtcaacatcgccatgctcatcgtcggccgcatgctgctcggcttcggcgtcggcttcaccaaccaggccgcgcctctgttcctggccgagatggcgccgtcgcggtggcggggctccctgacggcgggctaccagttcttcctggcgctcggggtgctcacggcgaacctcgtcaactacgccacggcgcaccactcctggggttggcgcgtctcgctggggctggcgggcgcgccggccatcgtcatcttcgtcggcgcgctcttcctcaccgacacgcccagcagcctcgtcatgcgggggcggggcgacggggcccgcgcggcgctgctccgcgtgcgcggcgccgacgccgacgtggacgccgagctcagggacatcgccaaggccgtggaggccgcgcgccggagcgaggacggcgcgttccgccgcatggccaccaggcgcgcgtaccgcccgcacctcgtcctcgccgtcgccgtgcccatgttcttccagctcacgggcgtcatcgtgctcgccttcttcgcgccgctcgtgttccggaccgtcggcttcggcagcaacgccgccctgatgggcgccgtcatactcggcgcggtcaacctcggctccctcgtgctctccaccttcgtcatcgaccgctacgggcggaaggtgctcttcatggtcggcggcatccagatggtcatctgccaggttgccatcgcttggatcatgggggcgaagatcggcaagggcggggaggcggcgatggcgcacccatacgcggtggcggtgctggtgttcacgtgcctgcacacggcggggttcgggtggtcatgggggccgctggggtgggtgatcccgagcgagatattcccggtggacatccggtcggcggggcaggccatgaacgtctccatcggcctctgcctcaccttcgtgcagacgcagtcgttcctcgccatgctctgccgcttcaagtacgccacattcgcctactacgccgcctgggtcgccgtcatgaccgtcttcatcgcgctcttcctgccggagaccaagggcatcccgctcgagtccatggccaccatttggggcaaacactggtactggaagaggttcgtcgtccacgacgggaagagcgacgtggcactgacctaa

SEQ ID NO: 10416 - protein, 510 aa, Sorghum bicolor
  misc_feature: Ceres ANNOT ID no. 6112584
  misc_feature (27)..(489): Pfam Id: Sugar_tr Pfam Desc: Sugar (and other) transporter
  misc_feature (31)..(438): Pfam Id: MFS_1 Pfam Desc: Major Facilitator Superfamily
  misc_feature (1)..(505): NCBI GI: 115458708 NCBI Desc: os04g0452700 [oryza sativa (japonica cultivar-group)]
  misc_feature (1)..(505): NCBI GI: 116309957 NCBI Desc: h0505f09.3 [oryza sativa (indica cultivar-group)]
  misc_feature (1)..(505): NCBI GI: 11991110 NCBI Desc: monosaccharide transporter 1 [oryza sativa]
  misc_feature (1)..(506): NCBI GI: 116309956 NCBI Desc: h0505f09.2 [oryza sativa (indica cultivar-group)]
  misc_feature (1)..(499): NCBI GI: 32489200 NCBI Desc: osjnba0027g07.27 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MAGGVIVPSDGPAADYGGGLTLSVFMTCLVAASGGLIFGYDIGISGGVSEMEPFLRRFFPHVLQKMASAKGNEYCLYDSQTLTAFTSSLYVAGLFASLVASRVTRALGRQAVMLMGGALFFAGGAVTGAAVNIAMLIVGRMLLGFGVGFTNQAAPLFLAEMAPSRWRGSLTAGYQFFLALGVLTANLVNYATAHHSWGWRVSLGLAGAPAIVIFVGALFLTDTPSSLVMRGRGDGARAALLRVRGADADVDAELRDIAKAVEAARRSEDGAFRRMATRRAYRPHLVLAVAVPMFFQLTGVIVLAFFAPLVFRTVGFGSNAALMGAVILGAVNLGSLVLSTFVIDRYGRKVLFMVGGIQMVICQVAIAWIMGAKIGKGGEAAMAHPYAVAVLVFTCLHTAGFGWSWGPLGWVIPSEIFPVDIRSAGQAMNVSIGLCLTFVQTQSFLAMLCRFKYATFAYYAAWVAVMTVFIALFLPETKGIPLESMATIWGKHWYWKRFVVHDGKSDVALT

SEQ ID NO: 10417 - DNA, 993 bp, Sorghum bicolor
  misc_feature: Ceres ANNOT ID no. 6112585
  misc_feature: Encodes the peptide sequence at SEQ ID NO 10418
  misc_feature: Up-regulated in shoot tissues in response to salicylic acid treatment
atggcgggatccgcgttcctcaacgccctcgtcctccgcgcgccatccccatccccgtcgctctcgtgctcgtcctcgtctacgcgccgcagcgccggcgccttcgcgttcccgaacccaccgcgcctcccatctctgcgttctgcgcgccgcgtcgtccttgcgcgggcggcggcggcgccgccgggcgcgggcggtgaccccgagcccgaggacgacgagtgggggccggagcccgagggcgggtccgctgtcacgggagcgaccgcggtggcggaggcgcctgaggcgccggaggcgagagaggtcgcggagctcaaggcgcagctgaaggacgcgctgtacggcacggagcggggcctgcgggcgtccagcgagtcgcgggccaaggtgctggagctcatcacgcagctcgagacgcgcaaccccacgccggcgcctaccgaggcgcttacgctcctcaacggcaagtggatcctcgcgtacacatcattttcccaactgttcccactattggggtttggcaatctgcctgagctcgtgaaagtggaggaaatatcacagaccattgattctgagaacttcacagtgcaaaactgtataaagttttcaggacctttggctacaacctcagttgccaccaatgcaaaatttgaaatcagaagccccaagcgcgtgcagatcaaatttgaagaaggcattgttggtacaccacagttgaccgactccattgtgctaccagagaagtttgaattgtttggacagaacatcgacctgagtccactgaaaggcatatttacatctatcgaaaatgcagcatcctcggttgcaaagaccatatctgatcagcctccgctgaaaataccaatcaggacaaacaacgctgaatcatggttgcttacgacctaccttgacgaagagctcaggatctccagaggcgatggcagcagcatctttgtgctgttcaaggaaggaagtactcttctaaactga

SEQ ID NO: 10418 - protein, 330 aa, Sorghum bicolor
  misc_feature: Ceres ANNOT ID no. 6112585
  misc_feature (104)..(322): Pfam Id: PAP_fibrillin Pfam Desc: PAP_fibrillin
  misc_feature (1)..(329): NCBI GI: 62900682 NCBI Desc: probable plastid-lipid associated protein 2, chloroplast precursor (fibrillin-like protein 2)
  misc_feature (1)..(329): NCBI GI: 29367475 NCBI Desc: fibrillin-like protein [oryza sativa (japonica cultivar-group)]
  misc_feature (17)..(329): NCBI GI: 2598049 NCBI Desc: chloroplast drought-induced stress protein, 34 kd) [solanum tuberosum]
  misc_feature (17)..(329): NCBI GI: 83743301 NCBI Desc: plastid lipid associated protein chrc [lycopersicon esculentum]
  misc_feature (71)..(329): NCBI GI: 25453087 NCBI Desc: light-induced protein, chloroplast precursor (c40.4)
  misc_feature: Useful for making plants with modulated nitrogen use efficiency
  misc_feature: Useful for making plants with modulated salt sensitivity
  misc_feature: GREAT-hit functional homolog of the protein sequence given in SEQ ID NO 12943
  misc_feature: Useful for making plants with modulated nitrogen use efficiency
  misc_feature: Useful for making plants with modulated salt sensitivity
  misc_feature: Functional homolog of the protein sequence given in SEQ ID NO 12943
  misc_feature: Up-regulated in shoot tissues in response to salicylic acid treatment
MAGSAFLNALVLRAPSPSPSLSCSSSSTRRSAGAFAFPNPPRLPSLRSARRVVLARAAAAPPGAGGDPEPEDDEWGPEPEGGSAVTGATAVAEAPEAPEAREVAELKAQLKDALYGTERGLRASSESRAKVLELITQLETRNPTPAPTEALTLLNGKWILAYTSFSQLFPLLGFGNLPELVKVEEISQTIDSENFTVQNCIKFSGPLATTSVATNAKFEIRSPKRVQIKFEEGIVGTPQLTDSIVLPEKFELFGQNIDLSPLKGIFTSIENAASSVAKTISDQPPLKIPIRTNNAESWLLTTYLDEELRISRGDGSSIFVLFKEGSTLLN

SEQ ID NO: 10419 - DNA, 1536 bp, Sorghum bicolor
  misc_feature: Ceres ANNOT ID no. 6112589
  misc_feature: Encodes the peptide sequence at SEQ ID NO 10420
atggccggaggaggatcctccgtcggtgtgccggactacggcggtggcgtgacgttctccgtcgtggtgaccagcctcatggctgcctcctgcggcatcatctttggctacgactccggcgtctcaggtggcgtgactcagatggattcattcctgagcaaattcttcccggacgtgatcgacgggaggaagagcgcaaaggtggacgcctactgcaagtacgacaaccaatggctcaccgccttcacgtcgtcgctatggatcgccggcgcgctgtcctcgctggtggcgagccgcgtgacccgaagggtgggccgccaggccatcatgctcatcggcggcgtgctgttcctcgccggctccgtcatcaacgccgccgcggtgaacatcgccatgctcatcgtcggccggatgctgctaggcttcggcctcggcttcaccttgcaggccgctccggtgtacctctccgagacggcgccggcgaggtggcgcggtgcgttcacgtcagcctacaacgcgttcgtcgtcgtcggcatactgtcggcgaccgtcaccaactacttcaccaaccgcatccccggctgggggtggcgcgtctccctgggcctggcagccgtgccgggcgccgccgtcgtcctgggagccttcttcgtctcggacacccccatcagcctggtgatgcgaggccagcacgagaaggctcgggccgcgctgcagcgcgtccgcgggggcgacgccgacgtcgacgccgagttcaaggacatcgtccgcgccgtggacgtggcgcgccagaacgacgacggcgcgttccggcggctgttcagcaaggagtaccggcactacctggcgataggggtggccataccggtgttctacgagttcaccggcatgatcgtcatctccatcttcttgccggtgctgttccggaccgtcgggttcagcagccagagggctatccttgggtccgtgatcaacagcatgaccaatctggcctcgacgctgctgtcctccgtcgtcatggaccgcgttggacgcagatttctgttcgtcgttggtggattaggcatgatgctttgcgaggtggccatctcatggatcatggcggatcacctcgggaagcacggaggggtgacgacggcgatgccgcggagctacgcgacgggcgtgctggtgctgatctgcatgtgcacgttcagcttcggcctgtcgtgggcaccgctcaggtgggtggtgccgagcgagatctaccccgtggaggtgaggtcggccgggcaggcactgagcatctccatcacgctctgcatctccttcgtggagctgcaggtgttcatcgcgctgctctgcgccatgaagtacgccgtcttcgtgctctacgccgcgtggctgctggccatgaccgtcttcgtggtgatgttcctgccggagacgaaaggggtgccgctggaggccatgcagtccgtgtgggcgcggcattggtactggaggaggttcgtcaaggttgatgccaggcagcacaacgaagtcaattgtttgtaa

SEQ ID NO: 10420 - protein, 511 aa, Sorghum bicolor
  misc_feature: Ceres ANNOT ID no. 6112589
  misc_feature (24)..(488): Pfam Id: Sugar_tr Pfam Desc: Sugar (and other) transporter
  misc_feature (5)..(437): Pfam Id: MFS_1 Pfam Desc: Major Facilitator Superfamily
  misc_feature (2)..(506): NCBI GI: 115458712 NCBI Desc: os04g0453300 [oryza sativa (japonica cultivar-group)]
  misc_feature (2)..(506): NCBI GI: 116309959 NCBI Desc: h0505f09.5 [oryza sativa (indica cultivar-group)]
  misc_feature (1)..(511): NCBI GI: 21741620 NCBI Desc: osjnba0027g07.5 [oryza sativa (japonica cultivar-group)]
  misc_feature (1)..(511): NCBI GI: 116309958 NCBI Desc: h0505f09.4 [oryza sativa (indica cultivar-group)]
  misc_feature (1)..(499): NCBI GI: 32489200 NCBI Desc: osjnba0027g07.27 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MAGGGSSVGVPDYGGGVTFSVVVTSLMAASCGIIFGYDSGVSGGVTQMDSFLSKFFPDVIDGRKSAKVDAYCKYDNQWLTAFTSSLWIAGALSSLVASRVTRRVGRQAIMLIGGVLFLAGSVINAAAVNIAMLIVGRMLLGFGLGFTLQAAPVYLSETAPARWRGAFTSAYNAFVVVGILSATVTNYFTNRIPGWGWRVSLGLAAVPGAAVVLGAFFVSDTPISLVMRGQHEKARAALQRVRGGDADVDAEFKDIVRAVDVARQNDDGAFRRLFSKEYRHYLAIGVAIPVFYEFTGMIVISIFLPVLFRTVGFSSQRAILGSVINSMTNLASTLLSSVVMDRVGRRFLFVVGGLGMMLCEVAISWIMADHLGKHGGVTTAMPRSYATGVLVLICMCTFSFGLSWAPLRWVVPSEIYPVEVRSAGQALSISITLCISFVELQVFIALLCAMKYAVFVLYAAWLLAMTVFVVMFLPETKGVPLEAMQSVWARHWYWRRFVKVDARQHNEVNCL

SEQ ID NO: 10421 - DNA, 1566 bp, Sorghum bicolor
  misc_feature: Ceres ANNOT ID no. 6112590
  misc_feature: Encodes the peptide sequence at SEQ ID NO 10422
atggccggcggaggcgggttcgccgcggcggcggagcgcggccacgcccgcgacgacgacggctacggaggtagaggaggcgtgacggtccccgtcgtggtgacctgcctcatggccgcctcctgcggcctcatcttcggctacgacattggcgtctcaggtggtgtgacgcagatggagtcgttcctgatgaagttcttcccggaagtgtcgagcgccatgacgaagaacgcgaagcacgacgcgtactgcaaatacgacgaccagcggctcacggcgttcacctcgtcgctgtacatcgccgcgatggtctcgtcgctggtggcgagccgcgtgacgaggacggtgggccggtccaccgtcatgctgatcggcggcgtcctgttcctcgcaggctccgcgatcaacgccggcgccgtcaacgtcgccatgctcatcatcgggcggatgctgctgggattcggagtcgggttcaccacgcaggctgctcctctgtacctcgcggagacatcgccggcgcggtggcgcggcgcgttcaccacggcctacaacatcttccaggtgcagggcgcgctggccgccacggtcaccaactacttcaccaaccgcatcccgggctggggatggcgcgtgtcgctcggcctcgccgccgtcccggccgccgtcgtcgtcctgggcgccctgctcgtcccggacacgcccagcagcctcgtcctgcgcggcgacaccgacagcgcccgggcctcgctgcagcgcctccgtggccccggcgcggaaaccgacgcggagctcaaggacatcgtccgcgccgtggaggacgcgcggcggaacgacgagggcgcgtacgagaggctggtgcgcggcaaggggtacgggcactacctggtgatggtggtggccatcccctccttcttcgacctcaccggcgtcatcgtcatggccgtcttctcgccggtgctgttccggacggtcgggttcagcagccagaaggcgatctttggatccgtggttcttagcctcgtcaacctggcctcgtcgttgctctcctccttcgtcatggaccgcgccggccgcaggttcttgttcctcgccggcggcgcagcaatgatgatttgtcagttggccatgtcgtgcatcctggcggggcatctgggcaagcagaacgcggcgacaatgccgcgggactacgcggtggccgtgctggtgctcatgtgcctgtacaccttcagcttcggcgtgtcgtgggggccgctgaaatgggtggtgccgagcgagatctaccccgtggagatcaggtcggcggcgcaggcgctgacggtgtccatcgcgctctgcctctccttcgcgcagacgcaggtgttcgtctccctgctgtgcgccatgaagcacggcatcttcctgttctacgccgggtgggtcctggccatgacggccttcgtcgccgcgttcctgccggagaccaaaggcgtgccgctggaggccatgcgcgccgtctgggcgggacactggtactggaggaggttcgtcagggatgccaagcaggaggttcaggtgaactgcctgtag

SEQ ID NO: 10422 - protein, 521 aa, Sorghum bicolor
  misc_feature: Ceres ANNOT ID no. 6112590
  misc_feature (35)..(499): Pfam Id: Sugar_tr Pfam Desc: Sugar (and other) transporter
  misc_feature (1)..(448): Pfam Id: MFS_1 Pfam Desc: Major Facilitator Superfamily
  misc_feature (10)..(521): NCBI GI: 21741620 NCBI Desc: osjnba0027g07.5 [oryza sativa (japonica cultivar-group)]
  misc_feature (10)..(521): NCBI GI: 116309958 NCBI Desc: h0505f09.4 [oryza sativa (indica cultivar-group)]
  misc_feature (4)..(511): NCBI GI: 115458712 NCBI Desc: os04g0453300 [oryza sativa (japonica cultivar-group)]
  misc_feature (4)..(511): NCBI GI: 116309959 NCBI Desc: h0505f09.5 [oryza sativa (indica cultivar-group)]
  misc_feature (4)..(510): NCBI GI: 32489200 NCBI Desc: osjnba0027g07.27 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MAGGGGFAAAAERGHARDDDGYGGRGGVTVPVVVTCLMAASCGLIFGYDIGVSGGVTQMESFLMKFFPEVSSAMTKNAKHDAYCKYDDQRLTAFTSSLYIAAMVSSLVASRVTRTVGRSTVMLIGGVLFLAGSAINAGAVNVAMLIIGRMLLGFGVGFTTQAAPLYLAETSPARWRGAFTTAYNIFQVQGALAATVTNYFTNRIPGWGWRVSLGLAAVPAAVVVLGALLVPDTPSSLVLRGDTDSARASLQRLRGPGAETDAELKDIVRAVEDARRNDEGAYERLVRGKGYGHYLVMVVAIPSFFDLTGVIVMAVFSPVLFRTVGFSSQKAIFGSVVLSLVNLASSLLSSFVMDRAGRRFLFLAGGAAMMICQLAMSCILAGHLGKQNAATMPRDYAVAVLVLMCLYTFSFGVSWGPLKWVVPSEIYPVEIRSAAQALTVSIALCLSFAQTQVFVSLLCAMKHGIFLFYAGWVLAMTAFVAAFLPETKGVPLEAMRAVWAGHWYWRRFVRDAKQEVQVNCL

SEQ ID NO: 10423 - DNA, 1161 bp, Sorghum bicolor
  misc_feature: Ceres ANNOT ID no. 6112601
  misc_feature: Encodes the peptide sequence at SEQ ID NO 10424
atgcacggccgccggcacctcgcggcgtccctaacccgggccctgacgcaggcgccgtcccgctccatctcctccaccccgtctctcctccaaaccctcgacccctcagtgccgtcgccatcgcctcctcccgccgcggaaccagggcggctcgcggagctgcggcggcggctgcaggcggacgcgccgtcgctgggcgacttcgcgtactcggtggaggtggggacgcggcagcgcccgctgcccaagcccaagtggatgaaggagaccgtgcctggcggcgccaagtacgcggccatcaaggccaagctgcgggagctgaagctgcacaccgtctgcgaggaggcccggtgccccaacctcggcgagtgctggtccggcggcgagaccggcaccgccaccgccacgattatgatccttggggacacctgcacgcgcggctgcagattctgtaatgtcaagacatctcgaacgccccctccaccggatcctgatgagccttccaatgttgctcaagcaattgcctcatggggccttgaatatatagttatcacgagtgttgaccgggacgatttgcctgatcagggcagtggtcactttgctgaaacagtacaaaagttaaaggctttgaagccagaaatgcttattgaagcactcgtacctgatttccgcggagatccaagctgtgtagagaaggttgcaacttctggattgcatgtttttgcgcacaatattgaaacagtggaagagcttcaaagaaatgtccgagactaccgtgcaaatttcaaacaatctatagatgttctgaaaatggcaaaagagtatgctcctcctggtacccttacaaagacatcaataatgctaggttgcggggagactccagatcaggttattagcaccatggaaaaggtgcgggctgctggtgttgacgttataacatttggccagtacatgaggccatcaaaacgtcacatgcctgtttctgagtatgttacgcctgaagctttcgagaagtaccgggcccttggtgttgaaatggggttccgctatgttgcatctgggccaatggttcgatcttcctacaaagcaggtgaattctacatcaaggctatgattgaagccgatcgatcaaaggcaaccactgcagactcaagtgcataa

SEQ ID NO: 10424 - protein, 386 aa, Sorghum bicolor
  misc_feature: Ceres ANNOT ID no. 6112601
  misc_feature (138)..(304): Pfam Id: Radical_SAM Pfam Desc: Radical SAM superfamily
  misc_feature (1)..(382): NCBI GI: 116309989 NCBI Desc: h0523f07.4 [oryza sativa (indica cultivar-group)]
  misc_feature (24)..(379): NCBI GI: 13873338 NCBI Desc: lipoic acid synthase [bruguiera gymnorrhiza]
  misc_feature (84)..(379): NCBI GI: 60650254 NCBI Desc: lipoic acid synthetase isoform 1 precursor [bos taurus]
  misc_feature (84)..(379): NCBI GI: 49117964 NCBI Desc: mgc80349 protein [xenopus laevis]
  misc_feature (73)..(378): NCBI GI: 17737685 NCBI Desc: cg5231-pa, isoform a [drosophila melanogaster]
MHGRRHLAASLTRALTQAPSRSISSTPSLLQTLDPSVPSPSPPPAAEPGRLAELRRRLQADAPSLGDFAYSVEVGTRQRPLPKPKWMKETVPGGAKYAAIKAKLRELKLHTVCEEARCPNLGECWSGGETGTATATIMILGDTCTRGCRFCNVKTSRTPPPPDPDEPSNVAQAIASWGLEYIVITSVDRDDLPDQGSGHFAETVQKLKALKPEMLIEALVPDFRGDPSCVEKVATSGLHVFAHNIETVEELQRNVRDYRANFKQSIDVLKMAKEYAPPGTLTKTSIMLGCGETPDQVISTMEKVRAAGVDVITFGQYMRPSKRHMPVSEYVTPEAFEKYRALGVEMGFRYVASGPMVRSSYKAGEFYIKAMIEADRSKATTADSSA

SEQ ID NO: 10425 - DNA, 1755 bp, Sorghum bicolor
  misc_feature: Ceres ANNOT ID no. 6112622
  misc_feature: Encodes the peptide sequence at SEQ ID NO 10426
atggctgcccgacgactacgtctccaatgggagacaccgcgagtcaccgtcgctctcctcctcctccccctcctcgccgccgccgccgcgggagcggctgccacggcagcgccagcggcagcagggcgcagggaggtggtgacgtcgccgcacggcgccgtggcggcggacgactggcggtgctcgaggatcggccgggacgcgctccgcgagggcggcagcgccgtggacgcggccgtcgcctccgcgctctgcctcggcgtcgtcagcccggcgtccagcggcgtcggcggcggcgccttcatgctcgtcaggctcgccgacggcaccgccgtcgtgtacgactcccgcgagaccgcgcccctcgccgcctccaaggacatgtacggcggcaatgagtcgctgaaagcacggggcgcgctctccatagcagtccccggggagatcgccggcctgtacgaggcgtggaagcaccacggcaagctcccatggaggcgcctcgtcctgccggccgcgcggctcgccctggcgttcaggatctcgccgtacctgcggatgcagatggaggcgaccagggacggcatcctgggcaacaacgggacgcgggccgtgtacgcgccgggcggcgacatcctcagggccggggacatgtgccgcaaccggaggctcgcccagaccctgcgggccgtcgcggagcacgggcccggcgtgttctacggcggcgccgtgggggcgcggctcgtgagggacgtccgggaggccggagggatcctgacggtggaggacctgaagaggtaccaggtgaaggtgcggcagccgctgacggagaacgtgatggggctcgaggtggtgaccatgcccccgccttccgccggcggtgccgggatgatgcttgtcctgaacatccttgatcagtttggcattcctgctggtttcgctggatctcttgggattcaccgtctcatcgagtccttgaaacattacatggcggtaaagatgaacctcggcgatcctgactttgtgaacgataacgaggttgtgtctgatatgatttcccccaaatttgctgctgaactgaagaaaaccatctatgacaacatgacatttgcgcctaaacattacggtggaaggtggaacatccttcaggaccatggaacgagccacttgtccatcgtcgacagcgagcgaaacgcggtttcgatgacgagcaccgtcaactcgtacttcgggtcactgatccattccccacgcacaggcatcctgctcaacaacgagatggacgacttctccatgccggcgaacacgacggagaattctccacccccagcacctgccaatttcgtcagccccatgaaacggcctctctcttccatgactccgaccatagttgtcaaggacgggaagctggtgtccgcagttggtgccagtggtggcagcatgatccccgctggaacgatcgaggtgttcatcaaccatttcgtcaagaacatggatccattggcttctgtcatggcgccaagggtttatcaccagctgatcccaaacgaggtcaagtacgagaactggacgacggtgaccggcgaccacttcgagctcgacgccgcgacgagggccgacctgcagaagagaggccacgtcctgaagccgctagccggtggaaccataagccagctcgtggtgcacaacgtcgggcgccaaggcgacctgaccgccgtcagtgaccccagaaaaggcggtgtcccggccggttactga

SEQ ID NO: 10426 - protein, 584 aa, Sorghum bicolor
  misc_feature: Ceres ANNOT ID no. 6112622
  misc_feature (66)..(579): Pfam Id: G_glu_transpept Pfam Desc: Gamma-glutamyltranspeptidase
  misc_feature (1)..(584): NCBI GI: 116309998 NCBI Desc: h0523f07.13 [oryza sativa (indica cultivar-group)]
  misc_feature (1)..(584): NCBI GI: 38567882 NCBI Desc: osjnba0036b21.10 [oryza sativa (japonica cultivar-group)]
  misc_feature (14)..(584): NCBI GI: 28208262 NCBI Desc: gamma-glutamyl transferase [raphanus sativus]
  misc_feature (39)..(584): NCBI GI: 23308189 NCBI Desc: at4g39640/t19p19_30 [arabidopsis thaliana]
  misc_feature (53)..(584): NCBI GI: 46402910 NCBI Desc: gamma-glutamyltransferase [allium cepa]
MAARRLRLQWETPRVTVALLLLPLLAAAAAGAAATAAPAAAGRREVVTSPHGAVAADDWRCSRIGRDALREGGSAVDAAVASALCLGVVSPASSGVGGGAFMLVRLADGTAVVYDSRETAPLAASKDMYGGNESLKARGALSIAVPGEIAGLYEAWKHHGKLPWRRLVLPAARLALAFRISPYLRMQMEATRDGILGNNGTRAVYAPGGDILRAGDMCRNRRLAQTLRAVAEHGPGVFYGGAVGARLVRDVREAGGILTVEDLKRYQVKVRQPLTENVMGLEVVTMPPPSAGGAGMMLVLNILDQFGIPAGFAGSLGIHRLIESLKHYMAVKMNLGDPDFVNDNEVVSDMISPKFAAELKKTIYDNMTFAPKHYGGRWNILQDHGTSHLSIVDSERNAVSMTSTVNSYFGSLIHSPRTGILLNNEMDDFSMPANTTENSPPPAPANFVSPMKRPLSSMTPTIVVKDGKLVSAVGASGGSMIPAGTIEVFINHFVKNMDPLASVMAPRVYHQLIPNEVKYENWTTVTGDHFELDAATRADLQKRGHVLKPLAGGTISQLVVHNVGRQGDLTAVSDPRKGGVPAGY

SEQ ID NO: 10427 - DNA, 1062 bp, Sorghum bicolor
  misc_feature: Ceres ANNOT ID no. 6112627
  misc_feature: Encodes the peptide sequence at SEQ ID NO 10428
atggctagagctgcactgctcgccattcctttgctcctgctgtgcctagcattggccggcggcacagatgctgcgaggaagacggttggggtgtacaagctccagaacaagaagggcgacttctccgtcaaggtcaccaactggggagccacgctcatgtctgtcattgttcctgactctaaaggaaacctggccgatgtcgtccttgggtatgacaagcttgcacagtatgtggacgcttcttccgcctttggaaccgtggttggacgagtagccaatagaatcgccaacggcagttttgtactcgatggaaaaaccattcgtctgaacaaaaacggcaccaccacacttcacgtcatctggacggtgaaggagtacgtgcccggcggtgactccccatacatcacactctactaccacagcttcgacagagagcaagggttcccgggggacctagacgtgtacgtgacgtaccagctgtgctgcggcccgtacgagctgagagcacggatgaacgcgacggcgctgaacaaggcgacgccggtgaacctggcgaaccacgcgtactggaacctcgccggcgacggcagcagcgacgccctcggccacctcatcaaggtgttcgcgtcgcagtatacgcccgtggacgcgtccatgatcccgacgggggagatcgccccggtctccggcacgccgtacgacctgcgcgcgccgacgctcctgggctcccgcatcaagcacgtctccggcgccggcatggccgggttcgacatcaactacgccgtggacggggacgggttccggcaggtcgcggacctccgtgacccggcgtccggtcgagcgctggagctgtgggccaaccagcccggggtgcagctctataccagcaactggctcaacaacgtcaagggcaagggtggcagggtgtacgggcagtacggcgcggtgtgcctggagacgcaggccttcccggacgccgtcaaccaccccaacttcccgtcggagatagttaggcccggcggggtgtaccagcatgacatgctgttcaagttttccttctaa

SEQ ID NO: 10428 - protein, 353 aa, Sorghum bicolor
  misc_feature: Ceres ANNOT ID no. 6112627
  misc_feature (30)..(350): Pfam Id: Aldose_epim Pfam Desc: Aldose 1-epimerase
  misc_feature (5)..(353): NCBI GI: 38567884 NCBI Desc: osjnba0036b21.19 [oryza sativa (japonica cultivar-group)]
  misc_feature (118)..(353): NCBI GI: 38567883 NCBI Desc: osjnba0036b21.18 [oryza sativa (japonica cultivar-group)]
  misc_feature (1)..(353): NCBI GI: 115458754 NCBI Desc: os04g0458300 [oryza sativa (japonica cultivar-group)]
  misc_feature (5)..(353): NCBI GI: 115458758 NCBI Desc: os04g0458600 [oryza sativa (japonica cultivar-group)]
  misc_feature (1)..(353): NCBI GI: 116310050 NCBI Desc: osigba0097p08.2 [oryza sativa (indica cultivar-group)]
MARAALLAIPLLLLCLALAGGTDAARKTVGVYKLQNKKGDFSVKVTNWGATLMSVIVPDSKGNLADVVLGYDKLAQYVDASSAFGTVVGRVANRIANGSFVLDGKTIRLNKNGTTTLHVIWTVKEYVPGGDSPYITLYYHSFDREQGFPGDLDVYVTYQLCCGPYELRARMNATALNKATPVNLANHAYWNLAGDGSSDALGHLIKVFASQYTPVDASMIPTGEIAPVSGTPYDLRAPTLLGSRIKHVSGAGMAGFDINYAVDGDGFRQVADLRDPASGRALELWANQPGVQLYTSNWLNNVKGKGGRVYGQYGAVCLETQAFPDAVNHPNFPSEIVRPGGVYQHDMLFKFSF

SEQ ID NO: 10429 - DNA, 3780 bp, Sorghum bicolor
  misc_feature: Ceres ANNOT ID no. 6112650
  misc_feature: Encodes the peptide sequence at SEQ ID NO 10430
atggcggagggcgatgcggggaaggcggaggcggggagctgcagcggcgccggagccggcggcgggtgcgacgcggtcaagaagcggccggagcagagcgtggcgttccacgagctgttcggtttcgcggacccgctggactggctgctcatggcggcgggcagcgcgggcgccgtcgtgcacggcgccgccatgccggtcttcttcctcctcttcggcgagctcgtcaacggcttcggcaagaaccagcacaacctccgccgcatgacggacgagtattcgctctacttcgtctacctcggcctcgtcgtctgcgcctcgtcctacctagagatcgcgtgctggatgtacacgggcgagcgccaggtgggcgctctccggaggcggtacctcgaggccgtgctgcgccaggacgtgggcttcttcgacaccgacgcgcgtaccggcgacgtcgtcttcagcgtctctaccgacacgctcctcgtgcaggatgccattggcgagaaggtcggcaacttcatccactacctggcgacattcctggccgggctggtcgtcgggttcgtctcggcgtggcggctcgcgttgctcagtatcgccgtcatccccggcatcgccttcgccggcgggctgtacgcgtacacgcttactggcctgacctccaagagccgggactcgtacgccaacgccggaatcatagccgagcaggccattgcccaggtgaggactgtctactcttatgtgggggagaccaaggccctgaattcctactcggaggcgattcagaacaccctgaagctgggttacaaggccgggatggccaaggggcttggcattggctgcacctatggaattgcttgtatgtcatgggcactggtgttctggtatgctggagtgttcatccggaacggccagacagatggtggcaaggccttcactgcaattttctcagcaatcgtcggtggcctgagcttggggcagtcattttcaaaccttggagcattcagcaaagggaagattgctggctacaagttgctggaagtgataaggcagaggccaacgatagttcaggacacggcagacgggaggtgccttgatgaagtacatggcaacatagagttcaaggaagtggccttcagctatccttcccgcccggatgtcatgattttccgtgatttttctctcttcttccctgctgggaagaccgcagcggtggttggaggcagtgggtctggaaagagcacagttgtagctctcattgagcggttttacgatcctaatcaggggcaagttttgctggataatgtagacatcaagacgctgcaattgaagtggcttagggagcagattggtttggtgaatcaggaacctgcactttttgcaactacaattcttgagaatattctttatggcaagcctgatgccacaatggcggaggttgaggctgcggctacttcagccaatgcccatagcttcattgctcttcttcctaatggctacaacactcatgtgggagagaggggacttcagctctctggtggtcagaagcaacgtattgccattgcccgtgcgatgctgaagaatccaaaactcctgctactagatgaggccactagtgcactcgatgctggttcagagaatattgtccaagaagcccttgatcgattgatggtcggcaggacaaccgttgtggttgcccacagattatcaacaataagatgtgtcgacatgatcgcggtgatacagcaaggccaggttgttgagactggtactcacgatgaactcctcgccaaaggaagctctggagcgtatgctgcactcatcagattccaagagacagccagaaaccgtgcatgcccatcaactcgcaagtctaggtcatcccgcttgagcaattccctctccactcggtcactgagcctcaggtcaggaagcttgaggaacctgagctactcatacagcactggtgctgatggccgcatcgagatggtttccaatgccgacaatgaccggaagtacccagcaccaaggggttacttcttcaagctcctaaaactgaatgcaccggagtggccttacaccatactgggtgctattgggtccatcctatctgggtttatcggcccgacatttgccattgtgatgagcaacatgatcgaagtgttctattaccggaaccccaacaagatggagagcaagaccagggagtacgtgttcatttacatcggcactgggctgtatgccgttgtggcatacctcgtccagcattatttcttcagcatcatgggcgaaaacctgaccaccagggtgcggaggatgatgcttgccgtgattttgaggaatgacgtcggatggttcgatcaggaggagaacaattcaaaccttgttaccgctcgcctctccacagacgctgctgatgtgaagtcggccattgctgagcggatatcggtgatcctgcagaacatgacatccctccttgtgtccttcgtggtcggctttatcattgaatggcgggtggctctcctcatcctcgtcaccttccctctcctcgtcctcgccaactttgcccagcaactgtcgatgaagggcttcgcgggcgacacggccaaggcccacgccaagacgagcatgatcgccggggagggcgtcagcaacatccgcacggtggcggcgttcaacgcgcaggacaagatcctgtcgctcttctgcagcgagctccgcgtcccgcagatgcacagcctgcggcgcagccagatctccggcgcgctcttcggcgcctcccagctctccctgtacgcctccgaggcgctcatcctctggttcggcgcgcacctcgtccgcacccacgtgtccactttctccaaggtcatcaaggtgttcgtggtcctggtgatcaccgccaactccgtcgccgagaccgtcagcctggcgccggagatcgtccgcggcggcgagtccatccgctccgtgttcgccatcctcaacagccggacccgcatcgaccccgacgacccggacgcggagcaggtggagtcggtgcgcggcgagatcgacttccgccacgtcgacttcgcgtacccgacgcgccccgacgtgatggtgttcaaggacttcagcctgcggatccgtgccgggcagagccaggcgctggtcggcgcgagcgggtccgggaagagcaccgtcatcgccctcatcgagcggttctacgacccgctcgccgggaaggtgatggtggacggcaaggacatccggcgcctgaacctcaagtcgctgcgcctcaggatcgggctggtgcagcaggagcccgtgctgttcgccgccagcatcctggagaacatcgcgtacggcagggacggcgcgacggaggaggaggtggtggaggcggccaaggtggccaacgtgcacggcttcgtgagcgcgctcccggacgggtaccggacgcccgtgggcgagcgcggggtgcagctgtccggcgggcagaagcagcgcatcgcgatcgcgcgcgcggtgctcaaggaccccgccgtgctgctgctggacgaggcgaccagcgcgctggacgccgagtccgagtgcgtgctgcaggaggcgctggagcgcatcatgaagggccgcaccgccgtgctggtggcgcaccggctgtccaccatacgcggcgtggacaacatcgcggtggtgcaggacggccgcgtggtggagcagggcagccacggggacctcgtgtcccgccccgacggcgcctactcgcggctgctgcagctgcagctgcaccacggctga

SEQ ID NO: 10430 - protein, 1259 aa, Sorghum bicolor
  misc_feature: Ceres ANNOT ID no. 6112650
  misc_feature (400)..(584): Pfam Id: ABC_tran Pfam Desc: ABC transporter
  misc_feature (1045)..(1229): Pfam Id: ABC_tran Pfam Desc: ABC transporter
  misc_feature (51)..(325): Pfam Id: ABC_membrane Pfam Desc: ABC transporter transmembrane region
  misc_feature (694)..(970): Pfam Id: ABC_membrane Pfam Desc: ABC transporter transmembrane region
  misc_feature (10)..(1259): NCBI GI: 27368847 NCBI Desc: mdr-like abc transporter [oryza sativa (japonica cultivar-group)]
  misc_feature (10)..(1259): NCBI GI: 115458764 NCBI Desc: os04g0459000 [oryza sativa (japonica cultivar-group)]
  misc_feature (1)..(1258): NCBI GI: 38347317 NCBI Desc: osjnba0063c18.8 [oryza sativa (japonica cultivar-group)]
  misc_feature (27)..(1257): NCBI GI: 24324262 NCBI Desc: mdr-like p-glycoprotein [arabidopsis thaliana]
  misc_feature (22)..(1259): NCBI GI: 4204793 NCBI Desc: p-glycoprotein [solanum tuberosum]
MAEGDAGKAEAGSCSGAGAGGGCDAVKKRPEQSVAFHELFGFADPLDWLLMAAGSAGAVVHGAAMPVFFLLFGELVNGFGKNQHNLRRMTDEYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGETKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERFYDPNQGQVLLDNVDIKTLQLKWLREQIGLVNQEPALFATTILENILYGKPDATMAEVEAAATSANAHSFIALLPNGYNTHVGERGLQLSGGQKQRIAIARAMLKNPKLLLLDEATSALDAGSENIVQEALDRLMVGRTTVVVAHRLSTIRCVDMIAVIQQGQVVETGTHDELLAKGSSGAYAALIRFQETARNRACPSTRKSRSSRLSNSLSTRSLSLRSGSLRNLSYSYSTGADGRIEMVSNADNDRKYPAPRGYFFKLLKLNAPEWPYTILGAIGSILSGFIGPTFAIVMSNMIEVFYYRNPNKMESKTREYVFIYIGTGLYAVVAYLVQHYFFSIMGENLTTRVRRMMLAVILRNDVGWFDQEENNSNLVTARLSTDAADVKSAIAERISVILQNMTSLLVSFVVGFIIEWRVALLILVTFPLLVLANFAQQLSMKGFAGDTAKAHAKTSMIAGEGVSNIRTVAAFNAQDKILSLFCSELRVPQMHSLRRSQISGALFGASQLSLYASEALILWFGAHLVRTHVSTFSKVIKVFVVLVITANSVAETVSLAPEIVRGGESIRSVFAILNSRTRIDPDDPDAEQVESVRGEIDFRHVDFAYPTRPDVMVFKDFSLRIRAGQSQALVGASGSGKSTVIALIERFYDPLAGKVMVDGKDIRRLNLKSLRLRIGLVQQEPVLFAASILENIAYGRDGATEEEVVEAAKVANVHGFVSALPDGYRTPVGERGVQLSGGQKQRIAIARAVLKDPAVLLLDEATSALDAESECVLQEALERIMKGRTAVLVAHRLSTIRGVDNIAVVQDGRVVEQGSHGDLVSRPDGAYSRLLQLQLHHG

SEQ ID NO: 10431 - DNA, 1215 bp, Sorghum bicolor
  misc_feature: Ceres ANNOT ID no. 6112653
  misc_feature: Encodes the peptide sequence at SEQ ID NO 10432
atggcgtcgtcgtccatgctctccgccaccaccgtgccactccagggggccgccggcctgtccgagttctccgggctcaggagctccgcgtcgctgccgatgcgccggaatgccacctccgacgacttcatgtccgccgtctccttcaggacccacgcggtcggcacgagcggcggctcgaggcgggcgccgacggaggcgaagctgaaggtggcgatcaacgggttcggccggatcgggcgcaacttcctgcggtgctggcacggccgcggcgacgcctcaccactggaagtcatcgccatcaacgacacgggaggcgtcaagcaggcgtcgcacctgctcaagtacgactccacgctgggcatcttcgacgccgacgtcaagcccgtcggcgacaacgccatctccgtcgacggcaaggtcatcaaggtcgtgtcggaccgcaaccccagcaacctgccgtggggcgagatgggcatcgacctcgtcatcgagggcacgggcgtcttcgtcgaccgcgagggcgccgggaagcacatccaggccggggccaagaaggtgctcatcacggcgcccggcaagggcgacatccccacctacgtcgtcggcgtcaatgccgaccagtacgaccccgacgagcccatcatcagcaacgcctcctgcaccaccaactgcctcgcgccgttcgtcaaggtgctcgaccaaaagttcggcatcatcaagggcaccatgaccaccacccactcgtacaccggcgaccagaggctgctggacgcgagccaccgcgacctgcgccgcgcgcgcgccgccgcgctcaacatcgtgcccacgtccacgggcgccgccaaggccgtctcgctggtgctcccaaacctcaagggcaagctcaacgggatcgcgctccgggtgcccaccccgaacgtctccgtcgtcgacctcgtcgtgcaggtgtccaagaagaccctcgccgaggaggtgaaccaggcgttccgcgacgccgccgccaacgagctcagcggcatcctcgaggtctgcgacgtgccgctcgtgtccgtcgacttcaggtgctccgacgtctcctccaccatcgacgcctccctcaccatggtcatgggagacgacatggtcaaggtcatctcctggtacgacaacgagtgggggtactcgcagagggttgtcgacctcgctgacatttgcgccatcaagtggaagtga

SEQ ID NO: 10432 - protein, 404 aa, Sorghum bicolor
  misc_feature: Ceres ANNOT ID no. 6112653
  misc_feature (226)..(382): Pfam Id: Gp_dh_C Pfam Desc: Glyceraldehyde 3-phosphate dehydrogenase, C-terminal domain
  misc_feature (69)..(221): Pfam Id: Gp_dh_N Pfam Desc: Glyceraldehyde 3-phosphate dehydrogenase, NAD binding domain
  misc_feature (3)..(404): NCBI GI: 763035 NCBI Desc: glyceraldehyde-3-phosphate dehydrogenase [zea mays]
  misc_feature (22)..(404): NCBI GI: 22240 NCBI Desc: gadph (383 aa) [zea mays]
  misc_feature (1)..(404): NCBI GI: 77540210 NCBI Desc: glyceraldehyde-3-phosphate dehydrogenase a subunit [glycine max]
  misc_feature (19)..(404): NCBI GI: 22655450 NCBI Desc: at3g26650/mlj15_5 [arabidopsis thaliana]
  misc_feature (1)..(404): NCBI GI: 140047434 NCBI Desc: glyceraldehyde-3-phosphate dehydrogenase, type i [medicago truncatula]
  misc_feature (3)..(404): SWISSPROT Homolog: EC 1.2.1.13 Glyceraldehyde-3-phosphate dehydrogenase A, chloroplast precursor
  misc_feature (70)..(404): SWISSPROT Homolog: EC 1.2.1.59 Glyceraldehyde-3-phosphate dehydrogenase 2
  misc_feature (69)..(403): SWISSPROT Homolog: EC 1.2.1.12 Glyceraldehyde-3-phosphate dehydrogenase 2
  misc_feature: The sequence is a functional homolog of SEQ ID NO. 307 in the 11/188,298 US application
  misc_feature: The sequence is a functional homolog of SEQ ID NO. 447 in the 11/188,298 US application
MASSSMLSATTVPLQGAAGLSEFSGLRSSASLPMRRNATSDDFMSAVSFRTHAVGTSGGSRRAPTEAKLKVAINGFGRIGRNFLRCWHGRGDASPLEVIAINDTGGVKQASHLLKYDSTLGIFDADVKPVGDNAISVDGKVIKVVSDRNPSNLPWGEMGIDLVIEGTGVFVDREGAGKHIQAGAKKVLITAPGKGDIPTYVVGVNADQYDPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELSGILEVCDVPLVSVDFRCSDVSSTIDASLTMVMGDDMVKVISWYDNEWGYSQRVVDLADICAIKWK

SEQ ID NO: 10433 - DNA, 2238 bp, Sorghum bicolor
  misc_feature: Ceres ANNOT ID no. 6112657
  misc_feature: Encodes the peptide sequence at SEQ ID NO 10434
atggccgccgccgccgccgccgccattgccgcggcgcttctccgccgctccacctccaccacgcaccaccggctcatactccctctcctctctcatctccaccgccccttgccgcaacccccgtcttccccatggctcccaccccagcaccgcttcttctccaccggcgacacagccggcggcgatcccacccggaaaccgccgccgtctcttgacccgaagcagctatggcgcgagctatccgactcggaccccgccgccggctcctcccgcctgccgaaggccacgtgggacgccgtggtgggcctcgtccgcggcttcgccaagagcccggccatgtccgaccaggcgctcgcgctctacgtcccctcgtccgccttcccctcctacgcccggcgcttccgcgcgttcctcctcccgcggctctcccgggagtccgcggcgcacctcctctcgctcccggcggaggacgcgcacgagctcctcctcccggccttcgcggagttctgcgtcgccaacttcgcggacgagctgaggcagcacaggtcggtcatggccgcggccgacctcacggcgccgcacacctggtaccccttcgcgcgcgccatgcgccgccgtatcgtgtaccactgcgggcccaccaacagcggcaagacgcacaacgcgctcacccgcttcgccgcagccaagtctggggtctactgcagcccgctccgtctccttgccatggagatcttcgacaaggttaatgccctcggtgtctactgcaccctgcgcactggacaggaggttaaggaagtgcctttcgccaaccatgttgcctgtaccattgaaatggtgtccactgaggagctctatgaagtcgccgtggttgatgagatacagatgatggctgaccctgtcaggggctttgcatggacgcgcgctgtgcttgggctcaaggcggatgagatacacctctgcggtgaccctagcgtgctcaagcttgtccggaagatttgtgcagatactggggatgatttggtggtgcaccaatatgagcgattcaagcctcttgttgttgaggcaaagacgcttcttggggacctcaagaatatccgctctggtgactgcgttgttgctttctcacgcaaggagatattcgaggtgaagctggcaattgagaagtttacaaagcacaagtgttgtgttatttatggagctctgccaccagagacacgacgacagcaagcaaagctgttcaacgagcaggataatgagtatgatgtgcttgtagcaagtgatgcagtcggtatggggctgaacctgaacattaggagggttgtgttctatagcttggccaaatacaatggggaaagaatggtaccagttcctgcttcacaggtaaagcagattgctggtcgtgctggtcggaggggcagcgtttacccagatggactcacaacaactttcttgaaggatgatttagattatttgattcagtgcctgcagcagccatttgaggaggcacagaaagttggtctttttccttgctttgagcaagtggaaaagtttgccagccaattccctgaccttgctttcactgatctgttggataaattccgtgagacttgtcgcatagataagacatacttcatgtgccagcaggatagtatcaagaaggttgctaatatgcttgagagggtgcaagggctatccctcaaggatcgctacaatttttgctttgctccagtaaatataagggatccaaaagccatgtaccatcttctgagatttgcaactaactattgccaaagccgtcgtgttagcatcgcaatgggagtgccaaggggttctgcaagaaatgacgctgagcttctggaccttgagacaaaacatcaggtcctatcaatgtatctatggttgtcacatcattttgaggaagataacttccctcatgtggagcaagctgagaacatggcaataaatattgctgatttacttggcaagtcacttgcgaaagcatgctggaagcctgaatcaagacagcaagctaggcgacgagaggacaaggatgagtacaatgaggaaaagacatcaaatggcagtgcaaaagatgtctctacagatggttatgaacggccaatggcacttgctaaaacaatagtaagacaaactgctgggtttgtatgggtttggatggggtcctgcactcagtgcagatatagatttatttttcttgtttgtaagggtaaatga

SEQ ID NO: 10434 - protein, 745 aa, Sorghum bicolor
  misc_feature: Ceres ANNOT ID no. 6112657
  misc_feature (387)..(473): Pfam Id: Helicase_C Pfam Desc: Helicase conserved C-terminal domain
  misc_feature (4)..(718): NCBI GI: 38344959 NCBI Desc: osjnba0072f16.4 [oryza sativa (japonica cultivar-group)]
  misc_feature (4)..(718): NCBI GI: 32492143 NCBI Desc: osjnba0036b21.27 [oryza sativa (japonica cultivar-group)]
  misc_feature (4)..(718): NCBI GI: 116310057 NCBI Desc: osigba0097p08.9 [oryza sativa (indica cultivar-group)]
  misc_feature (136)..(718): NCBI GI: 115458774 NCBI Desc: os04g0459800 [oryza sativa (japonica cultivar-group)]
  misc_feature (72)..(694): NCBI GI: 10176976 NCBI Desc: mitochondrial rna helicase-like protein [arabidopsis thaliana]
MAAAAAAAIAAALLRRSTSTTHHRLILPLLSHLHRPLPQPPSSPWLPPQHRFFSTGDTAGGDPTRKPPPSLDPKQLWRELSDSDPAAGSSRLPKATWDAVVGLVRGFAKSPAMSDQALALYVPSSAFPSYARRFRAFLLPRLSRESAAHLLSLPAEDAHELLLPAFAEFCVANFADELRQHRSVMAAADLTAPHTWYPFARAMRRRIVYHCGPTNSGKTHNALTRFAAAKSGVYCSPLRLLAMEIFDKVNALGVYCTLRTGQEVKEVPFANHVACTIEMVSTEELYEVAVVDEIQMMADPVRGFAWTRAVLGLKADEIHLCGDPSVLKLVRKICADTGDDLVVHQYERFKPLVVEAKTLLGDLKNIRSGDCVVAFSRKEIFEVKLAIEKFTKHKCCVIYGALPPETRRQQAKLFNEQDNEYDVLVASDAVGMGLNLNIRRVVFYSLAKYNGERMVPVPASQVKQIAGRAGRRGSVYPDGLTTTFLKDDLDYLIQCLQQPFEEAQKVGLFPCFEQVEKFASQFPDLAFTDLLDKFRETCRIDKTYFMCQQDSIKKVANMLERVQGLSLKDRYNFCFAPVNIRDPKAMYHLLRFATNYCQSRRVSIAMGVPRGSARNDAELLDLETKHQVLSMYLWLSHHFEEDNFPHVEQAENMAINIADLLGKSLAKACWKPESRQQARRREDKDEYNEEKTSNGSAKDVSTDGYERPMALAKTIVRQTAGFVWVWMGSCTQCRYRFIFLVCKGK

SEQ ID NO: 10435 - DNA, 1071 bp, Sorghum bicolor
  misc_feature: Ceres ANNOT ID no. 6112668
  misc_feature: Encodes the peptide sequence at SEQ ID NO 10436
atggagcaggagctgcaccggcccatggagctgcccccgggcttccgcttccacccgacggacgaggagctcatcacgcactacctcgcccgcaaggtcgccgacgcccgcttcgccgcgctcgccgtcggcgaggctgacctcaacaagtgcgagccctgggacctgccatcgctggcgaagatgggggagaaggagtggtacttcttctgcctcaaggaccgcaagtacccgacggggctgaggacgaacagggccacggaggccgggtactggaaggccacgggcaaggacaaggatatcttcaggggcaacggcggcaaggtgctcgtcggctccaagaagacgctcgtcttctacacggggagggcgcccaagggcgagaagtccggctgggtcatgcacgagtaccgcctccacggcaagctccatggcgccatcgtcccccccaaggccgccgccggctccaagaacgagtgggtgctgtgcagggtgttcaagaagagccttgtcgtaggcggtgcagcagcagcagcaccagccgcaggcaaaaggggcgccatggagatgtccaagatgaacgacgacatggcggccatctctcacctccctccgctgatggacgtgtccggcgccggcgccaacgtcaaccccgcggcggcggcacacgtgacctgcttctccgacgcactggagggccaccagttcttcaaccagcagcagacgccgccagaagccgacgccacggaccacctcggcctcgccgcctcctcgccgttcctgctgtccggcttcgcgcattacgggccgctgcaccacggcgcgacgagcctggtgcagctcctggagggcagcgtcgtgtacgctgccgccggcggtggcggcctcccggacatgtccaacaagcagcaacagcagcccgtgccggcgccgccgtgcaaggtgggcggcgagcgggagcggctgagcttgtcgcaggacacggggctcacctccgacgtgaaccccgagatctcctcctcctccggcgcccaacggttcgaccacgaccacctctgctggggctactga

SEQ ID NO: 10436 - protein, 356 aa, Sorghum bicolor
  misc_feature: Ceres ANNOT ID no. 6112668
  misc_feature (11)..(140): Pfam Id: NAM Pfam Desc: No apical meristem (NAM) protein
  misc_feature (1)..(356): NCBI GI: 38344965 NCBI Desc: osjnba0072f16.10 [oryza sativa (japonica cultivar-group)]
  misc_feature (1)..(356): NCBI GI: 116310448 NCBI Desc: h0219h12.10 [oryza sativa (indica cultivar-group)]
  misc_feature (9)..(356): NCBI GI: 27529810 NCBI Desc: osnac2 protein [oryza sativa]
  misc_feature (1)..(292): NCBI GI: 115446897 NCBI Desc: os02g0579000 [oryza sativa (japonica cultivar-group)]
  misc_feature (9)..(342): NCBI GI: 27529808 NCBI Desc: osnac1 protein [oryza sativa]
  misc_feature: The sequence is a functional homolog of SEQ ID NO 151 in the 11/479,226US patent application
  misc_feature: The sequence is a functional homolog of SEQ ID NO 2346 in the 10/374,780US patent application
  misc_feature: The sequence is a functional homolog of SEQ ID NO 238 in the 10/225,068US patent application
  misc_feature: The sequence is a functional homolog of SEQ ID NO 32 in the 10/412,699US patent application
  misc_feature: The sequence is a functional homolog of SEQ ID NO 326 in the 10/412,699US patent application
  misc_feature: The sequence is a functional homolog of SEQ ID NO 338 in the 10/412,699US patent application
  misc_feature: The sequence is a functional homolog of SEQ ID NO 760 in the 11/479,226US patent application
  misc_feature: The sequence is a functional homolog of SEQ ID NO 774 in the 11/479,226US patent application
  misc_feature: Useful for making plants with altered Lignin content
  misc_feature: Useful for making plants with altered terpenoid content
  misc_feature: Useful for making plants with modulated growth and phenotype characteristics
  misc_feature: GREAT-hit functional homolog of the protein sequence given in SEQ ID NO 13140
  misc_feature: Functional homolog of the protein sequence given in SEQ ID NO 13250
  misc_feature: The sequence is a functional homolog of SEQ ID NO 32 in the 20040045049 US patent application
  misc_feature: The sequence is a functional homolog of SEQ ID NO 326 in the 20040045049 US patent application
  misc_feature: The sequence is a functional homolog of SEQ ID NO 338 in the 20040045049 US patent application
  misc_feature: Useful for making plants with modulated light quality sensitivity
  misc_feature: Functional homolog of the protein sequence given in SEQ ID NO 13618
  misc_feature: Useful for making plants with altered lignin content
  misc_feature: Functional homolog of the protein sequence given in SEQ ID NO 13619
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered cell wall content and/or composition
  misc_feature: Functional homolog of the protein sequence given in SEQ ID NO 13620
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered carbohydrate content
  misc_feature: Functional homolog of the protein sequence given in SEQ ID NO 13622
  misc_feature: The sequence is a functional homolog of SEQ ID NO 890 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 891 in the 10/374,780 US patent application
  misc_feature: Useful for biocontainment applications
  misc_feature: Functional homolog of the protein sequence given in SEQ ID NO 13623
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MEQELHRPMELPPGFRFHPTDEELITHYLARKVADARFAALAVGEADLNKCEPWDLPSLAKMGEKEWYFFCLKDRKYPTGLRTNRATEAGYWKATGKDKDIFRGNGGKVLVGSKKTLVFYTGRAPKGEKSGWVMHEYRLHGKLHGAIVPPKAAAGSKNEWVLCRVFKKSLVVGGAAAAAPAAGKRGAMEMSKMNDDMAAISHLPPLMDVSGAGANVNPAAAAHVTCFSDALEGHQFFNQQQTPPEADATDHLGLAASSPFLLSGFAHYGPLHHGATSLVQLLEGSVVYAAAGGGGLPDMSNKQQQQPVPAPPCKVGGERERLSLSQDTGLTSDVNPEISSSSGAQRFDHDHLCWGY

SEQ ID NO: 10437 - DNA, 1092 bp, Sorghum bicolor
  misc_feature: Ceres ANNOT ID no. 6112670
  misc_feature: Encodes the peptide sequence at SEQ ID NO 10438
atggggcgatcgccgtgctgcgagaaggacgggttgaagaaggggccgtggacgccggaggaggaccagaagctgctcgcctacattgagcagcacggccatggctgctggcgctcgctgcccgccaaagccgggctgcagcggtgcggcaagagctgccgcctccggtggacgaactacctccggccggacatcaagcggggcaagttcagcctgcaggaggagcagaccatcatccagctccacgcgctgctcggcaacaggtggtcggcgatcgcgacgcacctcccgaagcgcacggacaacgagatcaagaactactggaacacgcacctcaagaagcggctggccaagatgggcatcgacccggtcacgcacaagccgcgctccgacgcgctcgggacaggcggcggaggagggcccggcggcgcagcgggcgcgcagcacgcccgggccgcggcgcacctcagccacacggcgcagtgggagagcgccaggctcgaggccgaggcgcgcctggcgcgcgaggccaggctgcgcgcgctcgcagcctccgccgcctccgcgtcctcgtccgtctcggcgccgcagccgcagatgcccggacacgccgcggcgcaccggctcgactcgccgacgtccacgctcagcttctccgagagcgcggcgctcgcatcggtcctgcaggaggcgcacggcgccgcagcggctgcggccgcggccgcgcgcgccgccatgcatcccatgcaggcgtacgaggtggcgtgcaaggagcagcagcagcagtggggcgatcatgttgtcgatgtcgctgacgcagggttcgcagcggcggggttcacgggcctgcttctcgacggctccttgagccagcaggatctgaggccggcgacgaggaacgacgaggacgcagccgaggcggacgccgggctgcaggagacggaggaggagaagaactactgggacagcataatgaacctgacgtcagtcgcaatgccggcgcccgaggcgtactcgtcgtcagcctcgttgtcgacgtcagtcgtcgctgtgcccgcgcccgaggcctactctccggcgctggagttctga

SEQ ID NO: 10438 - protein, 363 aa, Sorghum bicolor
  misc_feature: Ceres ANNOT ID no. 6112670
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(339): NCBI GI: 38344966 NCBI Desc: osjnba0072f16.11 [oryza sativa (japonica cultivar-group)]
  misc_feature (1)..(339): NCBI GI: 116310449 NCBI Desc: h0219h12.11 [oryza sativa (indica cultivar-group)]
  misc_feature (1)..(349): NCBI GI: 115446899 NCBI Desc: os02g0579300 [oryza sativa (japonica cultivar-group)]
  misc_feature (1)..(201): NCBI GI: 28628947 NCBI Desc: myb1 [dendrobium sp. xmw-2002-1]
  misc_feature (1)..(203): NCBI GI: 20563 NCBI Desc: protein 1 [petunia x hybrida]
  misc_feature: The sequence is a functional homolog of SEQ ID NO 296 in the 11/479,226 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1002 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1010 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 36 in US patent 7193132
  misc_feature: The sequence is a functional homolog of SEQ ID NO 1564 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRSPCCEKDGLKKGPWTPEEDQKLLAYIEQHGHGCWRSLPAKAGLQRCGKSCRLRWTNYLRPDIKRGKFSLQEEQTIIQLHALLGNRWSAIATHLPKRTDNEIKNYWNTHLKKRLAKMGIDPVTHKPRSDALGTGGGGGPGGAAGAQHARAAAHLSHTAQWESARLEAEARLAREARLRALAASAASASSSVSAPQPQMPGHAAAHRLDSPTSTLSFSESAALASVLQEAHGAAAAAAAAARAAMHPMQAYEVACKEQQQQWGDHVVDVADAGFAAAGFTGLLLDGSLSQQDLRPATRNDEDAAEADAGLQETEEEKNYWDSIMNLTSVAMPAPEAYSSSASLSTSVVAVPAPEAYSPALEF

SEQ ID NO: 10439 - DNA, 543 bp, Sorghum bicolor
  misc_feature: Ceres ANNOT ID no. 6112671
  misc_feature: Encodes the peptide sequence at SEQ ID NO 10440
atgctcccaatggccgtgcaccccacgaccacgccggccttgtccccgcgcacccgcgtctccccgcccaggccttccacctccctggccgccacctcgtccaccccctgctctcgcactgtcagtttgaagagcagcaggctgcgacttcgctcgctccgaagcgtcgtcgccgccgccgccgccgatgccgtcggggcagaggaagaagaggtgcaactaagtggaggtgtggatgcggtcgacgaggaggaagcggagaataaggtggtggtgcctgagagacaggacccgatgctggtactcaaattcatctggatggagaagaacatcggcatagcacttgaccaattggttcctggctatggcagcatcccgctaagcccatactacttttggccgcggaaagacgcgtgggaggagcttagagcgaagttggaagagaaagagtggatctcgcagaagcagatgatcatccttctcaaccaggccaccgatatcatcaacctctggcagcagggtggtgggagcctgtcgacatga

SEQ ID NO: 10440 - protein, 180 aa, Sorghum bicolor
  misc_feature: Ceres ANNOT ID no. 6112671
  misc_feature (127)..(175): Pfam Id: PSRP-3_Ycf65 Pfam Desc: Plastid and cyanobacterial ribosomal protein (PSRP-3 / Ycf65)
  misc_feature (1)..(180): NCBI GI: 6136559 NCBI Desc: plastid-specific 30s ribosomal protein 3, chloroplast precursor (psrp-3)
  misc_feature (1)..(180): NCBI GI: 7578871 NCBI Desc: plastid-specific ribosomal protein 3 precursor [spinacia oleracea]
  misc_feature (29)..(180): NCBI GI: 21554275 NCBI Desc: plastid-specific ribosomal protein 3 precursor [arabidopsis thaliana]
  misc_feature (102)..(175): NCBI GI: 1723407 NCBI Desc: probable plastid-specific 30s ribosomal protein 3 (psrp-3)
  misc_feature (81)..(175): NCBI GI: 46577386 NCBI Desc: probable 30s ribosomal protein psrp-3 (ycf65-like protein)
MLPMAVHPTTTPALSPRTRVSPPRPSTSLAATSSTPCSRTVSLKSSRLRLRSLRSVVAAAAADAVGAEEEEVQLSGGVDAVDEEEAENKVVVPERQDPMLVLKFIWMEKNIGIALDQLVPGYGSIPLSPYYFWPRKDAWEELRAKLEEKEWISQKQMIILLNQATDIINLWQQGGGSLST

SEQ ID NO: 10441 - DNA, 597 bp, Sorghum bicolor
  misc_feature: Ceres ANNOT ID no. 6112681
  misc_feature: Encodes the peptide sequence at SEQ ID NO 10442
atggcgtcgacggctcctgcgttctgcgtcgcgctgctgctgctggtggtttccgtggccggcgtccgcgcggtgccccaggacagcggcacgtccacctgcagcaccgacctcttccgcctcctcccctgcctgcccttcatcgagggcagcgccgccgtgccggcggacacctgctgcgccaacctgggcagcatggtgcacgacgagccgcagtgcctgtgccaggccctcagcaaccccagcacggcccccgtcgccgtcaacatgacgcgcgtgatggcgatgcctcgcctctgccgcctcgacctcccgcccgccaccggcgcctgcgcagttgcaggtcttcttccccatggaacatcaccgccggcgccgccagcacgcgcggtcactccacgcccaagcgccaactccactgctccagcgaccctcacgccggcgacgccaacgccaacgccgacgacaccacgtatgattccgtcaccgtcggtgagcagccagatgccgcgatacagcagggggtccaaggtgatagccgatggcttttctgtcgcccttggttttgtggcattggtgtcagtcctagctttctga

SEQ ID NO: 10442 - protein, 198 aa, Sorghum bicolor
  misc_feature: Ceres ANNOT ID no. 6112681
  misc_feature (34)..(111): Pfam Id: Tryp_alpha_amyl Pfam Desc: Protease inhibitor/seed storage/LTP family
  misc_feature (11)..(147): NCBI GI: 25553602 NCBI Desc: protease inhibitor-like protein [oryza sativa (japonica cultivar-group)]
  misc_feature (5)..(153): NCBI GI: 50509338 NCBI Desc: protease inhibitor-like protein [oryza sativa (japonica cultivar-group)]
  misc_feature (26)..(176): NCBI GI: 15220327 NCBI Desc: protease inhibitor/seed storage/lipid transfer protein (ltp) family protein [arabidopsis thaliana]
  misc_feature (12)..(193): NCBI GI: 92883937 NCBI Desc: plant lipid transfer protein/par allergen [medicago truncatula]
  misc_feature (31)..(166): NCBI GI: 30680828 NCBI Desc: protease inhibitor/seed storage/lipid transfer protein (ltp) family protein [arabidopsis thaliana]
MASTAPAFCVALLLLVVSVAGVRAVPQDSGTSTCSTDLFRLLPCLPFIEGSAAVPADTCCANLGSMVHDEPQCLCQALSNPSTAPVAVNMTRVMAMPRLCRLDLPPATGACAVAGLLPHGTSPPAPPARAVTPRPSANSTAPATLTPATPTPTPTTPRMIPSPSVSSQMPRYSRGSKVIADGFSVALGFVALVSVLAF

SEQ ID NO: 10443 - DNA, 1062 bp, Sorghum bicolor
  misc_feature: Ceres ANNOT ID no. 6112708
  misc_feature: Encodes the peptide sequence at SEQ ID NO 10444
atggcctcctcgtcggcgtcttcgaggcaccaggtcaccatcaccctcggccgcagcggtcaggttgtcaaaaggagggctatgtctgatgatattaatgaccatgaagtgccatcgtcagggaaaaagcgatctgtgagagataggttaggaagtaatgtgtctgattctgatttttatgaaagccagcaccagcagagaaacaaaaggcgacagacagaaagtaatagctcacatggagatgatggttcagatcgcctggttggcaaggatgatctgagactgaaactcatgaggaaaggcttgttacagaggagcaatggtggtgcagaacagaatggaattgatctccgtgaaaagctttcccgaaatcataagttaccaagatatgattctagaggccacgctgcagaatcaagggctagttatgatatgagagatgagcctccagagttaaggtccagatattcttcgagggaggatgtcctagggtcaaggcactcttctgttgtaagtcgagatccttatacaagaagtgtggatgatttgctaaagttggactcttcaagaaaatcttacacctcatggacagacgatggtttgaggcacagatcacctgaaaggattttaagtgctcggagtgatgtgtctccaccgatagcttatgatcagattaggcccatgccaccccttagatctgccggttcctcaagacctcaaagttttattacaagagatgctcctgacacgtcaaggagtcaaccatatgctggcaaatccaccatttctgttgatacagtacagagaactaatggaatcactccatctagtgcagctctacctaaggtccctgttatggctgaagccccacttacagttactggattgctgaattcgttgggtcttgagaagtatcttgttctctttcaggctgaggaggtggatatggctgcattgaagcaaatgggggagagtgacctcaaagacatgggggtaccaatgggcccgaggaagaagattctccttgcagttggtcctcagttgaaacaacggcataaatga

SEQ ID NO: 10444 - protein, 353 aa, Sorghum bicolor
  misc_feature: Ceres ANNOT ID no. 6112708
  misc_feature (287)..(349): Pfam Id: SAM_1 Pfam Desc: SAM domain (Sterile alpha motif)
  misc_feature (285)..(351): Pfam Id: SAM_2 Pfam Desc: SAM domain (Sterile alpha motif)
  misc_feature (1)..(351): NCBI GI: 38347059 NCBI Desc: osjnba0060p14.15 [oryza sativa (japonica cultivar-group)]
  misc_feature (1)..(351): NCBI GI: 116310123 NCBI Desc: osigba0130p02.4 [oryza sativa (indica cultivar-group)]
  misc_feature (4)..(235): NCBI GI: 30697996 NCBI Desc: sterile alpha motif (sam) domain-containing protein [arabidopsis thaliana]
  misc_feature (234)..(344): NCBI GI: 116634831 NCBI Desc: osigba0135c09.6 [oryza sativa (indica cultivar-group)]
  misc_feature (234)..(344): NCBI GI: 115457974 NCBI Desc: os04g0378200 [oryza sativa (japonica cultivar-group)]
MASSSASSRHQVTITLGRSGQVVKRRAMSDDINDHEVPSSGKKRSVRDRLGSNVSDSDFYESQHQQRNKRRQTESNSSHGDDGSDRLVGKDDLRLKLMRKGLLQRSNGGAEQNGIDLREKLSRNHKLPRYDSRGHAAESRASYDMRDEPPELRSRYSSREDVLGSRHSSVVSRDPYTRSVDDLLKLDSSRKSYTSWTDDGLRHRSPERILSARSDVSPPIAYDQIRPMPPLRSAGSSRPQSFITRDAPDTSRSQPYAGKSTISVDTVQRTNGITPSSAALPKVPVMAEAPLTVTGLLNSLGLEKYLVLFQAEEVDMAALKQMGESDLKDMGVPMGPRKKILLAVGPQLKQRHK

SEQ ID NO: 10445 - DNA, 1038 bp, Sorghum bicolor
  misc_feature: Ceres ANNOT ID no. 6112713
  misc_feature: Encodes the peptide sequence at SEQ ID NO 10446
atgggcgcgccgctgctccgccgccgcctcctgctgtccctcgcgctcctggccgcctgctgcgccgcggtggggacagcggcggcggcgaaagcgaaagcgcccaggctgtcgcccaactactaccgccacagctgcccgcgggtgcagcggatcgtgtcggacgtcatcgcggcaaagcagcgcgcctacccgtcgacggcggcgggcacgctgcggctcttcttccacgactgcttcgtcaacggctgcgacgcctccgtgctggtctccccgctctcctccaccgcggccccggagcgcgcggcggagatcaacctctccctgcccggggacgccttctacgccgtggcccgcgccaaggcggcgctggagaccgcctggcccggtgtggtgtcctgcgccgacgtcctggcgctggcggcgcgggacctcgtggggatccttggcgggccacggttccccgtcgcgctgggccgccgcgactccgcccgctccgaggcgcgcgacgtggagggcaacctgccacgcaccaacatgtcggcgcgcgccatggtgcggctcttcgcgggcaaggggctctcggcccgggagatggtggcgctggccggcgcccacaccgtgggcttctcccactgcgccgagttcgcgcaccgcatctacggataccggggcccgggcgccgccggcgccggggccggccacgacccgcggctcaacccggagttcgcccgcgcgctgcagcgctcctgcgcggggtaccggaccgaccccaccgtctccatcttcaacgacatcgtcacgcccagtgagttcgacgaggcatactacaagaacctgccccacgggctgggcctgctcgcctccgacgccgccatctgggagtacccgcccaccagggtgttcgcgcagcggtactccgccaaccgcaccgccttcttcgaggacttcgccgccgccatgcagaggctcggcgccgtcggcgtcaagaccgggcgccagggcgtcgtcagacgccgctgcgacgcgctcgactga

SEQ ID NO: 10446 - protein, 345 aa, Sorghum bicolor
  misc_feature: Ceres ANNOT ID no. 6112713
  misc_feature (53)..(309): Pfam Id: peroxidase Pfam Desc: Peroxidase
  misc_feature (1)..(344): NCBI GI: 32489883 NCBI Desc: osjnba0060p14.16 [oryza sativa (japonica cultivar-group)]
  misc_feature (21)..(342): NCBI GI: 9759442 NCBI Desc: peroxidase [arabidopsis thaliana]
  misc_feature (21)..(342): NCBI GI: 21593687 NCBI Desc: peroxidase [arabidopsis thaliana]
  misc_feature (12)..(345): NCBI GI: 89274149 NCBI Desc: at5g40150 [arabidopsis thaliana]
  misc_feature (36)..(345): NCBI GI: 92890173 NCBI Desc: haem peroxidase, plant/fungal/bacterial [medicago truncatula]
  misc_feature (21)..(342): SWISSPROT Homolog: EC 1.11.1.7 Peroxidase 65 precursor
  misc_feature: Useful for making plants with altered cell wall content and/or composition
  misc_feature: Functional homolog of the protein sequence encoded by LOCUS at1g24110
  misc_feature: Functional homolog of the protein sequence encoded by LOCUS at3g28200
  misc_feature: Functional homolog of the protein sequence encoded by LOCUS at4g17690
  misc_feature: Functional homolog of the protein sequence encoded by LOCUS at5g40150
  misc_feature: GREAT-hit functional homolog of the protein sequence encoded by LOCUS at5g47000
  misc_feature: Useful for making plants with altered carbohydrate content
  misc_feature: Functional homolog of the protein sequence given in SEQ ID NO 13617
MGAPLLRRRLLLSLALLAACCAAVGTAAAAKAKAPRLSPNYYRHSCPRVQRIVSDVIAAKQRAYPSTAAGTLRLFFHDCFVNGCDASVLVSPLSSTAAPERAAEINLSLPGDAFYAVARAKAALETAWPGVVSCADVLALAARDLVGILGGPRFPVALGRRDSARSEARDVEGNLPRTNMSARAMVRLFAGKGLSAREMVALAGAHTVGFSHCAEFAHRIYGYRGPGAAGAGAGHDPRLNPEFARALQRSCAGYRTDPTVSIFNDIVTPSEFDEAYYKNLPHGLGLLASDAAIWEYPPTRVFAQRYSANRTAFFEDFAAAMQRLGAVGVKTGRQGVVRRRCDALD

SEQ ID NO: 10447 - DNA, 954 bp, Sorghum bicolor
  misc_feature: Ceres ANNOT ID no. 6112717
  misc_feature: Encodes the peptide sequence at SEQ ID NO 10448
atggcggcgtcgcccgccctcctctcgctgacccccgccgtctccaggcacccccacctcctcttctccccttgccctccgccgcgccacgtccgcctcgccccccctctagccgccgccacaccctccccgggcgggaacggccctggccctggccccggcgtcttcctgtcgccgcgcgcgctctcgcagctcgacgagctcgcggcgttccgctacgagcacgccttcccgcacggcctcctcaccgtgcgcgccctcacgcgtggccccgacgacgacgccgtggccgaggcgctcgtccgcctcctcgcctcctccttctccgagaccgtgcgctgggccccggcgcagcggtacgcgcagctcctcacgttcgtcatccgcaggtacctccacgaccgccgcgggctcgcgccgcacgccgcggtgctcgtggggttctaccgccccgctgacgccggcagcgacgacagcgccgcctcggaggagggcggccgggatgatgagggcggcgaaggggagggtggagatgaaggggagatggcgtgcaccgcggaggtgtcgtttgacgcggtgggcgcgcccggggccccgcccacgcccactccgccgctcgacttcccctacatctgcaacatgactgtgaagacgccactgagaaggagaggaattggaaagcaacttcttaaggcatgcgaggatctggttttcaagatgaatgccagaagacgtgtgtatcttcattgtagaataatcgaccaagtcccattcaacatgtacaggaaagctggatatattattgtccagactgacagtattttggtctggctgagccttcaaaagcggaagtacttgatgagcaaggaattaccccaagcttctgttgttagtgagacttcaaccaaaaactttgatgataatattgacaagctgaatgtgctacgggactaa

SEQ ID NO: 10448 - protein, 317 aa, Sorghum bicolor
  misc_feature: Ceres ANNOT ID no. 6112717
  misc_feature (174)..(267): Pfam Id: Acetyltransf_1 Pfam Desc: Acetyltransferase (GNAT) family
  misc_feature (56)..(150): NCBI GI: 92875056 NCBI Desc: oleosin; casein, alpha/beta [medicago truncatula]
MAASPALLSLTPAVSRHPHLLFSPCPPPRHVRLAPPLAAATPSPGGNGPGPGPGVFLSPRALSQLDELAAFRYEHAFPHGLLTVRALTRGPDDDAVAEALVRLLASSFSETVRWAPAQRYAQLLTFVIRRYLHDRRGLAPHAAVLVGFYRPADAGSDDSAASEEGGRDDEGGEGEGGDEGEMACTAEVSFDAVGAPGAPPTPTPPLDFPYICNMTVKTPLRRRGIGKQLLKACEDLVFKMNARRRVYLHCRIIDQVPFNMYRKAGYIIVQTDSILVWLSLQKRKYLMSKELPQASVVSETSTKNFDDNIDKLNVLRD

SEQ ID NO: 10449 - DNA, 1731 bp, Sorghum bicolor
  misc_feature: Ceres ANNOT ID no. 6112725
  misc_feature: Encodes the peptide sequence at SEQ ID NO 10450
atggcttcgctctgccccttgtccgccgcgcccactgtcccgcgcgctcgccgtgccgcaagcttcaggagccccgctccctggaccggcctcgccgcgaccgcgagcaatgccagtccctgcggctgtgggcttctgcccgctggaggctacgcgaggctgcggtcgcgtttgaggagccccgtgcgcgccaagatcgacgaggccggcaaggacacgggcgccggtctgggtttccccccgccccgccgccggaagctgcgcctgcgcctgcggccgcggctgcgcctcctgtggtggcggctccggcggctgtcgccgcgggagctcgcggccgacgccggggcagcgctgcggcgcgccgtccgacgcgtgccccccgcggccgccgcgccggtcgtcctggcgctgctcctcgccgtcgcgcggctcgcgctgcccaagaacgtggcccgggaggtggcctactcggacctcgtcgcggggctccgcgagggcgccgtggccgccgtcgcgttcgaggaggactcgcgccgtatctacttcagcaagaaagatggggacgacggcggctccgacacgagcgaggccggtgagagcgctgctgtggcggcgccgaagtggccgtactacgcgcggagggtgtcgcacgatgagggcttcctgctcgggctaatgcgggagggcggggtggactaccgatcggcgccgcggcctgctgggaggctgctcgtcgacatgctgagcacgctgctcacgctctgggtctcgctggtgcccatgatgtggttcatacagcggcagatgtctggtggtggcagtgctgacaagcgacgcaaaccgaggaagcagatggtgggctttgacgatgttcagggtgtagatgaagcgaaggaggagcttgttgagatagtgagctgtctgcatggttcactaaactacaagaagcttggagcaaaattgcccaggggtgttctgcttgttggccctcctggaactgggaagactctgttagcaagggcagttgcaggagaggctggaattccatttttctctgtttctgctagtgagtttgttgaagttttcgttggacgaggtgcagcccgagtcagggatttgttcaaggaggccaaagaagctgccccgtcaatcatttttattgatgaacttgatgctgtgggtggaagtcgaggtagaagttttaatgatgagagggaccaaactctaaaccagctgcttactgaaatggatggttttgactcggacatgaaagttattgtcatggctgctactaacaggccaaaagcactggatgctgctctttgtcgacctggccgcttctccagaaaggttgttgttggtaggcctgatgtggagggccgtaaaaagattctggctgttcatctaagggatattcctttggaagagaatcccgaaataattagtgatctggttgctagagtaactccaggattggtcggtgcagatctagcaaacattgttaatgaggctgctctattagctgcacgaagaggtcggaatactgtgtcccgggaggatattatggatgcaattgagagggagaaatacggggtcaacgggagacaagaaactgatgattctgaaaggcaaggcctcaccaagttatttccatggttacctaaatctggaaataaaccatcaagccctgatgatttccgaggactgatgggttatcatacattaagctaa

SEQ ID NO: 10450 - protein, 576 aa, Sorghum bicolor
  misc_feature: Ceres ANNOT ID no. 6112725
  misc_feature (324)..(510): Pfam Id: AAA Pfam Desc: ATPase family associated with various cellular activities(AAA)
  misc_feature (152)..(298): Pfam Id: FtsH_ext Pfam Desc: FtsH Extracellular
  misc_feature (2)..(576): NCBI GI: 116309721 NCBI Desc: osigba0115m15.4 [oryza sativa (indica cultivar-group)]
  misc_feature (2)..(576): NCBI GI: 38606517 NCBI Desc: osjnba0016o02.1 [oryza sativa (japonica cultivar-group)]
  misc_feature (206)..(576): NCBI GI: 21592745 NCBI Desc: cell division protein ftsh-like protein [arabidopsis thaliana]
  misc_feature (225)..(535): NCBI GI: 86139142 NCBI Desc: atp-dependent metalloprotease ftsh [roseobacter sp. med193]
  misc_feature (188)..(535): NCBI GI: 114765727 NCBI Desc: atp-dependent metalloprotease ftsh [roseovarius sp. htcc2601]
  misc_feature: The sequence is a functional homolog of SEQ ID NO. 462 in the 11/188,298 US application
  misc_feature: The sequence is a functional homolog of SEQ ID NO. 471 in the 11/188,298 US application
MASLCPLSAAPTVPRARRAASFRSPAPWTGLAATASNASPCGCGLLPAGGYARLRSRLRSPVRAKIDEAGKDTGAGLGFPPPRRRKLRLRLRPRLRLLWWRLRRLSPRELAADAGAALRRAVRRVPPAAAAPVVLALLLAVARLALPKNVAREVAYSDLVAGLREGAVAAVAFEEDSRRIYFSKKDGDDGGSDTSEAGESAAVAAPKWPYYARRVSHDEGFLLGLMREGGVDYRSAPRPAGRLLVDMLSTLLTLWVSLVPMMWFIQRQMSGGGSADKRRKPRKQMVGFDDVQGVDEAKEELVEIVSCLHGSLNYKKLGAKLPRGVLLVGPPGTGKTLLARAVAGEAGIPFFSVSASEFVEVFVGRGAARVRDLFKEAKEAAPSIIFIDELDAVGGSRGRSFNDERDQTLNQLLTEMDGFDSDMKVIVMAATNRPKALDAALCRPGRFSRKVVVGRPDVEGRKKILAVHLRDIPLEENPEIISDLVARVTPGLVGADLANIVNEAALLAARRGRNTVSREDIMDAIEREKYGVNGRQETDDSERQGLTKLFPWLPKSGNKPSSPDDFRGLMGYHTLS

SEQ ID NO: 10451 - DNA, 1131 bp, Sorghum bicolor
  misc_feature: Ceres ANNOT ID no. 6112726
  misc_feature: Encodes the peptide sequence at SEQ ID NO 10452
atgttgaaggtcctcgaggggcggcgccaggccaagatggggttcaggatgccggcggagtgggagccgcacgagcagtgctggatgggatggcccgagcgtccagataactggagggagaatgctggtccagctcaagaggtatttgctagaactgcaattgccatttcaaagtttgaaaacgtcacgttatgtgcaagtgccaagcagtatcccaaagtccacgagctcatggaacatcagaccaacatcagggtggttgagatgagcatgaatgattcctggttccgtgatatgggacccacttttatcactcgtaaaggtgattcaggaaacgcagaaaaaacaattgcaggaattgattggcaatttaatgcctggggaggaatctatgatgattggagtcttgacagcgatgttgccaagaaaatagtcgagattgagaggattcctaggtttctgcataaaatgatccttgagggtggtagcattcatgtagatggagaaggtacatgcataacaacagaagagtgcttgttgaatcctaacagaaaccccaacatgaccaaactggagatagagaatgagctaaaggattttcttggagtctcaaaggtcatctggatacctcgtggactttacggtgatgaggatacgaatggccacgttgacaatatgtgctgtttcattaaacccggtgtgatcctactgtcgtggaccgatgatgagaaggaccctcagtatgaacggtcagtcgaggcactgtctgttctctctcagtccattgacgcgaaaggacggcagctcgaagtggtgaagatccacgtgcctgggcctctgtacatgacaaaagaagaggcagagggtgtgtttcaacggtcagggcatgctgtgccgagggaaccaggcacgagattggccgcctcgtatgtgaacttctacatcgccaatggcgggattgtagcaccttctttcggcgacaacaagtgggacaaggaggcatatgcggttctccagaaggcgtttcctgatcacgaggtggtgatggttgaaggcgctcgagagatcgtgctgggaggtggaaacattcactgcatcacgcagcagcagcccgtgcgcccgtcgtcctag

SEQ ID NO: 10452 - protein, 376 aa, Sorghum bicolor
  misc_feature: Ceres ANNOT ID no. 6112726
  misc_feature (15)..(371): Pfam Id: PAD_porph Pfam Desc: Porphyromonas-type peptidyl-arginine deiminase
  misc_feature (5)..(375): NCBI GI: 115458864 NCBI Desc: os04g0466600 [oryza sativa (japonica cultivar-group)]
  misc_feature (5)..(375): NCBI GI: 116309723 NCBI Desc: osigba0115m15.6 [oryza sativa (indica cultivar-group)]
  misc_feature (6)..(376): NCBI GI: 52696126 NCBI Desc: chain b, x-ray structure of gene product from arabidopsis thaliana at5g08170, agmatine iminohydrolase
  misc_feature (14)..(371): NCBI GI: 116054019 NCBI Desc: agmatine deiminase [pseudomonas aeruginosa ucbpp-pa14]
  misc_feature (14)..(371): NCBI GI: 84324372 NCBI Desc: cog2957: peptidylarginine deiminase and related enzymes [pseudomonas aeruginosa 2192]
  misc_feature (6)..(376): SWISSPROT Homolog: EC 3.5.3.12 Agmatine deiminase
MLKVLEGRRQAKMGFRMPAEWEPHEQCWMGWPERPDNWRENAGPAQEVFARTAIAISKFENVTLCASAKQYPKVHELMEHQTNIRVVEMSMNDSWFRDMGPTFITRKGDSGNAEKTIAGIDWQFNAWGGIYDDWSLDSDVAKKIVEIERIPRFLHKMILEGGSIHVDGEGTCITTEECLLNPNRNPNMTKLEIENELKDFLGVSKVIWIPRGLYGDEDTNGHVDNMCCFIKPGVILLSWTDDEKDPQYERSVEALSVLSQSIDAKGRQLEVVKIHVPGPLYMTKEEAEGVFQRSGHAVPREPGTRLAASYVNFYIANGGIVAPSFGDNKWDKEAYAVLQKAFPDHEVVMVEGAREIVLGGGNIHCITQQQPVRPSS

SEQ ID NO: 10453 - DNA, 2082 bp, Sorghum bicolor
  misc_feature: Ceres ANNOT ID no. 6112736
  misc_feature: Encodes the peptide sequence at SEQ ID NO 10454
atgcagggccgcctccggcgcgtcctccgggcgccgccgcctagaatcctactctaccgcgcgatctcctccccgccgcccggaggcaacggcggtggcggtggcgatggtggcagcggggtggcggtgaagcaggtgacgcgggggaacatggcggaggccctggagaagctgcggggacgcgtgcgggaggccgcattcgtaggggtggacctggagatgagcggcgtcacgagcgcgccctggagagacaccttcgagttcgaccgcgccgacgtgcgctacctcaaactccgcgactccgcggagcggcataacttctttatcttccctcgcaaggagctccctagtgattgttcatctcatgagtttctttgtcagacaacttcaattgacttcctagcaaagtaccagtttgatttcaacacatgcttccgtgaaggaatatcttatctatccagagcacaagaggaagaggcgctacagaaatttaatacattgcatcatggtcaaaccgctacatcttccaccaattctgaagaggacggagacatacctttaaagagtgcttctgatattcttttcacagaaaggatgaaaatgaacttcaaggaatggcgtgatgtgatagtcagcaagccaatggttgacaaccatttgtcagtaaacattaaatgtggtgcaggacaattccagacagttttcttcaaaatgcgcccagctattatgcttaatggattctcatcccatcaattgaagttaattcaacaggttttgagaaaaaactttagggatcttgtttttgtctgtacatttggtgaggatgacacatctgaaaagaaagtagtttattcagacactgatgaggacagaatgttattaatgaaagatgtgcaggaagatcaactaaaaaacagggaagaaagagtcaaatcagcaataggaatccgccatgtcatcgaccttctttcatcagaaaggaaattgattattggacatagttgtttcctagatattgcccaagtgtacagcaagtttgtaggtcctcttccatcatctatcaaggaatttgcgttaagtttccacaaaattttcccacacattgcagataccaggcatcttttgtctgtcaatcaagcagttcaggaactgatgaagcagaaaagcaaatcactatcttcagctttctcattgttgtgccctgcatcttattcatcggctgagaaggcatccagtcattctcctgtgacaattgaagttgaaggagatgaaacgacgtcttcttccttcatttcaggtgccaagcatgaagctggatatgatgcatacatgactggatgtatttttgcgcagttgtgtgcttatcttggcataaaatttgagcagttctcacctctggatgacctagcaacgaacactaggctgcagaaacacatcaattttttgtcccctagctggaacagtggaacagtgattgatttgagcactggcatggagagaccagatccaggttatatgagaaggtaccctgctgctgtgtatgataacatcgttgtcatttggggattcatgtctaaggttagaccaaaggaaattaaggattgcatctgcaaagtatttggttcaggttcggttacaaccgtcttctccattgattccactgctgcccttgtgcagttcaagaaacaagagtccgtaaacgatttcttggatttgaagtctgctttggagagggcagatagtgctgtcttaattctacaccccctgtcaactatattggaaggaggccaaacacgagctgcaaagtatgatacctacagagacatctgcagctcttctgaatcaaaatctctctttgctgatcaagctgaagcagtttgtgcaacttcaaagaatcaattcaaagaaaatgttgatgataatcttatatctggtgttcttgatggatttgcactcacctctgaaactgagggagatggaatattatcgggttccaagaatcaagacgttgctgatgttacatgtcacgatattttagatgctctacacgatggcaaagcattgttgggcagacgaatgtga

SEQ ID NO: 10454 - protein, 693 aa, Sorghum bicolor
  misc_feature: Ceres ANNOT ID no. 6112736
  misc_feature (44)..(451): Pfam Id: CAF1 Pfam Desc: CAF1 family ribonuclease
  misc_feature (10)..(693): NCBI GI: 116309728 NCBI Desc: osigba0115m15.11 [oryza sativa (indica cultivar-group)]
  misc_feature (10)..(693): NCBI GI: 116310355 NCBI Desc: osigba0128p10.2 [oryza sativa (indica cultivar-group)]
  misc_feature (451)..(693): NCBI GI: 57834081 NCBI Desc: osjnba0016o02.8 [oryza sativa (japonica cultivar-group)]
  misc_feature (154)..(693): NCBI GI: 115458872 NCBI Desc: os04g0467400 [oryza sativa (japonica cultivar-group)]
  misc_feature (105)..(633): NCBI GI: 60390594 NCBI Desc: poly(a)-specific ribonuclease parn (polyadenylate-specific ribonuclease) (atparn)
MQGRLRRVLRAPPPRILLYRAISSPPPGGNGGGGGDGGSGVAVKQVTRGNMAEALEKLRGRVREAAFVGVDLEMSGVTSAPWRDTFEFDRADVRYLKLRDSAERHNFFIFPRKELPSDCSSHEFLCQTTSIDFLAKYQFDFNTCFREGISYLSRAQEEEALQKFNTLHHGQTATSSTNSEEDGDIPLKSASDILFTERMKMNFKEWRDVIVSKPMVDNHLSVNIKCGAGQFQTVFFKMRPAIMLNGFSSHQLKLIQQVLRKNFRDLVFVCTFGEDDTSEKKVVYSDTDEDRMLLMKDVQEDQLKNREERVKSAIGIRHVIDLLSSERKLIIGHSCFLDIAQVYSKFVGPLPSSIKEFALSFHKIFPHIADTRHLLSVNQAVQELMKQKSKSLSSAFSLLCPASYSSAEKASSHSPVTIEVEGDETTSSSFISGAKHEAGYDAYMTGCIFAQLCAYLGIKFEQFSPLDDLATNTRLQKHINFLSPSWNSGTVIDLSTGMERPDPGYMRRYPAAVYDNIVVIWGFMSKVRPKEIKDCICKVFGSGSVTTVFSIDSTAALVQFKKQESVNDFLDLKSALERADSAVLILHPLSTILEGGQTRAAKYDTYRDICSSSESKSLFADQAEAVCATSKNQFKENVDDNLISGVLDGFALTSETEGDGILSGSKNQDVADVTCHDILDALHDGKALLGRRM

SEQ ID NO: 10455 - DNA, 1149 bp, Sorghum bicolor
  misc_feature: Ceres ANNOT ID no. 6112737
  misc_feature: Encodes the peptide sequence at SEQ ID NO 10456
atggacgccgccgccggtggccgcccgagccccgcgcctatccgctgcaccagcgcggagacggtcagcttttccgcgctcgattcccccgacgccgaggtggaggtggatgaggtcgcgacgagctcgcacgccgcgggggccaccacggacacggagcaagggggcaacgggagccccgtggcgggtgccgcggactccgccgaggtcgtcccgggcgtcgacgggataaggatccggcggcggcccgtcacggggcccgcggtgcactacgtgggcccgttccagttccgcctcgagaacgaggggaacacgccgcggaacatcctcgagaagatcatctgggacaaggatgtagagatgaaggagaggaggcccctgtacatgctgaagggcccgcttgaggctgctccccccgctagggactttgttggggcgctcaaggcgtcctatgatcgaactggcttgcctgctctgatcgcggaggtcaagaaggcttcaccaagccggggtgttatcagggagaattttgatccggttcagatcgctcaggcatacgagaaaaacggagcagcatgccttagtgttcttacagacgaaaaatactttcagggaagttttaacaacttggaggctattcgcaatgctggagtccagtgccctcttctgtgcaaagagttcattgttgatgcttggcaactttactatgcacggtccaagggtgcagacgctgttcttctaattgctgctgtattacctgaccgcgatatcaaatatatgttgaaaatttgcaagatacttgggatggctgctttagttgaggtccatgatgaaatggaaatggaccgtgttttagggattgatggtgtacagctcatcggcatcaataaccgtaatcttgagacatttgaagttgatattacaaacacaaaaaagcttctggagggtgaacgaggacaaattatagctcaaaaggatgtaattgttgtaggagaatctgggctgttcactcctgatgatatttcgtttgttcaaaatgctggggtcaaagcggttctcgtcggggaatccctcatcaagcaggaggatccagggaaagcaatcgctgggcttttcggcaaagatatctcgcacgctggtgctacctaa

SEQ ID NO: 10456 - protein, 382 aa, Sorghum bicolor
  misc_feature: Ceres ANNOT ID no. 6112737
  misc_feature (109)..(371): Pfam Id: IGPS Pfam Desc: Indole-3-glycerol phosphate synthase
  misc_feature (3)..(381): NCBI GI: 116309729 NCBI Desc: osigba0115m15.12 [oryza sativa (indica cultivar-group)]
  misc_feature (69)..(377): NCBI GI: 145334777 NCBI Desc: indole-3-glycerol-phosphate synthase [arabidopsis thaliana]
  misc_feature (121)..(381): NCBI GI: 38606522 NCBI Desc: osjnba0016o02.9 [oryza sativa (japonica cultivar-group)]
  misc_feature (76)..(378): NCBI GI: 619732 NCBI Desc: indole-3-glycerol phosphate synthase
  misc_feature (137)..(381): NCBI GI: 115458874 NCBI Desc: os04g0467700 [oryza sativa (japonica cultivar-group)]
  misc_feature (76)..(378): SWISSPROT Homolog: EC 4.1.1.48 Indole-3-glycerol phosphate synthase, chloroplast precursor
MDAAAGGRPSPAPIRCTSAETVSFSALDSPDAEVEVDEVATSSHAAGATTDTEQGGNGSPVAGAADSAEVVPGVDGIRIRRRPVTGPAVHYVGPFQFRLENEGNTPRNILEKIIWDKDVEMKERRPLYMLKGPLEAAPPARDFVGALKASYDRTGLPALIAEVKKASPSRGVIRENFDPVQIAQAYEKNGAACLSVLTDEKYFQGSFNNLEAIRNAGVQCPLLCKEFIVDAWQLYYARSKGADAVLLIAAVLPDRDIKYMLKICKILGMAALVEVHDEMEMDRVLGIDGVQLIGINNRNLETFEVDITNTKKLLEGERGQIIAQKDVIVVGESGLFTPDDISFVQNAGVKAVLVGESLIKQEDPGKAIAGLFGKDISHAGAT

SEQ ID NO: 10457 - DNA, 402 bp, Sorghum bicolor
  misc_feature: Ceres ANNOT ID no. 6112746
  misc_feature: Encodes the peptide sequence at SEQ ID NO 10458
atgaagcaaaagacggtgatcaaggtgagcatgccgtgcgataggagccggtccaaagccctgacgctggccgcccgagcagacggggtaatctccgtggagatcaccggcggcgacaaggacaagctggaggtggtcggcgacggcgtcgacacggtctgcttggtcagctgcctgcgcaggaagctcggccacgccgacatcctgcaggtggaggaagtgaagcccgatgacccgacgaacaaggagtcgccggacgggccgacgccgccgcccgagccagtaccgccgccgccgcatccagactacacctacacggattgctgctgctgctgccaccaccaccacccgccaccgccaatggtcatctgcgaggaaccaagcaattgcgccgtcatgtaa

SEQ ID NO: 10458 - protein, 133 aa, Sorghum bicolor
  misc_feature: Ceres ANNOT ID no. 6112746
  misc_feature (5)..(75): Pfam Id: HMA Pfam Desc: Heavy-metal-associated domain
  misc_feature (1)..(133): NCBI GI: 116310418 NCBI Desc: osigba0150f01.6 [oryza sativa (indica cultivar-group)]
  misc_feature (1)..(133): NCBI GI: 115458830 NCBI Desc: os04g0464100 [oryza sativa (japonica cultivar-group)]
  misc_feature (1)..(133): NCBI GI: 116310363 NCBI Desc: osigba0128p10.10 [oryza sativa (indica cultivar-group)]
  misc_feature (1)..(83): NCBI GI: 144923988 NCBI Desc: heavy metal transport/detoxification protein [medicago truncatula]
  misc_feature (1)..(87): NCBI GI: 8978333 NCBI Desc: atfp4-like [arabidopsis thaliana]
MKQKTVIKVSMPCDRSRSKALTLAARADGVISVEITGGDKDKLEVVGDGVDTVCLVSCLRRKLGHADILQVEEVKPDDPTNKESPDGPTPPPEPVPPPPHPDYTYTDCCCCCHHHHPPPPMVICEEPSNCAVM

SEQ ID NO: 10459 - DNA, 573 bp, Sorghum bicolor
  misc_feature: Ceres ANNOT ID no. 6112761
  misc_feature: Encodes the peptide sequence at SEQ ID NO 10460
atgaagaggttggtgtcgaccgccctcgccacgagagggctcctgagatctcgcggagcgccgagcacaactgctgttatgtcccgaccagctttccagcagtttatgaactattcgtcaccacaaggtggtgatcctaatgctagcacaaactcaactgcagcacgaatagctgctgatcctgatacacatcaagattttgagccaaagagcagaagttcagacatgtctttgaatgacattgttgctcaggatatcaaggagaacccagtcttgatctacatgaagggttttcctgagtctccaatgtgtggcttcagcgcactggcagttaaggtcctccagcaatatggcgtccctatctgtggcagagacattcttggagatctcaagctcaaagagagtgttaaagctcacactaactggcctacatttccacaaatatttatcaaaggagagtttgttgggggatctgacatcatattaagcatgcaccagaagggtgaacttaaggatcttcttggggatattgcacaaagagctgaacaaaaagcagatgctcatgattcatga

SEQ ID NO: 10460 - protein, 190 aa, Sorghum bicolor
  misc_feature: Ceres ANNOT ID no. 6112761
  misc_feature (91)..(155): Pfam Id: Glutaredoxin Pfam Desc: Glutaredoxin
  misc_feature (1)..(184): NCBI GI: 55296797 NCBI Desc: glutaredoxin-related protein -like [oryza sativa (japonica cultivar-group)]
  misc_feature (1)..(184): NCBI GI: 115434818 NCBI Desc: os01g0174900 [oryza sativa (japonica cultivar-group)]
  misc_feature (1)..(184): NCBI GI: 122064224 NCBI Desc: montothiol glutaredoxin-s1, mitochondrial precursor
  misc_feature (1)..(183): NCBI GI: 115437210 NCBI Desc: os01g0530400 [oryza sativa (japonica cultivar-group)]
  misc_feature (1)..(183): NCBI GI: 122064226 NCBI Desc: monothiol glutaredoxin-s4 precursor
MKRLVSTALATRGLLRSRGAPSTTAVMSRPAFQQFMNYSSPQGGDPNASTNSTAARIAADPDTHQDFEPKSRSSDMSLNDIVAQDIKENPVLIYMKGFPESPMCGFSALAVKVLQQYGVPICGRDILGDLKLKESVKAHTNWPTFPQIFIKGEFVGGSDIILSMHQKGELKDLLGDIAQRAEQKADAHDS

SEQ ID NO: 10461 - DNA, 1041 bp, Sorghum bicolor
  misc_feature: Ceres ANNOT ID no. 6112762
  misc_feature: Encodes the peptide sequence at SEQ ID NO 10462
atgggtcgaagcgcctgggcggttcggttggcttcccttctcgcgtttggtttggtgctcggcaccgtcgaggccagcctcggggatgttgatcggcgctacagaacttgtgtgagggagtgtcaaactacagggattattggggagaacaacatcagccattgtcagtccaaagagaacgacgcttctgttggaggctcttggtataaccaggagcaaatttacatccagtggaaacaactgaactgtatgacagactgtcgctacttttgcatgatgcagagagaaggggaacgacagtcacttggtctgagccccgttaaatatcatggaaagtggccgttcttacgtgtttctgtgttccaggaacccctttcagctgcactatctgctgtcaacctactgatgcacttcactggctggctttcatttttccttctagtgaattacaaattgcctcttagaacccagaccaagagaacttactatgaatatactagcttgtggcatatctatgcaatcttatcagtgaatgcatggttctggagcactattttccatactcgagacattgacttgactgagaaattggactattcttctgctgtggccctgcttggctattctttaatcctttcattgctaagggctttcaatgtcaaggatgaggctaccagggtgatgtttgcagccccaattttggcattcgttacgacgcacatcttgtatcttaacttctacgagcttgactatggttggaacatgaaagtttgtgtggtgatggccgctgtacaacttctgacgtgggcagtttgggctggtgtaagccggcatccatcacgtctgaagctctggacagttgtttttggaggagcactggccatgcttcttgaactcaatgacttccctccatacatgggttatgcggacgcccattcactgtggcatgcaagcaccattccactcacctatctctggtggagcttcatcaaggacgacgccatattccgcacgtcaacgctcgtgaagaaggcaaagtaa

SEQ ID NO: 10462 - protein, 346 aa, Sorghum bicolor
  misc_feature: Ceres ANNOT ID no. 6112762
  misc_feature (70)..(342): Pfam Id: Per1 Pfam Desc: Per1-like
  misc_feature (1)..(346): NCBI GI: 82400132 NCBI Desc: per1-like family protein [solanum tuberosum]
  misc_feature (1)..(346): NCBI GI: 82621128 NCBI Desc: per1-like family protein [solanum tuberosum]
  misc_feature (13)..(346): NCBI GI: 20147283 NCBI Desc: at5g62130/mtg10_150 [arabidopsis thaliana]
  misc_feature (23)..(261): NCBI GI: 140057270 NCBI Desc: per1-like [medicago truncatula]
  misc_feature (23)..(187): NCBI GI: 92898600 NCBI Desc: per1-like [medicago truncatula]
MGRSAWAVRLASLLAFGLVLGTVEASLGDVDRRYRTCVRECQTTGIIGENNISHCQSKENDASVGGSWYNQEQIYIQWKQLNCMTDCRYFCMMQREGERQSLGLSPVKYHGKWPFLRVSVFQEPLSAALSAVNLLMHFTGWLSFFLLVNYKLPLRTQTKRTYYEYTSLWHIYAILSVNAWFWSTIFHTRDIDLTEKLDYSSAVALLGYSLILSLLRAFNVKDEATRVMFAAPILAFVTTHILYLNFYELDYGWNMKVCVVMAAVQLLTWAVWAGVSRHPSRLKLWTVVFGGALAMLLELNDFPPYMGYADAHSLWHASTIPLTYLWWSFIKDDAIFRTSTLVKKAK

SEQ ID NO: 10463 - DNA, 669 bp, Sorghum bicolor
  misc_feature: Ceres ANNOT ID no. 6112771
  misc_feature: Encodes the peptide sequence at SEQ ID NO 10464
atggcggcggcggcgcagctgcacggatcggctgcggccacggcggcatgtcgccggactcgagcctactcagttcgatcctcgtgccggtggccgcagagccttctagctggttccccgaagctttcaatttctacaagtggagtttgtacgaagccatttggctttgctgctaaattttcaaccaaatgtgccaatgagaatgctcgagttgaagagttagatttacaatcagacaaaatgaaggaattacatgtggaggagcatgttattcctcagaagaggagtgctaaaatccatgacttttgccttgggattccttttggtggtcttttattctctatggggcttctaggatacatcttctccagaagcaccataagtcttgtcttgggtattgcaccagggcttgccactctgctacttggtattctcagtctaaagttttggaggagcggcagatccagcttcctgcttatcttggcccaagcagcaatttctgctttcctggcatggaagtactctcatgcttacttcttgacaaatagactccttccttggggcttctacgcttcactgagcactgcaatgggttgtttctatgcctatgtgctacttgccggaggaaatcccccacctaagaagttggcagccattccaccacagtag

SEQ ID NO: 10464 - protein, 222 aa, Sorghum bicolor
  misc_feature: Ceres ANNOT ID no. 6112771
  misc_feature (102)..(205): Pfam Id: TMEM14 Pfam Desc: Transmembrane proteins 14C
  misc_feature (1)..(220): NCBI GI: 38344745 NCBI Desc: osjnba0089k21.3 [oryza sativa (japonica cultivar-group)]
  misc_feature (1)..(220): NCBI GI: 116310019 NCBI Desc: osigba0124n08.6 [oryza sativa (indica cultivar-group)]
  misc_feature (97)..(215): NCBI GI: 1143711 NCBI Desc: non-green plastid inner envelope membrane protein precursor
MAAAAQLHGSAAATAACRRTRAYSVRSSCRWPQSLLAGSPKLSISTSGVCTKPFGFAAKFSTKCANENARVEELDLQSDKMKELHVEEHVIPQKRSAKIHDFCLGIPFGGLLFSMGLLGYIFSRSTISLVLGIAPGLATLLLGILSLKFWRSGRSSFLLILAQAAISAFLAWKYSHAYFLTNRLLPWGFYASLSTAMGCFYAYVLLAGGNPPPKKLAAIPPQ

SEQ ID NO: 10465 - DNA, 1383 bp, Sorghum bicolor
  misc_feature: Ceres ANNOT ID no. 6112773
  misc_feature: Encodes the peptide sequence at SEQ ID NO 10466
atggcggtgcacgactcgctcgaggtgctcgacggccgctgcgacgacgacgacgacggccacccgcgccggactgggaccgcgtggacgtgcgcggcgcacatcatcacggcggtgatcggctccggggtgctgtcgctggcctggagcgtggcgcagctgggctgggtggtcggcccggcctgcttgttctgcttcgcgctcgtcacctacgtctccgcggcgctgctcgccgactgctaccggcgcggcgaccccgagaaggggccaaggaaccgctcctacttggacgccgtccgcgtctacctcggcaagaagcatacctgggcttgcggctcgctgcagttcgtgagcctgtacggctgcggcgtcgcctatatcatcaccaccgccactagcataagggcgattctgaaggcgaactgctaccacaagcatgggcacgacgcgcactgcgactacggtggcagctactacatgctcgtcttcggcgccgcccagctcctcctctccttcataccggacttccacgacatggcgtggctctccgtcgtcgcggcggtcatgtcgttctcgtacgccttcatcggctttggcctcggcctcgcaacaaccattgctaacgggacgatcaaaggaagcataacaggtgttcagatgaggacgcctatgcagaaggtttggcgcgtctcgcaggccatcggcgacattgccttcgcgtacccctactccttgatcctcctggaaatacaggacaccctcaagtcaccaccagccgagaacaagacgatgaagagggcatccatgatctcgatccttgtcaccacattcttctacctttgctgcggctgcttcggctacgccgcctttgggagcgacgcgccgggcaacctcctcaccggcttcggcttctatgagccctactggctcatcgacttcgccaacgcctgcatcatcctccacctgctgggcgggtaccaggtgtacagccagccgatcttccagttcgcggaccggttcttcgcggagcggttcccggacagcgggttcgtgaacgacttccacaccgtccggttggggtgcctgccggcgtgccgggtgaacctgctgcgcgtgtgcttccggacgctgtacgtggcgtccacgacggcggtggccgtggcgttcccctacttcaacgaggtgctggcgctgctgggcgcgctcaacttctggccgctggccatctacttccccgtggagatgtacttcatccagcggaacgtgccccggtggtccgcccgctgggtcgtcctgcagaccttcagcgtcgtctgcctcctcgtcagcgccttcgcgctcgtcggctccatcgaggggctaatcacccagaagctaggctag

SEQ ID NO: 10466 - protein, 460 aa, Sorghum bicolor
  misc_feature: Ceres ANNOT ID no. 6112773
  misc_feature (24)..(456): Pfam Id: Aa_trans Pfam Desc: Transmembrane amino acid transporter protein
  misc_feature (24)..(460): NCBI GI: 38344748 NCBI Desc: osjnba0089k21.6 [oryza sativa (japonica cultivar-group)]
  misc_feature (24)..(460): NCBI GI: 116310022 NCBI Desc: osigba0124n08.9 [oryza sativa (indica cultivar-group)]
  misc_feature (23)..(458): NCBI GI: 115448373 NCBI Desc: os02g0722400 [oryza sativa (japonica cultivar-group)]
  misc_feature (19)..(460): NCBI GI: 10176848 NCBI Desc: amino acid transporter [arabidopsis thaliana]
  misc_feature (17)..(455): NCBI GI: 3293031 NCBI Desc: amino acid carrier [ricinus communis]
  misc_feature: The sequence is a functional homolog of SEQ ID NO. 313 in the 11/188,298 US application
  misc_feature: The sequence is a functional homolog of SEQ ID NO. 438 in the 11/188,298 US application
MAVHDSLEVLDGRCDDDDDGHPRRTGTAWTCAAHIITAVIGSGVLSLAWSVAQLGWVVGPACLFCFALVTYVSAALLADCYRRGDPEKGPRNRSYLDAVRVYLGKKHTWACGSLQFVSLYGCGVAYIITTATSIRAILKANCYHKHGHDAHCDYGGSYYMLVFGAAQLLLSFIPDFHDMAWLSVVAAVMSFSYAFIGFGLGLATTIANGTIKGSITGVQMRTPMQKVWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQFADRFFAERFPDSGFVNDFHTVRLGCLPACRVNLLRVCFRTLYVASTTAVAVAFPYFNEVLALLGALNFWPLAIYFPVEMYFIQRNVPRWSARWVVLQTFSVVCLLVSAFALVGSIEGLITQKLG

SEQ ID NO: 10467 - DNA, 2205 bp, Sorghum bicolor
  misc_feature: Ceres ANNOT ID no. 6112779
  misc_feature: Encodes the peptide sequence at SEQ ID NO 10468
atggagtggaaggatcctaaaccaggcccagaatccttgatgggcttccaaaccagaggtgttcgaccagacaccgtaggggggcacagcaacgaggacgctaaacccggatttgagaagcatggcttctcagtcgacataagctcgcctcaggaggaaggtcggtcacttccactcaccccgcagtttggccagaagaccagtcctggcagcagcctcgccgagaggatgcaggcaagagctggattcaaggtgccgaagctcaacatgcctttcagcacagcagctggagctgataattcagtaccaggagccccatcgccctacctcacgatcccgcctggcttgagcccagcaacgctgctcgagtcaccagtcttcgtttctaatgccatgggccaaccctcgccaaccacggggaagctattcatgtctggtagcacaaatgacaatgatcctattagatttggaggtcctccagttggagatggccctgatgctttttctttcaagcccttagatctgaaatcctcacactacactgctgaagcaatgaaggaacaaaatacgcaggtttctgtcaagactaaaactaagactcagccagtacaagaagctaatttgctgggccaactgaaccagcagaatcacaatgtgcagaccaatatgaacatcggcggtcctcatgactccaagctcagccgtcttgcatctggcaccggtgcctgcaacgaacacgtatcacccccggattacggccagacagctgaggaaggtggtgatgcgagggaagactacccgccggcaatggccgccgctacagcgccagcagaggacgggtacagctggaggaagtacgggcagaagcaggtgaagcacagcgagtacccgcggagctacttcaagtgcacgcatcccaactgccaggtgaagaagaaggtggagcgctcgcacgaggggcacatcacggagatcatctacaagggcgcgcacaaccacccgaagcccacgccgagccgccggccaggcgtccaggtccagcccgtgcacccgtttggcgacgccggcggtgcgcagcaggcggacgccgcggccgacaacaacctggggtcacagtcacagcaggcaaacgctgcagcggaagccaaccaccagccgtggcgtgcgggcgttcaggatggcatggacgccgcgacgtcgtcgccctcggttcccggtgagctctgtgactcgtcggcgtcgatgcagcaggtcgagtacgcaccccgagggtttgggtcccccgagggcgcggatgtgacgtctgctccgtctgacgaggtggacggcggcgacagggtgactcttggcagcatgtcccacgccggtgccgacgcggagggcgacgaactggaatctaaacgaaggaaggtggaggcatatgccatggatatgagcactgcgtcgagagctattcgcgagcctcgcgtggtgatccagacgacgagcgaggtggacatcctcgacgacggctaccgctggcgcaagtacgggcagaaggtcgtcaagggcaacccgaatccaaggagctactacaagtgcacgcacccggggtgcacggtgcggaagcacgtggagcgcgcgtcgcacgacctcaagtccgtgatcaccacgtacgagggcaagcacaaccacgaggtccccgcggcgaggaacagcggcggccacccgagcaccgcggcggcggcgacaggcgcgggtggtggtggtccgcggaggccggagcacacgtcgtcggtgcacgacggcctgatgatgaggcacctgggcggctgcggcgtgccgttcggcctgccgctgcagccgcctagcagggacccgctggcgccgatgggcaactacccgacgtacccgttcactgccctcggcggcggcggtggcagcggcggcgacggcggcctcacgtcgctgccgagcttgccgatggccacggggaacctcagcgccgtggaggggctgaagctcccgatgctggcaacctcgtcgcccctgcaccaccagcacccgctgctgaggcaccggcaggcgatgcaggccgccgccctcgccgcggcgcccatggcgcaagtgaaggtcgaagacaacgtcgccgccggcgttaccgctgccccgtcggtgtaccagcagatggtgcgcagcgggctgcggctgggccaccagatgtag

SEQ ID NO: 10468 - protein, 734 aa, Sorghum bicolor
  misc_feature: Ceres ANNOT ID no. 6112779
  misc_feature (277)..(335): Pfam Id: WRKY Pfam Desc: WRKY DNA -binding domain
  misc_feature (501)..(560): Pfam Id: WRKY Pfam Desc: WRKY DNA -binding domain
  misc_feature (2)..(734): NCBI GI: 116310204 NCBI Desc: h0418a01.8 [oryza sativa (indica cultivar-group)]
  misc_feature (2)..(734): NCBI GI: 33519174 NCBI Desc: wrky2 [oryza sativa (japonica cultivar-group)]
  misc_feature (2)..(734): NCBI GI: 38344754 NCBI Desc: osjnba0089k21.12 [oryza sativa (japonica cultivar-group)]
  misc_feature (2)..(523): NCBI GI: 33519190 NCBI Desc: wrky10 [oryza sativa (japonica cultivar-group)]
  misc_feature (2)..(577): NCBI GI: 14530687 NCBI Desc: wrky dna-binding protein [nicotiana tabacum]
  misc_feature: The sequence is a functional homolog of SEQ ID NO 1269 in the 11/479,226US patent application
  misc_feature: The sequence is a functional homolog of SEQ ID NO 1362 in the 10/666,642US patent application
  misc_feature: The sequence is a functional homolog of SEQ ID NO 138 in the 10/412,699US patent application
  misc_feature: The sequence is a functional homolog of SEQ ID NO 1388 in the 10/412,699US patent application
  misc_feature: The sequence is a functional homolog of SEQ ID NO 1389 in the 10/412,699US patent application
  misc_feature: The sequence is a functional homolog of SEQ ID NO 1390 in the 10/412,699US patent application
  misc_feature: The sequence is a functional homolog of SEQ ID NO 1736 in the 10/412,699US patent application
  misc_feature: The sequence is a functional homolog of SEQ ID NO 174 in the 10/374,780US patent application
  misc_feature: The sequence is a functional homolog of SEQ ID NO 199 in the 11/479,226US patent application
  misc_feature: The sequence is a functional homolog of SEQ ID NO 20 in the 10/374,780US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 224 in the 10/714,887US patent application
  misc_feature: The sequence is a functional homolog of SEQ ID NO 224 in the 11/435,388US patent application
  misc_feature: The sequence is a functional homolog of SEQ ID NO 236 in the 10/225,066US patent application
  misc_feature: The sequence is a functional homolog of SEQ ID NO 24 in the 10/374,780US patent application
  misc_feature: The sequence is a functional homolog of SEQ ID NO 268 in the 10/714,887US patent application
  misc_feature: The sequence is a functional homolog of SEQ ID NO 268 in the 11/435,388US patent application
  misc_feature: The sequence is a functional homolog of SEQ ID NO 34 in the 10/666,642US patent application
  misc_feature: The sequence is a functional homolog of SEQ ID NO 474 in the 11/435,388US patent application
  misc_feature: The sequence is a functional homolog of SEQ ID NO 50 in the 10/225,066US patent application
  misc_feature: The sequence is a functional homolog of SEQ ID NO 512 in the 10/374,780US patent application
  misc_feature: The sequence is a functional homolog of SEQ ID NO 513 in the 10/374,780US patent application
  misc_feature: The sequence is a functional homolog of SEQ ID NO 514 in the 10/374,780US patent application
  misc_feature: The sequence is a functional homolog of SEQ ID NO 515 in the 10/374,780US patent application
  misc_feature: The sequence is a functional homolog of SEQ ID NO 56 in the 10/666,642US patent application
  misc_feature: The sequence is a functional homolog of SEQ ID NO 58 in the 10/412,699US patent application
  misc_feature: The sequence is a functional homolog of SEQ ID NO 584 in the 10/412,699US patent application
  misc_feature: The sequence is a functional homolog of SEQ ID NO 70 in the 10/225,068US patent application
  misc_feature: Useful for making plants with modulated growth and phenotype characteristics
  misc_feature: The sequence is a functional homolog of SEQ ID NO 138 in the 20040045049 US patent application
  misc_feature: The sequence is a functional homolog of SEQ ID NO 138 in the 20040045049 US patent application
  misc_feature: The sequence is a functional homolog of SEQ ID NO 1388 in the 20040045049 US patent application
  misc_feature: The sequence is a functional homolog of SEQ ID NO 1389 in the 20040045049 US patent application
  misc_feature: The sequence is a functional homolog of SEQ ID NO 1390 in the 20040045049 US patent application
  misc_feature: The sequence is a functional homolog of SEQ ID NO 1736 in the 20040045049 US patent application
  misc_feature: The sequence is a functional homolog of SEQ ID NO 58 in the 20040045049 US patent application
  misc_feature: The sequence is a functional homolog of SEQ ID NO 584 in the 20040045049 US patent application
  misc_feature: The sequence is a functional homolog of SEQ ID NO 236 in the 20050160493 US patent application
  misc_feature: The sequence is a functional homolog of SEQ ID NO 204 in the 20060015972 US patent application
  misc_feature: The sequence is a functional homolog of SEQ ID NO 515 in the 20060162006 US patent application
  misc_feature: The sequence is a functional homolog of SEQ ID NO 86 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MEWKDPKPGPESLMGFQTRGVRPDTVGGHSNEDAKPGFEKHGFSVDISSPQEEGRSLPLTPQFGQKTSPGSSLAERMQARAGFKVPKLNMPFSTAAGADNSVPGAPSPYLTIPPGLSPATLLESPVFVSNAMGQPSPTTGKLFMSGSTNDNDPIRFGGPPVGDGPDAFSFKPLDLKSSHYTAEAMKEQNTQVSVKTKTKTQPVQEANLLGQLNQQNHNVQTNMNIGGPHDSKLSRLASGTGACNEHVSPPDYGQTAEEGGDAREDYPPAMAAATAPAEDGYSWRKYGQKQVKHSEYPRSYFKCTHPNCQVKKKVERSHEGHITEIIYKGAHNHPKPTPSRRPGVQVQPVHPFGDAGGAQQADAAADNNLGSQSQQANAAAEANHQPWRAGVQDGMDAATSSPSVPGELCDSSASMQQVEYAPRGFGSPEGADVTSAPSDEVDGGDRVTLGSMSHAGADAEGDELESKRRKVEAYAMDMSTASRAIREPRVVIQTTSEVDILDDGYRWRKYGQKVVKGNPNPRSYYKCTHPGCTVRKHVERASHDLKSVITTYEGKHNHEVPAARNSGGHPSTAAAATGAGGGGPRRPEHTSSVHDGLMMRHLGGCGVPFGLPLQPPSRDPLAPMGNYPTYPFTALGGGGGSGGDGGLTSLPSLPMATGNLSAVEGLKLPMLATSSPLHHQHPLLRHRQAMQAAALAAAPMAQVKVEDNVAAGVTAAPSVYQQMVRSGLRLGHQM

SEQ ID NO: 10469 - DNA, 2250 bp, Sorghum bicolor
  misc_feature: Ceres ANNOT ID no. 6112783
  misc_feature: Encodes the peptide sequence at SEQ ID NO 10470
atgaggaggagcggccgtgcctgctccgttcttgcgtcgctcctgctgctgctgtggctgggcgtcgccgccgcgcagaaggcctcgtcttggaagacattgagcggcaaggctccagcaatcgtagccaagggtggattttccgggctattccccgattcaagcgaatatgcttatcaatttgctctggtcgctagctcgccggatacaatactgtactgcgatgtgcggctgaccaaggatgagattggcatttgcctgccggacatcaggatggataactgcacaaacattccagatttctatgcgcagggtcagaagagctacctcgtcaatggtgtgcctacctcgggatggttctcggtggactacaatggcactgagcttggacaagtaactctcaagcagtcaatcaattctcggacgcccagatttgattcaagtttctttgcgctacttgctgttgaagatgtgcagtccaagttcaaacctccaggaatttggctcaatgttcagcatgacagtttctacagccagttcaatctaagcatgaggaattatatcatttctgtatctaagcgtgttgttgccaattatatctcatcacctgaagtgagcttcctcaccagcatacttggaagaattagcaacaaaacaaagcttgtgttccgctttcttgatgagagcactctcgagccatctatgaaccagacatatggctccatgatgaaaaatcttacatttgttaagacatttgcatctgggatacttgtcccaaagagttatatttggcctaattcaccagacaattatctgcaaccatacacttcagttgttgatgatgctcataaagcaggcttggaaatctatgctgctgattttgcaaatgattttctgctcagttacaaccacagctatgatcccttagcagaatatctctcattcattgataatgatgtcttctcagttgatggtgtattgactgatttccctgtcacagcatcagaggcaattggatgttttaccaatttaaacaaaagcaacactgatcatggaaagcctttaattatatcacacaatggtgctagtggggattacccagggtgcactgatctagcttatcaaaaagcagttgatgatggtgcagatgtcattgattgccctgttcaagtgaccaaagatggaataccaatatgcttgtcttccattgacctaatgaccgatactactattgcaagatcgcaattcatctctcagactgccacgataaaggatattcagattgcaccaggggtttttagtttcaacctcacctgggatgacattgtaaagaacctgaaacccaaaatatccaccccatggaccaacttcaaattggaccgaaatccgagatataggaatgcaggaaagttcgtgaggctatcagactttttggagttcacaaaagataaagatttgtctggaatcatgatcagtgtagagcatgctgccttcctggcaggggaacttgggtttgacatggtcgacaaagttatcaaagccctcgacgatgctggttaccatgaacaaactgcccagaaagttatgattcagtcagccgatagttcagttctagagaagttcaaggagcaaacaaagtatgaccttgtgtacatgatcaacaaagaagtcggggacgctgcaccttcctcgctcgcggacattaaaaagtttgctagtgccgtttccgttgatactagctctgtcttccctgaaacccactacttcacagtgtatgaaaccaatcttgtccagacactgcagtcggcaggcctctcggtctacgtttatactcttatgaacgagtttccgtctcagccatacgacttcttctcagatgctacagcgcagattaatgcctatgtcaagggtgctctcgtggatgggctaatcacggatttccctgctacagctcgaagatacaaggtgaacagttgcatgaacatggggaacaatacgccgaatttcatggcccctgttcatcccggtgatctcatgcaaagcattagcaggagtgcgcagccaccagcattggctcccattccgcccttgaccgagtccgatgtggcacagccgcctttgcctcctgccagatcaaacagcagtacagttccgacgcaatcacccgcgagcaggacgcatgcctgtgctgctcacatcccagtccttgtcacactggcaatactttgcacttggcgttccctggtctga

SEQ ID NO: 10470 - protein, 749 aa, Sorghum bicolor
  misc_feature: Ceres ANNOT ID no. 6112783
  misc_feature (359)..(650): Pfam Id: GDPD Pfam Desc: Glycerophosphoryl diester phosphodiesterase family
  misc_feature (3)..(749): NCBI GI: 38344811 NCBI Desc: osjnbb0022f23.4 [oryza sativa (japonica cultivar-group)]
  misc_feature (3)..(749): NCBI GI: 116310266 NCBI Desc: b0806h07.1 [oryza sativa (indica cultivar-group)]
  misc_feature (8)..(749): NCBI GI: 18416801 NCBI Desc: glycerophosphoryl diester phosphodiesterase family protein [arabidopsis thaliana]
  misc_feature (8)..(746): NCBI GI: 15219803 NCBI Desc: protein kinase family protein / glycerophosphoryl diester phosphodiesterase family protein [arabidopsis thaliana]
  misc_feature (133)..(524): NCBI GI: 50252308 NCBI Desc: glycerophosphoryl diester phosphodiesterase 2 precursor-like [oryza sativa (japonica cultivar-group)]
MRRSGRACSVLASLLLLLWLGVAAAQKASSWKTLSGKAPAIVAKGGFSGLFPDSSEYAYQFALVASSPDTILYCDVRLTKDEIGICLPDIRMDNCTNIPDFYAQGQKSYLVNGVPTSGWFSVDYNGTELGQVTLKQSINSRTPRFDSSFFALLAVEDVQSKFKPPGIWLNVQHDSFYSQFNLSMRNYIISVSKRVVANYISSPEVSFLTSILGRISNKTKLVFRFLDESTLEPSMNQTYGSMMKNLTFVKTFASGILVPKSYIWPNSPDNYLQPYTSVVDDAHKAGLEIYAADFANDFLLSYNHSYDPLAEYLSFIDNDVFSVDGVLTDFPVTASEAIGCFTNLNKSNTDHGKPLIISHNGASGDYPGCTDLAYQKAVDDGADVIDCPVQVTKDGIPICLSSIDLMTDTTIARSQFISQTATIKDIQIAPGVFSFNLTWDDIVKNLKPKISTPWTNFKLDRNPRYRNAGKFVRLSDFLEFTKDKDLSGIMISVEHAAFLAGELGFDMVDKVIKALDDAGYHEQTAQKVMIQSADSSVLEKFKEQTKYDLVYMINKEVGDAAPSSLADIKKFASAVSVDTSSVFPETHYFTVYETNLVQTLQSAGLSVYVYTLMNEFPSQPYDFFSDATAQINAYVKGALVDGLITDFPATARRYKVNSCMNMGNNTPNFMAPVHPGDLMQSISRSAQPPALAPIPPLTESDVAQPPLPPARSNSSTVPTQSPASRTHACAAHIPVLVTLAILCTWRSLV

SEQ ID NO: 10471 - DNA, 660 bp, Sorghum bicolor
  misc_feature: Ceres ANNOT ID no. 6112795
  misc_feature: Encodes the peptide sequence at SEQ ID NO 10472
atggcgccgtcgtctaagctgtcgcagggcatcaagaaggcctcgcggtcccacgcgtaccaccgccgcggtctgtgggcgatcaaggctaagcacggcggcgccttccccaaggccgagaagcccgccgcggtcgccgagcccaagttttaccccgccgatgacgtgaagccgcgcaagcccagcacccggaagccgaagcccaccaagcttaggtcctcaatcactcccggcaccgtgctgattctgctcgccgggaggttcatggggaagagagtcgttttcctcaagcagctcaaatctggcctgctccttgttactggacctttcaagatcaatggagtcccaatccgccgtgtgaatcagacctacaccattgcaacgtccacaaaggttgatatctctggtgttaacgtagagaagtttgatgacaagtactttgcaagggagaagaagaagaaggcaaccaagactgagggtgaactttttgagacagagaaggagtcaaccaaggacctgcctcagttcaagaaggatgaccagaaggcggtggacaccgagttgatcaaagctattgatgctgtgccagatctgaaaacctacctcggtgcgcggttctctctcagggatggcgacaagcctcatgagatggttttctag

SEQ ID NO: 10472 - protein, 219 aa, Sorghum bicolor
  misc_feature: Ceres ANNOT ID no. 6112795
  misc_feature (112)..(219): Pfam Id: Ribosomal_L6e Pfam Desc: Ribosomal protein L6e
  misc_feature (1)..(49): Pfam Id: Ribosomal_L6e_N Pfam Desc: Ribosomal protein L6, N-terminal domain
  misc_feature (1)..(219): NCBI GI: 38344818 NCBI Desc: osjnbb0022f23.11 [oryza sativa (japonica cultivar-group)]
  misc_feature (1)..(219): NCBI GI: 115458930 NCBI Desc: os04g0473400 [oryza sativa (japonica cultivar-group)]
  misc_feature (1)..(219): NCBI GI: 116310429 NCBI Desc: h0305e08.7 [oryza sativa (indica cultivar-group)]
  misc_feature (1)..(219): NCBI GI: 57471700 NCBI Desc: ribosomal protein l6 [triticum aestivum]
  misc_feature (6)..(219): NCBI GI: 92888438 NCBI Desc: ribosomal protein l6e; ribosomal protein l6, n-terminal [medicago truncatula]
  misc_feature: Useful for making plants with modulated nitrogen use efficiency
  misc_feature: Functional homolog of the protein sequence given in SEQ ID NO 13136
  misc_feature: Useful for making plants with modulated nitrogen use efficiency
  misc_feature: Functional homolog of the protein sequence given in SEQ ID NO 13136
MAPSSKLSQGIKKASRSHAYHRRGLWAIKAKHGGAFPKAEKPAAVAEPKFYPADDVKPRKPSTRKPKPTKLRSSITPGTVLILLAGRFMGKRVVFLKQLKSGLLLVTGPFKINGVPIRRVNQTYTIATSTKVDISGVNVEKFDDKYFAREKKKKATKTEGELFETEKESTKDLPQFKKDDQKAVDTELIKAIDAVPDLKTYLGARFSLRDGDKPHEMVF

SEQ ID NO: 10473 - DNA, 7116 bp, Sorghum bicolor
  misc_feature: Ceres ANNOT ID no. 6112798
  misc_feature: Encodes the peptide sequence at SEQ ID NO 10474
atggatctgggaaaatcaatagacgataaattcagcaagttgcatccaagtttgccagtagacaccagaattgtcatagttggagcagggccaagcggcttatcagcagcatatgcactagctaagctaggatatcacaatgtaactgtgtttgagaaatgccatcatgtttcagggatgtgcgagtccattgatattgaggaaatggatacacacaagcttgctctgattgatagccaaacaggaaacattagagatcttgaagttgctgaggactatgtatccatggatgaggcaaataggtctggacgagtgggaattcatgcagttagtggattggcttcagatccaactcttgactttttgaagcagcatggaataagttcaatgccaaaatctgtagtatatggttacactgcttctggctatggttttgttcaagacatgccctatgctttcatacatgagtttactagaacctctatggctggcaagatccgacgtttcaagcatggatacatgagcttgtgggagaaacttagtcggtcgttaccatttgaagttctttgtggcacggaggttctcagagtcaagcgtgacaactgtgttgcaagtgtaactttcaagaatagcaatggtgatgtagaagttagggagtttgataaaattatattgtcaggtgctcttcctttcaagaatgggaaaacatatcgctctttgagtatgactgatggagaaaatgaagtggtggaactgaatgatcttgaaagagagctattcagtaaggtacggacgattgactactatacaactgttgttaagattgaaggatttgagcacatgccaaagggctttttctactttggggaatacatggaggatccaacaacagtagggcatccagtggcaatgcaaagattctttgctgacacaaatattttcttgttctggtcttacgggaattcagcagacatcaaggagccatatgtggctaaatgtgtaaccgatgttgtgacatctatgggaggaactgtgcagaaagtgcttttacagcggcgattcaaatatttccctcatgtcagcagtgaagacatgaaaaatggattctacgagaaggtggagtctcagttgcaaggctttcagaacacttactttgttggaggtctgctagcgtttgagctaactgaaagaaatgtgttatactccatctcagctgtttgtaaacactttgccattgccagtgagctaccaatgattccttatgttaagagactttttcctctatccaaaggaaatccttcacctcctagagatattggtgagcttgaaggagttgaattcccccatcttccatccctggatggatatttacaatattggggaactcatagagtcactgcagagaagtttatctacacttggatcaatgaaaaagggaagatcgtgaatcgtagaacctaccaggagcttcatgataatgcatcttacattgcgtataggctattgacaagcacaaagcctattatcaagcctggtgacagagttctccttattcatctacctggtttggagtttgttgatgcattctttggatgcatcagagcaggagttataccagtcccagttttgccccctgacccaatgcaaaggggtgggcaagcgcttctgaaagttgagaatgtctctaaggtgtgcaatgctgtggcaattctatccacctcttcataccatgctgctgtacgtgcaggctatatcaagaatattgtcactctagcacagagtgctcagaaatgctcagctcagtggcctgacctcccatggattcacactgactcatggattaagaactatcgacgaagtccaggcagcttcaactcagaaagtgttgtgcctatgattaccaagacccagccaagtgagttgtgctttctacaattcacttcaggttccactggtgacgccaagggtgtgatgataacacatagtggactaatccacaatgtgaagatgatgaagaagcgatatagaagtacttcaaaaactgtccttatcagttggcttccacagtaccatgacatgggtctaatagggggtcttttcactactctagtaagtggaggaacttccattctattttcaccaatgacatttatcagaaaccccctcctatggctcgaaacaataagtgactaccatggaacacacagtgcagggccaaactttgcatttgaattggttataagacggcttgaggctgagaaaaacaaaacgtatgacctctcttcaatgatcttcctcatgattgccgcagagccagtgaggcaaaaaactgtcaaaaggttcatagagttgactcaacctttgggcttttctgaaggtgtacttgctcctggatacggcctggctgagaattgtgtctatgtttgctgtgcttttggtgaatgcaagcccatttctatagactggcagggaagaatttgttgtgggtatgttgatccaaatgatacagatgttgttatcaaaattgttgatccagactctttgacagaacatcaagaggatggtgctgagggtgagatatggatcagcagttctagttctggagttggttattggaacaataaggaaacaagccagagaaccttttgcaattggctcaagaattaccctaacataaagtttacaagaactggtgatttaggacggatcattgatggtaaactttttattacaggaaggatcaaagatcttatcattgttgctggtagaaatatttattctgcagatgtagagaagacagtggaaggttcttctgatgttcttcgaccaggctgttgtgctgttgttggtgttcctgaggaagttttaacccagaaaggcatctcaatccctgattcttctgatcaggttggacttgtcgtgatcgctgaggttagggatggtaaagtagtctctgaaaatatcgcagacagcataagaacacgtgtagcagaggagcatggtgtaactattgcatctgtcaagcttatcaagcctagaaccatatccaagacaacatctgggaaaatacggagatttgaatgcatgaagcaatttgttgataatactcttagcttggcaagtggtaatcatatatctaaaaagaagtctctttttcggtctctcactacaggaactggcatggaaatcaagagacctttcctgaagcacactgttgattctaccattcaccctcagcctagaagcaaagtgaaaaatttcatggagattgttgggtttttaatgcagttagtatctgatcaaacaggtatttcaaaggataaaatttccccaaatgacagcctaccttcttatggctttgactcgattgcagtggtccgagcagcacaaaagctctcagattttcttggtacacctgttggagcaattgacatctttactgcgagcagcatttcggagcttgctaactccttggagaatctggtgcttaagtcacaaccacagctggcacctcagcctagatgcaaagtgaaaagatccagtgagattattgagtttctaacacagatagtatcagatcaagcaggcattccaaaggacaaaatttctccaactgatagtctaccttcttatggttttgattcaattgcagtggtccgaactgcccagaagctctcagattttcttggtattcctgttggagccattgacatttttacggcaagctgtattgctgagcttgggagcttcttggagaatttggcacgcaagtcacaaccacagttagaacctgatgtatctcactccgctgaagatgagaatctagttatcacagatgccactagttttgatcttagcgtgtttgctactgggaccctccagctcctggctcttacttatgtctgttttatcctgttactcccagcatatctcgcaagctcgatgtacatgagcatgatatcttcagtcagtctggtgaaatcatcactactgagctatcttagttctttggtcttggcacctattgcatggatctgctatgccttgttcacttcattatctctatctaccttggggaagccattccttcagccaaattatgttttaacccctgatatttcgatatggtcagttgactttgtgaaatggtgggcactaaacaaggcacaatcattagcagcaaagatgctagctgtgcatctaaagggcacagtcttcttgaattattggttcaagatgcaaggagctcggattggttcagatgttgtcattgatacggtagacatcactgacccatccttactagcagtcgcggatagtgcagtgatcgcagaaggtgttctcattcagagccatgaagtccgtaatgaagtgctgagtttcaggcatatcaagattggtcagaaggcatcaattggcccttatgcggtgatccagaagggaactattgtgcatggtggcgttgtcattccaccattgcaaaagactgagcaagggaaatcagcatatcctcctagcggagcttctgcatacatgaaggacgaagcagggacagcaaacatggcatttgaacacctctttagcatctatgcagttggcttcttgggtgctttgtcaggtgcaacagtcttcatgttgtacacccacttttcaggcaccactgcttcgcttcagcacttctcctttgcatgtgttgctggtgccttccattggttgccagctgtcattgctgcttatgctgtgattgtccgggagacaaccaagagcccggtggaatttgctctcttcattgccttcgcctacttaagttatgggatcatcgttagtcttctcaccagtgtcgccaacaaagctcttgctacaaggtcagggaccaagaagaaggatatggcaagtttgatccagcagcgcataaccatcgctgcacacctcagatttgcaaagatgatatccggcacagaagccttctgcatgtacttgaggcttcttggtgcaaagattggcaggcattgctctatccgagccatcaatccagtggcaaatcctcagctgatcagcattggtgatggggtccatctaggtgatttctgcaatattgttccagggttctactcaaaggggtttaccagtgcagagataaaggtccaggacaacactgtggttggcagtggcagcttgctccttcctggctctgtcctccaagagaatgtcatcctgggagcactatctgttgctccgcagggttcgattctccttcaaggtggcgtctatgtcggggcgcagtctctgaccttggtgaagaacaccttgctcacagaagatgaacggattgcagagatggacccgatgtataagaagattgttgggaaccttgcggcgaacctggccatcactaccatgaacgtcaagtcaagatacttccaccgcattggcgtcagcgggcggggggtcctgaggatgtaccaagatataccttcgctgcccaagcacaagatatttggcgccggcaagtctttcccggtgattgtccggcacagcaacagcctcagcgcagatgacgacgcaaggctcgacgctcgtggcgcatcagtgcggatcctctcggatgacggcgaggtgcctcttcttgacctcacactgaagagcggcaacgcgttttacgcgcgcacaatcgccgacttcgccacctggcttgtctgtggcctgccggcgagggaagagcaagtgaagcgtgcaccgcacatccgtgacgccgtctggggctcgttgcggaacaccgactcgtacaccatgctccattactactcaaacatatgccggctgctgcggttcgaggacggcaggcagatgtatgcaaagttcaagcttcgtcctgcggaccaaggcatctcggaggactccggccaagtggtgccgcgtggcatcctgccgccggaaactggtgcgatcccgagggacgagggtgacacacgcccgctgctgttcctcgctgacgacttccgccggaaggtggagtctcccgagggggtgcgctatgtcttccagctgcagctcagggatgtccctgctgacagcgccactcgcgacatcgctctagactgcacacggccttgggacgaggccgagttcccgtacatcgaagtcggagagataagcattggcagcaatctcccagcagaggagacggagaagctggagttcaacccgttcctgcggtgccaagaggtggacgtgatctcggcgacgtcctgcaagcagagcgcgtccatagaccatggacgctcgctggtctacgagatctgccagcgcgtgcgaaatggcgagccgctgccggcctcatggcgagcgttcctcgagcagtcagacaccaagatcgacttgtcaggctgtccggtcatcgcggtgacgcgctcaagctcggacgtccgtcaagccaccaaggtgacgctggctcggacatggtaccaggcgctctgggccacgctgtgccagccactgctgcagacactcgtgccgtacttcgtcgtgggcctggtcatcttcctccccctccgtggcctcctcgccgccatggccaccggcatgccactctactgggctctgcccatcttctgggccacgtcaggcgtcgccgcgatgggtgcctgtgcggcagcaaagtggaccctggtcggcaggcgggccgacggagacacggtgcacatctgggcgccgcctgtgttcctggacacggtctggcaggccgtgcgcacggtgaccgcggagtacttcgcggagctgacgcctgggtccgtgctgttcgctgggtggatgcgggcgatgggcgcgtctgtggccgtgtccgatggcgtgtacgtggactccatgggcgcgctgctgaacccggagatggtgcacctggagcgcggcgcaagcgtggggcgggacgcgctgctgttcggccacatatacgagggcgagggcggggaggtgaagtttggcagggtccatgtgggcgaggacgggttcgtcggcagccgcgcggtggccatgccgggcgtcagggtcgatgacggtggctgcctcggtgccctgcggttggccatgaaggaggagatcgtgatgaacaggatgtag

SEQ ID NO: 10474 - protein, 2371 aa, Sorghum bicolor
  misc_feature: Ceres ANNOT ID no. 6112798
  misc_feature (486)..(945): Pfam Id: AMP-binding Pfam Desc: AMP-binding enzyme
  misc_feature (1092)..(1158): Pfam Id: PP-binding Pfam Desc: Phosphopantetheine attachment site
  misc_feature (1185)..(1251): Pfam Id: PP-binding Pfam Desc: Phosphopantetheine attachment site
  misc_feature (1772)..(2144): Pfam Id: Catalase Pfam Desc: Catalase
  misc_feature (1)..(2371): NCBI GI: 116309764 NCBI Desc: osigba0135c13.1 [oryza sativa (indica cultivar-group)]
  misc_feature (56)..(1190): NCBI GI: 92881007 NCBI Desc: nad-binding site; serine/threonine dehydratase, pyridoxal-phosphate-binding site; amp-dependent synthetase and ligase [medicago truncatula]
  misc_feature (627)..(1166): NCBI GI: 23129358 NCBI Desc: cog1020: non-ribosomal peptide synthetase modules and related proteins [nostoc punctiforme pcc 73102]
  misc_feature (575)..(1035): NCBI GI: 126660196 NCBI Desc: beta-ketoacyl synthase [cyanothece sp. ccy0110]
  misc_feature (605)..(1158): NCBI GI: 75910307 NCBI Desc: beta-ketoacyl synthase [anabaena variabilis atcc 29413]
MDLGKSIDDKFSKLHPSLPVDTRIVIVGAGPSGLSAAYALAKLGYHNVTVFEKCHHVSGMCESIDIEEMDTHKLALIDSQTGNIRDLEVAEDYVSMDEANRSGRVGIHAVSGLASDPTLDFLKQHGISSMPKSVVYGYTASGYGFVQDMPYAFIHEFTRTSMAGKIRRFKHGYMSLWEKLSRSLPFEVLCGTEVLRVKRDNCVASVTFKNSNGDVEVREFDKIILSGALPFKNGKTYRSLSMTDGENEVVELNDLERELFSKVRTIDYYTTVVKIEGFEHMPKGFFYFGEYMEDPTTVGHPVAMQRFFADTNIFLFWSYGNSADIKEPYVAKCVTDVVTSMGGTVQKVLLQRRFKYFPHVSSEDMKNGFYEKVESQLQGFQNTYFVGGLLAFELTERNVLYSISAVCKHFAIASELPMIPYVKRLFPLSKGNPSPPRDIGELEGVEFPHLPSLDGYLQYWGTHRVTAEKFIYTWINEKGKIVNRRTYQELHDNASYIAYRLLTSTKPIIKPGDRVLLIHLPGLEFVDAFFGCIRAGVIPVPVLPPDPMQRGGQALLKVENVSKVCNAVAILSTSSYHAAVRAGYIKNIVTLAQSAQKCSAQWPDLPWIHTDSWIKNYRRSPGSFNSESVVPMITKTQPSELCFLQFTSGSTGDAKGVMITHSGLIHNVKMMKKRYRSTSKTVLISWLPQYHDMGLIGGLFTTLVSGGTSILFSPMTFIRNPLLWLETISDYHGTHSAGPNFAFELVIRRLEAEKNKTYDLSSMIFLMIAAEPVRQKTVKRFIELTQPLGFSEGVLAPGYGLAENCVYVCCAFGECKPISIDWQGRICCGYVDPNDTDVVIKIVDPDSLTEHQEDGAEGEIWISSSSSGVGYWNNKETSQRTFCNWLKNYPNIKFTRTGDLGRIIDGKLFITGRIKDLIIVAGRNIYSADVEKTVEGSSDVLRPGCCAVVGVPEEVLTQKGISIPDSSDQVGLVVIAEVRDGKVVSENIADSIRTRVAEEHGVTIASVKLIKPRTISKTTSGKIRRFECMKQFVDNTLSLASGNHISKKKSLFRSLTTGTGMEIKRPFLKHTVDSTIHPQPRSKVKNFMEIVGFLMQLVSDQTGISKDKISPNDSLPSYGFDSIAVVRAAQKLSDFLGTPVGAIDIFTASSISELANSLENLVLKSQPQLAPQPRCKVKRSSEIIEFLTQIVSDQAGIPKDKISPTDSLPSYGFDSIAVVRTAQKLSDFLGIPVGAIDIFTASCIAELGSFLENLARKSQPQLEPDVSHSAEDENLVITDATSFDLSVFATGTLQLLALTYVCFILLLPAYLASSMYMSMISSVSLVKSSLLSYLSSLVLAPIAWICYALFTSLSLSTLGKPFLQPNYVLTPDISIWSVDFVKWWALNKAQSLAAKMLAVHLKGTVFLNYWFKMQGARIGSDVVIDTVDITDPSLLAVADSAVIAEGVLIQSHEVRNEVLSFRHIKIGQKASIGPYAVIQKGTIVHGGVVIPPLQKTEQGKSAYPPSGASAYMKDEAGTANMAFEHLFSIYAVGFLGALSGATVFMLYTHFSGTTASLQHFSFACVAGAFHWLPAVIAAYAVIVRETTKSPVEFALFIAFAYLSYGIIVSLLTSVANKALATRSGTKKKDMASLIQQRITIAAHLRFAKMISGTEAFCMYLRLLGAKIGRHCSIRAINPVANPQLISIGDGVHLGDFCNIVPGFYSKGFTSAEIKVQDNTVVGSGSLLLPGSVLQENVILGALSVAPQGSILLQGGVYVGAQSLTLVKNTLLTEDERIAEMDPMYKKIVGNLAANLAITTMNVKSRYFHRIGVSGRGVLRMYQDIPSLPKHKIFGAGKSFPVIVRHSNSLSADDDARLDARGASVRILSDDGEVPLLDLTLKSGNAFYARTIADFATWLVCGLPAREEQVKRAPHIRDAVWGSLRNTDSYTMLHYYSNICRLLRFEDGRQMYAKFKLRPADQGISEDSGQVVPRGILPPETGAIPRDEGDTRPLLFLADDFRRKVESPEGVRYVFQLQLRDVPADSATRDIALDCTRPWDEAEFPYIEVGEISIGSNLPAEETEKLEFNPFLRCQEVDVISATSCKQSASIDHGRSLVYEICQRVRNGEPLPASWRAFLEQSDTKIDLSGCPVIAVTRSSSDVRQATKVTLARTWYQALWATLCQPLLQTLVPYFVVGLVIFLPLRGLLAAMATGMPLYWALPIFWATSGVAAMGACAAAKWTLVGRRADGDTVHIWAPPVFLDTVWQAVRTVTAEYFAELTPGSVLFAGWMRAMGASVAVSDGVYVDSMGALLNPEMVHLERGASVGRDALLFGHIYEGEGGEVKFGRVHVGEDGFVGSRAVAMPGVRVDDGGCLGALRLAMKEEIVMNRM

SEQ ID NO: 10475 - DNA, 774 bp, Sorghum bicolor
  misc_feature: Ceres ANNOT ID no. 6112839
  misc_feature: Encodes the peptide sequence at SEQ ID NO 10476
atgaagtttggcaagaggctcaagaagcaggtggaggagagcctcccagagtggagagacaagttcctggcgtacaagcgcctcaagaggctcgtccgcctcgtctcggctgctggttcttcctcgccccgccgccgccgcaggggcagcgccgccgaggaggccgccttcgtgcgcctgctcgacgccgaggtcgaccggttcaacgccttcttcctggagcgggaggaggacttcgtcatacggcacagggagctgaaggagacggccaagaaggtggcagaggacgcgtggcggcggcggcggccgccgtcggcagcggagacgacgagtgtgcgcaaggagatcgtggacctgcacggggagatggtactgctgctcaactacagcgccatcaactacacagggctggccaagatcctcaagaagtacgacaagcgcaccgggcggctcctacggctgcccttcatcgacaaggtgctcgggcagcccttcttcgccacggagctcatctccaggctcgtccgcgagtgcgaggccaccatggaggccgcgttcgaggccagcagaggcacgtcggccaggacgacccccgtggccgccgccgggcagggcatcttccggaacaccgtggcggcgctggtgaccatgggcgagctccgcagcgggagctccacatacggacacttctcgctgccaccgatggccccgccggagtccgacctcctgcggtgcgtgtgcgtccaggtcgccgccggtccagcgtccatctga

SEQ ID NO: 10476 - protein, 257 aa, Sorghum bicolor
  misc_feature: Ceres ANNOT ID no. 6112839
  misc_feature (1)..(161): Pfam Id: SPX Pfam Desc: SPX domain
  misc_feature (1)..(200): NCBI GI: 124054717 NCBI Desc: ids4-like protein [phaseolus vulgaris]
  misc_feature (1)..(235): NCBI GI: 21592813 NCBI Desc: ids4-like protein [arabidopsis thaliana]
  misc_feature (1)..(235): NCBI GI: 23507805 NCBI Desc: at5g20150/f5o24_40 [arabidopsis thaliana]
  misc_feature (48)..(201): NCBI GI: 56550691 NCBI Desc: at5g15330 [arabidopsis thaliana]
  misc_feature (48)..(201): NCBI GI: 7671502 NCBI Desc: ids-4 protein-like [arabidopsis thaliana]
MKFGKRLKKQVEESLPEWRDKFLAYKRLKRLVRLVSAAGSSSPRRRRRGSAAEEAAFVRLLDAEVDRFNAFFLEREEDFVIRHRELKETAKKVAEDAWRRRRPPSAAETTSVRKEIVDLHGEMVLLLNYSAINYTGLAKILKKYDKRTGRLLRLPFIDKVLGQPFFATELISRLVRECEATMEAAFEASRGTSARTTPVAAAGQGIFRNTVAALVTMGELRSGSSTYGHFSLPPMAPPESDLLRCVCVQVAAGPASI

SEQ ID NO: 10477 - DNA, 1377 bp, Sorghum bicolor
  misc_feature: Ceres ANNOT ID no. 6112959
  misc_feature: Encodes the peptide sequence at SEQ ID NO 10478
atgaactccatcgagcccttcaaccggctggtgaggctggcggcccgcgccttctacgatgacgtctccatgaagggcgacaaccagcccaagacttcccgcggggacaaccgtggcatggccgtcgtcgtcctggacgcgctcaccagacggcagtgggtccgggaggaagatttggctaaagcattgaagctccactcgaaacagctgcgtcgcattctccgtttctttgaagaggagaaactagtcacaagggatcatcggaaggagtcagcaaaaaatgcaaaagcacataatgctgcagctgcagctgctaatgatggtcaaccagttgccaaggagggagaagagaaagtaaagatgcacacacattcatactgttgcttggattatgctcagatctgtgatgttgtaaggtaccggatccaccgcatgaagaaaaaattgaaggatgaattggacagcagaaatacaattcaacactatatatgtcctagctgtaataaaagatactccgcctttgatgcactacaactggtaagctacacggatgagtacttccattgtgaaacttgcaatggtgaactggttgcagagagtgacaagcttgcttctgaggaaatgggagatggtgatgataatgttagaaagcgcaggcgtgagaaattaaaggacatgcagcaaagaattgaagagcaattgaagccattggttgcacaacttgatagagtgaagaatctgcctgcacctgagtttgggagtctacaaacatgggaaagagcaaatattggtgcttttgcaattggtgaccctgctgcagctgattcttccaggaattcacaagggcagtatggtacaccaatgccattcattggagagacaaaggttgaagttgtgattgatggcgtgaaagaagaaggtgctgaatcaggtaaaaatggttctgaactgaaagtcttacctccatggatgatcaaagatggcatgaatcttacaaaggaacaaagaggagagaaaattgagccacaaaaacttgaaatatctgaagccaaagatgacaagaaacaggactcgaaagatgatcaaagtgtacaggaagaatacataaaggcttattatgaggccttgaggaaaaagcaggaagaggaagaagcaaaaaggagaatgcaacaggaaggcaagatttctgtcccagattctcaaactgaacgccaagtgggcaagaaatacaagcgggacgatgatgatgaaggtattgaatgggaagagcatcaacctacagggaatgcaaccgaaacatacaaattggcagatttgaatgcggaggcccaagaatctggcgatgaggaagatgataatgagtgggaggagggttaa

SEQ ID NO: 10478 - protein, 458 aa, Sorghum bicolor
  misc_feature: Ceres ANNOT ID no. 6112959
  misc_feature (33)..(243): Pfam Id: TFIIE_alpha Pfam Desc: TFIIE alpha subunit
  misc_feature (4)..(458): NCBI GI: 145340451 NCBI Desc: transcription initiation factor [arabidopsis thaliana]
  misc_feature (4)..(457): NCBI GI: 3850583 NCBI Desc: contains similarity to transcription initiation factor iie, alpha subunit gbx63468 from homo sapiens. [arabidopsis thaliana]
  misc_feature (4)..(210): NCBI GI: 39545890 NCBI Desc: tfiie-alpha 2 [arabidopsis thaliana]
  misc_feature (4)..(170): NCBI GI: 140067014 NCBI Desc: transcription factor tfiie, alpha subunit [medicago truncatula]
  misc_feature (197)..(458): NCBI GI: 39545892 NCBI Desc: tfiie-alpha 2 [arabidopsis thaliana]
MNSIEPFNRLVRLAARAFYDDVSMKGDNQPKTSRGDNRGMAVVVLDALTRRQWVREEDLAKALKLHSKQLRRILRFFEEEKLVTRDHRKESAKNAKAHNAAAAAANDGQPVAKEGEEKVKMHTHSYCCLDYAQICDVVRYRIHRMKKKLKDELDSRNTIQHYICPSCNKRYSAFDALQLVSYTDEYFHCETCNGELVAESDKLASEEMGDGDDNVRKRRREKLKDMQQRIEEQLKPLVAQLDRVKNLPAPEFGSLQTWERANIGAFAIGDPAAADSSRNSQGQYGTPMPFIGETKVEVVIDGVKEEGAESGKNGSELKVLPPWMIKDGMNLTKEQRGEKIEPQKLEISEAKDDKKQDSKDDQSVQEEYIKAYYEALRKKQEEEEAKRRMQQEGKISVPDSQTERQVGKKYKRDDDDEGIEWEEHQPTGNATETYKLADLNAEAQESGDEEDDNEWEEG

SEQ ID NO: 10479 - DNA, 1347 bp, Sorghum bicolor
  misc_feature: Ceres ANNOT ID no. 6113365
  misc_feature: Encodes the peptide sequence at SEQ ID NO 10480
atgccaacatcgcgagaacaagcacaagcagaacacgaccaccaccaccaccaccccaccatcctacaccgcggcgggctcggcgacgacggcgacggcggcggcggcagcgattcgaggcaggtgtgggtgcctggccccgtcatcgtgggcgccggcccgtcggggctggcgacggcggcgtgcctcaaggcgcgcggcgtgccgtcgctggtgctggagaaggactcgtgcgtggccgcgtcgtggcgccaccgcacgtacgagcggctccggctgcacctgccccggtgcttctgcgagctcccgctcgcgccgttcccgcccggcacgccgccgtaccctacccgggaccagttcatcgcctacctcgacgactacgcccgcgccttcggcattgagccccgactcggcgcgcgcgtccgcagggccgcctacgacgccgccatcggcttctggagggtcaccgtcgatgaagacgctggtggcgatggcggtgccacggtggcgagtaccgagttcttgtcgcggtggctcgtcgtggccaccggcgagaatgcggagccggcgtggccggagggtgtggaggggatggacgggtaccgcggcgtcgccatgcacacgagcagctacaagaagggggacgaattcaggggcaagaatgtgctcgtcgtcggctgcggcaactccggcatggaggtcagcctcgacctctgcaacaatggcgccaaagcctccatggttgtcagggacaagattcatgtgttgcccagggagatactaggcatttccacgtttggcctctccgtgttccttctcaggtggctgcccataagacaggttgattctttgcttctattcttcacaagattgatccttggagacactgaaaaatacggtctcccacgaccaaagatcggcccacttcaaatcaagagttcaaccggcaaaacacccgtactcgacatcggagctctaagaaagatcaaaactagagaaataaaggtggtcccggcaattcagcggttcacagagaatggggtggaattcatagatggccaccgggaggactttgatgctgtcatcttcgcaaccgggtacaaaagcaacgtgccttcatggctcaaggaggaagagctcttcagtcattttgatgggttcccaagaaagccattcccacacagctggaggggcaagaacggcctgtatgccgccggcttcaccaagaagggcctcatgggcacctcctacgacgctcttaggatcgccggcgacatcgcggaccaatggacggagacctttgcgagccccactgctaccaacagaagcagtgaccacggtgcttga

SEQ ID NO: 10480 - protein, 448 aa, Sorghum bicolor
  misc_feature: Ceres ANNOT ID no. 6113365
  misc_feature (49)..(438): Pfam Id: FMO-like Pfam Desc: Flavin-binding monooxygenase-like
  misc_feature (17)..(430): NCBI GI: 92875435 NCBI Desc: pyridine nucleotide-disulphide oxidoreductase, class i; fad-dependent pyridine nucleotide-disulphide oxidoreductase [medicago truncatula]
  misc_feature (37)..(432): NCBI GI: 3142293 NCBI Desc: contains similarity to myosin ib heavy chain gbx70400 from gallus gallus. [arabidopsis thaliana]
  misc_feature (40)..(430): NCBI GI: 115439755 NCBI Desc: os01g0732700 [oryza sativa (japonica cultivar-group)]
  misc_feature (44)..(429): NCBI GI: 13027342 NCBI Desc: dimethylaniline monooxygenase-like protein [oryza sativa (japonica cultivar-group)]
  misc_feature (38)..(432): NCBI GI: 118624210 NCBI Desc: flavin monooxygenase-like protein [solanum lycopersicum]
MPTSREQAQAEHDHHHHHPTILHRGGLGDDGDGGGGSDSRQVWVPGPVIVGAGPSGLATAACLKARGVPSLVLEKDSCVAASWRHRTYERLRLHLPRCFCELPLAPFPPGTPPYPTRDQFIAYLDDYARAFGIEPRLGARVRRAAYDAAIGFWRVTVDEDAGGDGGATVASTEFLSRWLVVATGENAEPAWPEGVEGMDGYRGVAMHTSSYKKGDEFRGKNVLVVGCGNSGMEVSLDLCNNGAKASMVVRDKIHVLPREILGISTFGLSVFLLRWLPIRQVDSLLLFFTRLILGDTEKYGLPRPKIGPLQIKSSTGKTPVLDIGALRKIKTREIKVVPAIQRFTENGVEFIDGHREDFDAVIFATGYKSNVPSWLKEEELFSHFDGFPRKPFPHSWRGKNGLYAAGFTKKGLMGTSYDALRIAGDIADQWTETFASPTATNRSSDHGA

SEQ ID NO: 10481 - DNA, 2424 bp, Sorghum bicolor
  misc_feature: Ceres ANNOT ID no. 6113393
  misc_feature: Encodes the peptide sequence at SEQ ID NO 10482
atgatcggggcctctaggcgatccctcagtgccgccgccgccgccgccgcccgcagccgcgtggctgccagcgctgcctccgccgtctccgccgacgccgacgcctcctcagtcccgccccgccccgtgagcaatggagcgcctggggttcctcagcagcagaagaggctcctctcagtgcttgcagcacccaaggttgcaggaacaagcaatgttgtgtccctcaagctgatggatggtgcccttattgggagacgctatgaatcgagtgcggcagcagttgactctacggacctgccagctgagaagcatgagtatcaggctgaggtcaacaggctcatggatttgatcgtgcacagcttgtatagtaacaaggaagttttccttcgagaattggtcagcaatgctagtgatgcacttgataagttacgttatctgagtgtcacggatcctgagcttctgaaggatggtccccaacttgacattcgcatccaaacagacaaggataatggaataataacaattactgattctgggattggtatgacgaaacaagagctcattgattctcttgggactattgcaagcagtggaactgccaagttcctgaaggcattgaaggagagtcaagaagctggcatggacagcaacttgattggccaatttggtgttggtttctattccgcatttcttgtttcggagaaggttgttgtgtcaactaagagccccaaatctgacaaacaatatgtttgggaaggacaagcagattctggttcttataccattagagaggaaaatgacccggagaagctcattcctaggggaacgcgccttactctctatctcaagcgtgatgataagggctttgctcatcctgagaggattcaaaaacttctaaagaattactctcagtttgtttcctttcccatttacacgttgcaagagaaaggcttcacaaaagaggtggaggttgacgaggatccagcggaagcccaaaaagaaggtgacgagcctaagaaaaagaccaaaaccgtcgttgagaagtattgggattgggagcttgcaaatgagacacaacctatttggcttcggaaccctaaagaggtttcaactgaggagtacaatgaattttacaagaaaaccttcaatgagtacttggatcctttggcctcctcacacttcactacagagggtgaggtagaattcaggtcaattctttttgttcctgctacaaggaaggatgacataactgatagtaggaagaccaagaatatcagactgtatgttaagcgtgtattcatatcagatgactttgatggagaattgttcccaagatatttgagctttgtgaagggtgttgttgactcaaatgaccttccattgaatgtttctcgtgagattcttcaagaaagtcgaattgttcgtataatgagaaagaggctggtgcggaaagcctttgatatgatacttggcatttcttgcagtgaaaacagagatgattatgaaaggttctgggagaactatggaaaattcttaaagctgggtgccatggaagataaggaaaaccacaagagaattgctcctttgttgcgcttcttctcttctcaaagcaacgatgaattaattagcttggatgaatatgtggaaaacatgaaacctgagcaaaaggacatttacttcattgctgcggacagtctgagcagtgccaaaaatgctcctttcttagagagactaacagaaaaagagtatgaggttctacttttcgtcgaccctatggatgaagtggctatccagaatctggtctcctacaaggataagaaatttgtggacattagcaaggaagatttggacttaggtgataacaatgaggaaagagagaaggagataaagcaggagttcagccaaacctgtgactggataaagaatcgcttgggtgacaaggttgcacgtgttgacatatctaaccgtctcaggtcatcgccatgtgtactcgttgcagcgaagtttggttggtcagccaatatggaaaggctgatgagagcacagtctatgggtgatacatcctctttggatttcatgcgctcaaggaaggtttttgaaataaacccagagcatgagataatcaaggccttgaatgtggcatgcaggaataaccctgatgatcctgaagctctaaaggctctggatgttctcttcgaaactgctatgatttcaagtggcttttcgcctgacaacccggcagagctcagtgggaagatctacgagatgatgacctctgccatcgccggcaaatggtcctcacagtcggaggcgcaacctgccaacccaatcccgcagcactctgcacccgtgatgtcagatgagccgcttgaagctgaagtggttgagtcagagcccgctgctgatgctggtcagcagaagtag

SEQ ID NO: 10482 - protein, 807 aa, Sorghum bicolor
  misc_feature: Ceres ANNOT ID no. 6113393
  misc_feature (293)..(796): Pfam Id: HSP90 Pfam Desc: Hsp90 protein
  misc_feature (124)..(285): Pfam Id: HATPase_c Pfam Desc: Histidine kinase-, DNA gyrase B-, and HSP90-like ATPase
  misc_feature (1)..(796): NCBI GI: 145338243 NCBI Desc: atp binding [arabidopsis thaliana]
  misc_feature (88)..(802): NCBI GI: 20453106 NCBI Desc: at2g04030/f3c11.14 [arabidopsis thaliana]
  misc_feature (31)..(802): NCBI GI: 556673 NCBI Desc: heat-shock protein [secale cereale]
  misc_feature (57)..(802): NCBI GI: 1906830 NCBI Desc: heat shock protein [arabidopsis thaliana]
  misc_feature (26)..(585): NCBI GI: 115479725 NCBI Desc: os09g0474300 [oryza sativa (japonica cultivar-group)]
MIGASRRSLSAAAAAAARSRVAASAASAVSADADASSVPPRPVSNGAPGVPQQQKRLLSVLAAPKVAGTSNVVSLKLMDGALIGRRYESSAAAVDSTDLPAEKHEYQAEVNRLMDLIVHSLYSNKEVFLRELVSNASDALDKLRYLSVTDPELLKDGPQLDIRIQTDKDNGIITITDSGIGMTKQELIDSLGTIASSGTAKFLKALKESQEAGMDSNLIGQFGVGFYSAFLVSEKVVVSTKSPKSDKQYVWEGQADSGSYTIREENDPEKLIPRGTRLTLYLKRDDKGFAHPERIQKLLKNYSQFVSFPIYTLQEKGFTKEVEVDEDPAEAQKEGDEPKKKTKTVVEKYWDWELANETQPIWLRNPKEVSTEEYNEFYKKTFNEYLDPLASSHFTTEGEVEFRSILFVPATRKDDITDSRKTKNIRLYVKRVFISDDFDGELFPRYLSFVKGVVDSNDLPLNVSREILQESRIVRIMRKRLVRKAFDMILGISCSENRDDYERFWENYGKFLKLGAMEDKENHKRIAPLLRFFSSQSNDELISLDEYVENMKPEQKDIYFIAADSLSSAKNAPFLERLTEKEYEVLLFVDPMDEVAIQNLVSYKDKKFVDISKEDLDLGDNNEEREKEIKQEFSQTCDWIKNRLGDKVARVDISNRLRSSPCVLVAAKFGWSANMERLMRAQSMGDTSSLDFMRSRKVFEINPEHEIIKALNVACRNNPDDPEALKALDVLFETAMISSGFSPDNPAELSGKIYEMMTSAIAGKWSSQSEAQPANPIPQHSAPVMSDEPLEAEVVESEPAADAGQQK

SEQ ID NO: 10483 - DNA, 414 bp, Sorghum bicolor
  misc_feature: Ceres ANNOT ID no. 6113395
  misc_feature: Encodes the peptide sequence at SEQ ID NO 10484
atgacccaagccaagtccgctcctgggaggagggagatgggccggggacgatcgccggagccactcgatttcttcatatggactgtcgaggatgttggattatggctggaagaaataaatcttggtggctacagacaagtatttgaagaaaatggtgtcaatggagaatatctagaaagcttgtccatgtttactactgaacagattctgcgctttattaggcggtgccatatgaaatggggagactttatcacactgtgcaaagagttgaggcgcattaaagtcgcctgcctcaaaggggagcaagaagtccgcaggccatggtgggcaccggcatgcctctccatagtgttcgtgagggcagccaagcagaacaggaagtcccgtgttgtctccttgaagctggaaccatga

SEQ ID NO: 10484 - protein, 137 aa, Sorghum bicolor
  misc_feature: Ceres ANNOT ID no. 6113395
MTQAKSAPGRREMGRGRSPEPLDFFIWTVEDVGLWLEEINLGGYRQVFEENGVNGEYLESLSMFTTEQILRFIRRCHMKWGDFITLCKELRRIKVACLKGEQEVRRPWWAPACLSIVFVRAAKQNRKSRVVSLKLEP

SEQ ID NO: 10485 - DNA, 693 bp, Sorghum bicolor
  misc_feature: Ceres ANNOT ID no. 6113400
  misc_feature: Encodes the peptide sequence at SEQ ID NO 10486
atggcgagaggaggcggcggcggcggcccgaggccggaggatgaccccttctccgacggcgacaccaccggatccgattccgacgagtcccctcggcaggggatgggggctcgacgccccggcgccacctccaacccgatcctgacacgcctcgcggtgtcgcggaacccgagcccgctcgccgcggccaccgcggccccaggggtctgcctcctccgcttcgcctgggagtccgccgcgggctccctcgtcggcgccgtcgttggatacggtaaaggtttggttatgatgaaggggtttaaaggatcatttcctgatgctgcatcatctgctaagatatttgctgttcttgctggtgttcaaagtttggtagcttgctctttgagaaaacttcgtggaaaagatgatggaatcaatgcaggagtcgcaggctgttgtactggccttgctttgagctttccaggtgctccgcaaactctgattcagagctgcctgacctttgggactttctcttacatcattgagaagctaaacaagcagcagcctgcgctggcgctcccgcctgccacaggtgtgacgggtctgaaggctggacaaagcgttcttcctcccttcacacttcctcttccggatgcgatggacgaaatttctaagttccaaaactttttgtcatccaaatttcggggaaactga

SEQ ID NO: 10486 - protein, 230 aa, Sorghum bicolor
  misc_feature: Ceres ANNOT ID no. 6113400
  misc_feature (63)..(181): Pfam Id: Tim17 Pfam Desc: Tim17/Tim22/Tim23 family
  misc_feature (108)..(226): NCBI GI: 115481700 NCBI Desc: os10g0364700 [oryza sativa (japonica cultivar-group)]
  misc_feature (109)..(176): NCBI GI: 115452455 NCBI Desc: os03g0296300 [oryza sativa (japonica cultivar-group)]
  misc_feature (76)..(176): NCBI GI: 42562146 NCBI Desc: mitochondrial import inner membrane translocase subunit tim17/tim22/tim23 family protein [arabidopsis thaliana]
  misc_feature (109)..(176): NCBI GI: 18398755 NCBI Desc: mitochondrial import inner membrane translocase subunit tim17/tim22/tim23 family protein [arabidopsis thaliana]
  misc_feature (109)..(176): NCBI GI: 89213235 NCBI Desc: at3g10110 [arabidopsis thaliana]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated salt sensitivity
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13270
  misc_feature: Functional homolog of the protein sequence given in SEQ ID NO 13456
  misc_feature: Useful for making plants with modulated salt sensitivity
  misc_feature: Functional homolog of the protein sequence given in SEQ ID NO 13456
MARGGGGGGPRPEDDPFSDGDTTGSDSDESPRQGMGARRPGATSNPILTRLAVSRNPSPLAAATAAPGVCLLRFAWESAAGSLVGAVVGYGKGLVMMKGFKGSFPDAASSAKIFAVLAGVQSLVACSLRKLRGKDDGINAGVAGCCTGLALSFPGAPQTLIQSCLTFGTFSYIIEKLNKQQPALALPPATGVTGLKAGQSVLPPFTLPLPDAMDEISKFQNFLSSKFRGN

SEQ ID NO: 10487 - DNA, 1125 bp, Sorghum bicolor
  misc_feature: Ceres ANNOT ID no. 6113424
  misc_feature: Encodes the peptide sequence at SEQ ID NO 10488
atggtgatccccctggtgctcgtcgtgcttccgcttgggctcctcttcctcctttccggcctcatcgtcaacgcaatccaggctatcttgctcgtgtctgtaaggccattatcgaagagcttgtatcgtcggatcaacagattcttagtcgagctgctatggcttcagctaatctggcttttggactggtgggctgttgttaaggtacaattgcatgcagatcaagaaacttatcagctaatgggaaaagagcatgcccttatcatatcaaatcatcggagcgacatcgattggcttattggatggattttggcacagcgttcaggatgtcttggaagcacactagctatcatgaagaaatcttcaaagtttcttccagttattggctggtctatgtggttttctgaatatctatttctggagagaagttgggcaaaggacgaaaagacacttaaatggggtctcagaaggttgaaggactttcccagatcattctggcttgccctttttgttgagggtacacggtttacaccagcaaaacttctagcagctcaagaatatgcagcctcacagggtttgccagcccctagaaatgtgttgattccacggaccaagggatttgtatcagcagtaggtattatgcgtgattttgtcccagctatctatgatacaacagtgataatccctaaagattcacctgcaccgacaatgctgcgcattctcaagggacagtcatcagtagttcatgttcatataaaacgccatgcaatgagtgatatgcctaaattcgatgaagatgtttcaaaatggtgtaaggacatctttgtggcaaaggatgctttattggacaagcatatagcaactggtacttttgatgaagaaattagaccaattggtcgtccagtgaaatctttgctggtggttctgtcttggtcatgcctcctcctatatggtgcctacagattcttacagtggactcaactcttgtcaacgtggaaaggcattatcctcctcgctgctggattggcactggtgactggcgttatgcatgtcttcatcatgttctctcagtcagagcgttcaagctccgccagagcagcgaggaatcgggtgaagaaagattga

SEQ ID NO: 10488 - protein, 374 aa, Sorghum bicolor
  misc_feature: Ceres ANNOT ID no. 6113424
  misc_feature (68)..(223): Pfam Id: Acyltransferase Pfam Desc: Acyltransferase
  misc_feature (16)..(316): NCBI GI: 115486385 NCBI Desc: os11g0637800 [oryza sativa (japonica cultivar-group)]
  misc_feature (1)..(367): NCBI GI: 82568693 NCBI Desc: 1-acyl-sn-glycerol-3-phosphate acyltransferase [prunus mume]
  misc_feature (1)..(372): NCBI GI: 92897607 NCBI Desc: phospholipid/glycerol acyltransferase [medicago truncatula]
  misc_feature (8)..(372): NCBI GI: 4583544 NCBI Desc: acyl-coa:1-acylglycerol-3-phosphate acyltransferase [brassica napus]
  misc_feature (1)..(372): NCBI GI: 21536701 NCBI Desc: 1-acylcerol-3-phosphate acyltransferase-like protein [arabidopsis thaliana]
  misc_feature (1)..(374): SWISSPROT Homolog: EC 2.3.1.51 1-acyl-sn-glycerol-3-phosphate acyltransferase PLS1
MVIPLVLVVLPLGLLFLLSGLIVNAIQAILLVSVRPLSKSLYRRINRFLVELLWLQLIWLLDWWAVVKVQLHADQETYQLMGKEHALIISNHRSDIDWLIGWILAQRSGCLGSTLAIMKKSSKFLPVIGWSMWFSEYLFLERSWAKDEKTLKWGLRRLKDFPRSFWLALFVEGTRFTPAKLLAAQEYAASQGLPAPRNVLIPRTKGFVSAVGIMRDFVPAIYDTTVIIPKDSPAPTMLRILKGQSSVVHVHIKRHAMSDMPKFDEDVSKWCKDIFVAKDALLDKHIATGTFDEEIRPIGRPVKSLLVVLSWSCLLLYGAYRFLQWTQLLSTWKGIILLAAGLALVTGVMHVFIMFSQSERSSSARAARNRVKKD

SEQ ID NO: 10489 - DNA, 870 bp, Sorghum bicolor
  misc_feature: Ceres ANNOT ID no. 6113442
  misc_feature: Encodes the peptide sequence at SEQ ID NO 10490
atggggctgccgtcgccgggtgcgtcgttcacgccgccgctctcgccttccggcgggggaagcggcgtcgccggcgcgtggccgcagcccaacgtgcccgcgctgtgcctccccgggagcgccgggaaccttcatctgagccggctgcgcacttcgctgagcgcgcgcagcagggcagtggacgagctgctcgcctcagcggattacgacgggctcatcggatcgccagcctctgtgcggtctgcgaggggaaagacgctcgtgccgtccaatctcgacgatctgttctccgcggagatggcaggctccgcggcatctcactcaccgcggtacggggaccagggcggcgctgctttctcgccgacgcgtaaggccgccatgctgaaccagttccagcagcagcagagcttgctctctccccgggccacggttatccctgagccagtgtctccgatgagctccaggctgctcgcggcccttgcgcagcgggagaagatgcagcagcaaacactgagaagcatgagctctcgtgaccttggctccggcgcctccgtcctggttggttcaccagttacctctagctggtccaaatggggaatcccctcgagcacaccagattggggtgctgacgacgatgagattggtcgcctcaagcgatcctcgtcctttgagctccggaatggtgccaatggcgatgagccggacctctcatgggtcaatacccttgttaaggagccaacgccggagaagccatccattgcttctttgagtcaggccacaagtcatgaggatatcggcggtgaggatgacactgccggggtgatcggtggctggcttgaacagctccagctggatgagatggtagtctag

SEQ ID NO: 10490 - protein, 289 aa, Sorghum bicolor
  misc_feature: Ceres ANNOT ID no. 6113442
  misc_feature (133)..(288): NCBI GI: 124360202 NCBI Desc: zinc finger, ccch-type [medicago truncatula]
  misc_feature (138)..(289): NCBI GI: 140039408 NCBI Desc: zinc finger, ccch-type [medicago truncatula]
  misc_feature (3)..(181): NCBI GI: 7630041 NCBI Desc: zinc finger transcription factor-like protein [arabidopsis thaliana]
  misc_feature (3)..(181): NCBI GI: 22136426 NCBI Desc: zinc finger transcription factor-like protein [arabidopsis thaliana]
  misc_feature (5)..(243): NCBI GI: 46367690 NCBI Desc: zf protein [oryza sativa (japonica cultivar-group)]
  misc_feature: The sequence is a functional homolog of SEQ ID NO 230 in the 10/412,699US patent application
  misc_feature: Useful for making plants with modulated growth and phenotype characteristics
  misc_feature: The sequence is a functional homolog of SEQ ID NO 230 in the 20040045049 US patent application
MGLPSPGASFTPPLSPSGGGSGVAGAWPQPNVPALCLPGSAGNLHLSRLRTSLSARSRAVDELLASADYDGLIGSPASVRSARGKTLVPSNLDDLFSAEMAGSAASHSPRYGDQGGAAFSPTRKAAMLNQFQQQQSLLSPRATVIPEPVSPMSSRLLAALAQREKMQQQTLRSMSSRDLGSGASVLVGSPVTSSWSKWGIPSSTPDWGADDDEIGRLKRSSSFELRNGANGDEPDLSWVNTLVKEPTPEKPSIASLSQATSHEDIGGEDDTAGVIGGWLEQLQLDEMVV

SEQ ID NO: 10491 - DNA, 2058 bp, Sorghum bicolor
  misc_feature: Ceres ANNOT ID no. 6113453
  misc_feature: Encodes the peptide sequence at SEQ ID NO 10492
atgtgccgtttatgcttttctggagaaaatgagggcagcacgaaagctgccaaaatgcttccatgtaaactctgcagcaaacggtatcatagaaactgtttgaaaagctggggggaacatagagaccttttccactggagctcatgggtctgtccgtcttgccgcaattgtgaggtgtgccgacgtcctggtgatcccaataagttaatgttctgtaaaaggtgtgatggcgcttatcattgttactgccagcaaccatcacacaagaatgttacccatggaccatatttatgtccaaaacacacaaggtgccacagctgtggatctggtgtgcctggtagtggccatagcacaaggtggtttttggggtacacatgttgtgatgcgtgtgggcgattgtttgtgaaaggaaactactgtccaatttgcttgaaggtttatagagactctgaagtgatacctatggtttgctgcgatgtttgtgaaaaatgggtgcatattgagtgtgatggcatcagtgacgaaaagtaccaagaatttcaagctgaccaaaaccttcagtacacatgtgcagcatgccgtggtgaatgctcccagatccgggacactgaggatgcaatccgggagctttggaagaggagagatgttgtcgatcatgaacttatggttactttgcgggctgctgctgcactaccttctcctgaagatgtgtcaccaccttatccaaactcagatgatgagaaactcggtgcatatgtattgaaaaatgagagtagaaatactctaaagttttcattaaaaagcaacagtagtaagcctccatcagatacacctgagcaagagaagattgtttttaagagccctggatcaaataagaagtcttccaaaaagaaaggtggccagggtaataaaacagatgatggccatgatgaaatatttctggagagaaggcatgatgttaaattaccaaatagccgtttgggagatcaaagtatagatggcaatcatgataggagcccttttaagaatgatgataatgcctacatttcatcttcaactcgaagttcagagaagagtttgaaatctccatccaagaaagctgtgccaaacaatgctgatatgatacccaaagtcaagattaaaggcagtaaggtttcaactttgcattacaaagatggtgaagaaaatacccccaagaatgacactggaaaagctaccaagttggttattcatcttggttcgcggcataaaactaggagtggctctcctaagtcagaactgtccaattctcaaagagagcaagatctgggttcaatacatggagggaaagtagatgttacaagccagctgaaaagttcaagaagtgaggtaaaagagagaagtgtaatgaagttagttagagagactggggcaccgcaaagaaatagccttttgggtgatcttggtacctcaaaaaagcatgcaactgggaaaaggagcaatgctctaatttctggaatggaaaatgcaaatgaaactggtagtagaaacagatcatttgcacaaaaacaatatcattctagtcaggtggatgagaaccaaggaactgctgactctcctgataatttgaagccatcattgctcaaactcaaatttaagcgtccacattttgagcagctaaacacccaggcctctcaaccagaggagccgacctcctgggtttctcagcaagaggagcagttaaatgttgctaaaggccagaggtcaaagaggaagaggccttcaatggagaaggcagatggtttggatggtacgactccagccaagaggcatcagcagagcacagatgatgaagtgatggatgcaaactggattctacgcaagttgggcaaggatgcgattggaaagaggattgaggtccatctaacttctgatggcaaatggcatcaagggatggtgtcgaatgtcatcggtggcacactgtgtattcagttagacaatggcaggtctgagaacgtggagctaggaaagcaggccatccgcctgattgcttcaagatcaaagggcgggaagcgatga

SEQ ID NO: 10492 - protein, 685 aa, Sorghum bicolor
  misc_feature: Ceres ANNOT ID no. 6113453
  misc_feature (1)..(57): Pfam Id: PHD Pfam Desc: PHD-finger
  misc_feature (58)..(104): Pfam Id: PHD Pfam Desc: PHD-finger
  misc_feature (139)..(196): Pfam Id: PHD Pfam Desc: PHD-finger
  misc_feature (2)..(54): Pfam Id: zf-C3HC4 Pfam Desc: Zinc finger, C3HC4 type (RING finger)
  misc_feature (2)..(517): NCBI GI: 42565848 NCBI Desc: phd finger family protein [arabidopsis thaliana]
  misc_feature (4)..(193): NCBI GI: 11072099 NCBI Desc: mll protein [homo sapiens]
  misc_feature (18)..(193): NCBI GI: 2136323 NCBI Desc: trithorax homolog htx - human (fragment)
  misc_feature (4)..(193): NCBI GI: 62088596 NCBI Desc: myeloid/lymphoid or mixed-lineage leukemia (trithorax homolog, drosophila) variant [homo sapiens]
  misc_feature (4)..(193): NCBI GI: 119587786 NCBI Desc: myeloid/lymphoid or mixed-lineage leukemia (trithorax homolog, drosophila), isoform cra_c [homo sapiens]
MCRLCFSGENEGSTKAAKMLPCKLCSKRYHRNCLKSWGEHRDLFHWSSWVCPSCRNCEVCRRPGDPNKLMFCKRCDGAYHCYCQQPSHKNVTHGPYLCPKHTRCHSCGSGVPGSGHSTRWFLGYTCCDACGRLFVKGNYCPICLKVYRDSEVIPMVCCDVCEKWVHIECDGISDEKYQEFQADQNLQYTCAACRGECSQIRDTEDAIRELWKRRDVVDHELMVTLRAAAALPSPEDVSPPYPNSDDEKLGAYVLKNESRNTLKFSLKSNSSKPPSDTPEQEKIVFKSPGSNKKSSKKKGGQGNKTDDGHDEIFLERRHDVKLPNSRLGDQSIDGNHDRSPFKNDDNAYISSSTRSSEKSLKSPSKKAVPNNADMIPKVKIKGSKVSTLHYKDGEENTPKNDTGKATKLVIHLGSRHKTRSGSPKSELSNSQREQDLGSIHGGKVDVTSQLKSSRSEVKERSVMKLVRETGAPQRNSLLGDLGTSKKHATGKRSNALISGMENANETGSRNRSFAQKQYHSSQVDENQGTADSPDNLKPSLLKLKFKRPHFEQLNTQASQPEEPTSWVSQQEEQLNVAKGQRSKRKRPSMEKADGLDGTTPAKRHQQSTDDEVMDANWILRKLGKDAIGKRIEVHLTSDGKWHQGMVSNVIGGTLCIQLDNGRSENVELGKQAIRLIASRSKGGKR

SEQ ID NO: 10493 - DNA, 615 bp, Sorghum bicolor
  misc_feature: Ceres ANNOT ID no. 6113469
  misc_feature: Encodes the peptide sequence at SEQ ID NO 10494
atggtgcgtgaactacccgccgccggggcagcccgaggaccccacctcgccgccgtcggtcgcgggctcctcctcgcggccctcctcgtggctgctgcctccttcctcccagtagccgagtcgtcctgcccgcgagacaactcactggtgagagacataagccgcatgcagcagagcaactatgggagggaaggattctcgcatataactgtcgctggtgcgcttgctcacgggatgaaggaggttgaagtgtggcttcagacatttcgtccaggtcaaaggaccccaatccacaggcattcttgtgaagaggttttcattgtcctcaaagggaaaggcacgctcttactagggtcgagctcgctgaagtacccagggcagccgcaggaagttcctgtctttcagaataccacattttcggtccctgtaaatgatccgcatcaggtctggaattctgatgagcacgaagatttgcaagttcttgtgaccatatcgcgcccacccgtcaagatatttatatacgatgattggagtatgcctcatacagctgcgaagctgaaattcccctacttctgggacgaggactgcttgacagcaccaaaagatgaactctag

SEQ ID NO: 10494 - protein, 204 aa, Sorghum bicolor
  misc_feature: Ceres ANNOT ID no. 6113469
  misc_feature (39)..(204): Pfam Id: Auxin_BP Pfam Desc: Auxin binding protein
  misc_feature (85)..(164): Pfam Id: Cupin_2 Pfam Desc: Cupin domain
  misc_feature (1)..(204): NCBI GI: 461451 NCBI Desc: auxin-binding protein 4 precursor (abp)
  misc_feature (7)..(204): NCBI GI: 62363269 NCBI Desc: auxin-binding protein precursor [oryza sativa (japonica cultivar-group)]
  misc_feature (4)..(204): NCBI GI: 264278 NCBI Desc: auxin-binding protein; abp [zea mays]
  misc_feature (4)..(204): NCBI GI: 168397 NCBI Desc: auxin-binding protein
  misc_feature (4)..(204): NCBI GI: 168422 NCBI Desc: auxin-binding protein precursor
MVRELPAAGAARGPHLAAVGRGLLLAALLVAAASFLPVAESSCPRDNSLVRDISRMQQSNYGREGFSHITVAGALAHGMKEVEVWLQTFRPGQRTPIHRHSCEEVFIVLKGKGTLLLGSSSLKYPGQPQEVPVFQNTTFSVPVNDPHQVWNSDEHEDLQVLVTISRPPVKIFIYDDWSMPHTAAKLKFPYFWDEDCLTAPKDEL

SEQ ID NO: 10495 - DNA, 6798 bp, Sorghum bicolor
  misc_feature: Ceres ANNOT ID no. 6113493
  misc_feature: Encodes the peptide sequence at SEQ ID NO 10496
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
atggcggagccctaccaaatgaacggcatactgaacgggatgcctaatttgaggcatccatcctctccatcagaagtcgatgaattctgtaaagcgcttggtggtgactcgccaatacacagtgtgctagtcgctaacaatgggatggccgcggtcaagttcatgcgcagcatccggatatgggccctggagacctttgggacagagaaggccattcttttggttgctatggcaacaccggaggacttgaggataaacgctgagcacataagaattgctgatcagttcgtagaagttcctggaggaacaaacaataacaactatgcgaatgtacggcttatagttgagattgcagagagaactcgtgtatctgcagtttggcctggctggggtcatgcgtctgagaacccagaacttccagatgctctaaacgagaaaggaatcatttttcttgggccaccatcagctgcaatggctgcacttggtgataagattggttcttctctcattgcacaagcagcaggagttccaactcttccatggagtggatcacatgtaaaagttccaccagaaagctgccattcaattcccgaggagatatataagaatgcttgtgtttccaccacagaggaagcagtggctagttgtcaggtggttgggtaccctgccatgatcaaggcatcttggggaggcggtggtaaaggaataagaaaggttcataacgatgatgaggtgagggcactgttcaagcaagttcaaggagaagtccctggctcgcctatatttattatgaaagtggcatctcagagccgacatctggaggttcaattgctctgtgataaacatggcaatgtggcagcactacacagtcgagattgcagtgttcaaagaaggcaccaaaagattattgaagaggggccaatcacagttgctgctccagacactgttaaagagcttgagcaggcagcaaggcggcttgctaagtgtgttcaatacgttggtgctgctaccgtagaatatctgtacagcatggaaacgggtgaatactattttttggagcttaatccacggttgcaggtagaacatcctgtgactgaatggatagctgaagtaaacttgccagcagcccaagttgcagtcggaatgggcatacccctctataacattccagagattagacgcttttatggaatggaccatgggggaggctaccatgattggaggaaaatatcagctgttgcaactaagtttgatttggataaagcacagtcagtgaggccgaagggccattgtgttgcagtcagagttactagtgaggatcctgatgatgggtttaagcctacaagtggaagagtggaggagttaaactttaaaagcaaaccgaatgtttgggcctatttctctgttaagtctggaggagcaattcatgaattctctgattcacagtttggtcatgtttttgcatttggggaatctagatctttagccatagccaatatggtacttgggctaaaagagattcagatccgtggagagatacgcacaaatgttgattacacagtggatctcttgaatgccgcagagtaccgcgaaaataagatccatactggttggcttgacagcagaatagctatgcgtgttagagcagagaggcccccatggtacctctcagttgttggaggagctctatatgaagcatcaagcaggagctcaagcgttgttactgattatgttggttatctcagcaaaggtcagataccaccaaagcacatctcgcttgtcaatttaagtgttactctgaacatagaggggagcaaatacacgattgagacagttaggggtggaccccgcagctacaaattaagaatgaatggatcagaaattgaagcagagatacattcactgcgagatggtggacttttaatgcagttggatggaaacagtcatgtaatttatgcagagacggaggctgctggtacacgccttctcattaatggtagaacatgcttactacagaaagaacatgatccttcaaagttgttggctgatacaccttgcaaacttcttcggttcttggttgccgatggctctcatgtggatgctgatacaccatatgctgaggtggaagtcatgaagatgtgcatgccactgttactgcctgcctctggtgtcattcactttgttatgcctgagggtcaggccatgcaggcgagtgacctgatagcaagattggaccttgatgacccctcttctgtgaggagagctgaaccatttcatggttcctttcccaaactgggacctcctaccgctatctctggcaaagttcatcaaaaatttgctgcaagtgtgaattctgcacacatgatccttgcaggatatgaacataatatcaatgacgttgtacaagatttgctaaactgcctagacagccctgagctcccttttctacaatggcaagaacttatgtctgttttagcaacacggcttccaaaagatcttaggaatgagttggatggtaagtacaaggagtatgaattgaatcctgacttctgcaagagtaaggatttccctgcaaagttgctgaggggggttattgaggcaaatcttgcatactgttcggagaaagatagggttactaatgagaggcttgtggaaccacttatgagcctggtcaagtcatatgagggtggaagagaaagccatgctcgtgttgttgtcaaatctctatttgaggagtatctgtctgttgaagagctcttcaatgataaccttcagtctgatgttatagagcgtctacgccttcaacatgcaaaagaccttgagaaggttgtatacattgtgttctcacaccagggtgtgaggagcaaaaacaaattaatactacggcttatggaggcattggtatatccaaacccatctgcttacagggatcagctgattcgcttctctgctttgaaccatacatcatattccgagctggcacttaaagcaagccaacttcttgagcacactaaattgagtgaacttcgcacaagcatagcaagaagcctttcagagctggaaatgtttactgaggaaggagagcgtttgtcaacacctaggagaaagatagcgataaatgagagaatggaagatttagtttgtgctccactggcagttgaagatgctcttgtagcgttgttcgatcacagtgatcctactcttcaacggagagtggttgagacatatatacgcagattgtatcagccttatcttgtaagtggaagtatccggatgcaatggcaccgagctggcctaattgccatatgggagttctctgaagagcatcttaagcaaagaattgggcaagatgtgcccctacagcaagtagagaattccactgagaagagatggggcgtcatggttgtaattaagtctctccagtttttagcaactgcaattgatgttgcactgaaggagacttcacagtacagagtgggtgtcggaagtgtctcgaacggtgaccatgtaaattctaatcaaagcaatatgcttcatattgctttggttggtatcaataatcagatgagtactctccaagacagtggtgatgaggatcaagcacaagaaagggtcaacaaactatccaagattttgaaggataacactattacatcacatcttaatggcgctagtgttaaggttgtcagctgtattatccaaagagatgaagggcgtccaccaatgcgacactccttccaatggtctgttgacaagctttattatgaggaggatccaatgcttcgccatgtggaaccgccgttgtctacattccttgagctggagaaagtaaatttggaaggttacaatgaagtaaaatacaccccatcacgtgatcgtcagtggcatatttatacacttatcaagaacaagaaagatcagagattaaacgaccagagaatgttccttcgtaccatagtcagacaaccaagtgcaacaaatggtttcctgtcaggtaatattgacaatgaagtaggccgcacacaagcttcatcgtcgttcacatcaaacagcattctcagatcattgatgggagcactagaagaaatagagctacatgctcatagtgagactgtgagatcaggccactcacagatgtatctgtgcttactgagagaacaacaattgcatgaactaattccattttcaaggatgactgatgaaattgatcaggatgaaggaactgcatgtacacttttgaagcatatggtattgaatttatatgaacatgttggggtcaggatgcatcgtctttctgtgtgccagtgggaagtcaagctctggttggtttgtgatgggcaagctagtggtgcttggagagttgttgttaccaatgttactggtcacacctgcaccattgatatttaccgagaagtggaagaccccagcacacatcagcttctctaccactctgccacagccacggctggtcctttgcatggtgttgcattgaatgaaccatacaagcctttggacgctattgacctcaaacgttatgctgctaggaaaaatgaaaccacatactgctacgatttccccttggcatttgaaacagcgctgaagagattatggaaatcaagtagctatggtgttagtgaagctaatgagcgcaatcaactctatgctgaagtgaaagagcttatatttgttgattcggatggagcatggggcactccattggtttcatttgaacgccctccaggcatcaatgatattggcattgttgcttggaacatgaagctgtccacgccagaattcccaagtggccgggagattatagttgttgccaatgatgtgacatttaaagctgggtcctttggtccaagagaagatgcattttttgatgctgttaccaatcttgcctgtgagaggaaacttcctcttatctatctggcagcaactgctggtgccaggcttggtgtagctgaggaaataaagtcatgcttccatgtcggctggtctgatgatgagagccctgaacgtggttttcagtacatttacctcactacacaagattactcacgtctaagctcttcagtaatagctcacgagctgcaactagaaaatggagaaaccagatgggtggttgataccattgttggtaaagaggatggacttggttgtgagaatctccatggaagtggtgcgattgccagtgcatattccaaggcatacaaagagacctttactctgacatttgtgactggaagagctgttggcattggggcttatctggctcgtttaggtatgaggtgtatacaacgtcttgatcaaccaattattctgactgggttttctgcactaaacaagcttctggggcgggaggtgtacagttctcatatgcaattgggtggccccaaaatcatggctacaaatggtgttgtccaccaaactgtgtcagatgaccttgaaggtgtttctgctatcctgaaatggctcagttatgttcctccatatgttggtggtcctcttcccattatgaaacccctggacccacccgaaagaccagtagcatacttccctgagaatgcttgtgatgctcgtgcagccatctgtggcattcaagacggtgaagggaagtggttaggtggtatgtttgatagggaaaccttcgtggaaacattggaaggttgggcaaaaacagttatcaccggaagagcaaagcttggtggaataccagttggtgtcatagctgtggaaacccagactgtgatgcaagtcatcccagctgatccaggtcagcttgattccgctgagcgtgtagtccctcaagcaggtcaggtgtggttcccagattctgcagccaaaacagctcaggcattaatggatttcaaccgtgaggagcttccactgttcatccttgcaaactggagaggtttctctggtgggcaaagggatttatttgaaggaatccttcaggctggttcaacaattgttgagaatctgaggacgtacaagcagcctgcttttgtatatatcccaatgggtggagagctacggggaggggcctgggttgtggtggacagcaagatcaatccggaccacatagagatgtatgctgagaggactgcgaaagggaatgtccttgaggcagaaggattggtggagataaaattcaggccaaaggaactggaagattgcatgctaaggcttgacccagaattgattggcctgaatgctaggctgaaagacatgaagaaacaaaatgccagcatctcggaaatggagaccatacggaggagtatgactattcggatgaagcagttgatgcctatttatactcaggttgccacacgatttgccgaattgcatgacacctctgctagaatggctgccaaaggtgtgatcggtaaggttgttgattgggaagagtctcgggccttcttctacaggagattgcgaaggagagttgctgaggatgccctggccaaggaagttaaagaagctgctggtgagcagctttcccacagatcagcactagactctatcaagaaatggtatctagtgtccaaaggaactgaaggtggtagtgaaatgtggaatgatgatgaatctttctttgcttggaaggatgattccaagaactatgaaaattatctcgaggagttgaaggctgaaagagtatcgaactggttctcgcatcttgctgaaagttccgacgtgaaagctctgccaaacggtctttcactcctccttaacaagatgaatcctctgaagagggagcaggtcattgatggcctcaggcagcttcttggttga

SEQ ID NO: 10496 - protein, 2265 aa, Sorghum bicolor
  misc_feature: Ceres ANNOT ID no. 6113493
  misc_feature (745)..(1493): Pfam Id: ACC_central Pfam Desc: Acetyl-CoA carboxylase, central region
  misc_feature (1592)..(2150): Pfam Id: Carboxyl_trans Pfam Desc: Carboxyl transferase domain
  misc_feature (38)..(161): Pfam Id: CPSase_L_chain Pfam Desc: Carbamoyl-phosphate synthase L chain, N-terminal domain
  misc_feature (433)..(540): Pfam Id: Biotin_carb_C Pfam Desc: Biotin carboxylase C-terminal domain
  misc_feature (163)..(394): Pfam Id: CPSase_L_D2 Pfam Desc: Carbamoyl-phosphate synthase L chain, ATP binding domain
  misc_feature (678)..(744): Pfam Id: Biotin_lipoyl Pfam Desc: Biotin-requiring enzyme
  misc_feature (11)..(2265): NCBI GI: 1244566 NCBI Desc: acetyl-coa carboxylase
  misc_feature (24)..(2265): NCBI GI: 514306 NCBI Desc: cytosolic acetyl-coa carboxylase [triticum aestivum]
  misc_feature (1)..(2265): NCBI GI: 992917 NCBI Desc: acetyl coa carboxylase
  misc_feature (1)..(2265): NCBI GI: 495725 NCBI Desc: acetyl-coa carboxylase [medicago sativa]
  misc_feature (7)..(2265): NCBI GI: 79358114 NCBI Desc: acc1 (acetyl-coenzyme a carboxylase 1); acetyl-coa carboxylase [arabidopsis thaliana]
  misc_feature: Useful for making plants with altered oil content
  misc_feature: Useful for making plants with modulated herbicide sensitivity
  misc_feature: Functional homolog of the protein sequence given in SEQ ID NO 13625
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
MAEPYQMNGILNGMPNLRHPSSPSEVDEFCKALGGDSPIHSVLVANNGMAAVKFMRSIRIWALETFGTEKAILLVAMATPEDLRINAEHIRIADQFVEVPGGTNNNNYANVRLIVEIAERTRVSAVWPGWGHASENPELPDALNEKGIIFLGPPSAAMAALGDKIGSSLIAQAAGVPTLPWSGSHVKVPPESCHSIPEEIYKNACVSTTEEAVASCQVVGYPAMIKASWGGGGKGIRKVHNDDEVRALFKQVQGEVPGSPIFIMKVASQSRHLEVQLLCDKHGNVAALHSRDCSVQRRHQKIIEEGPITVAAPDTVKELEQAARRLAKCVQYVGAATVEYLYSMETGEYYFLELNPRLQVEHPVTEWIAEVNLPAAQVAVGMGIPLYNIPEIRRFYGMDHGGGYHDWRKISAVATKFDLDKAQSVRPKGHCVAVRVTSEDPDDGFKPTSGRVEELNFKSKPNVWAYFSVKSGGAIHEFSDSQFGHVFAFGESRSLAIANMVLGLKEIQIRGEIRTNVDYTVDLLNAAEYRENKIHTGWLDSRIAMRVRAERPPWYLSVVGGALYEASSRSSSVVTDYVGYLSKGQIPPKHISLVNLSVTLNIEGSKYTIETVRGGPRSYKLRMNGSEIEAEIHSLRDGGLLMQLDGNSHVIYAETEAAGTRLLINGRTCLLQKEHDPSKLLADTPCKLLRFLVADGSHVDADTPYAEVEVMKMCMPLLLPASGVIHFVMPEGQAMQASDLIARLDLDDPSSVRRAEPFHGSFPKLGPPTAISGKVHQKFAASVNSAHMILAGYEHNINDVVQDLLNCLDSPELPFLQWQELMSVLATRLPKDLRNELDGKYKEYELNPDFCKSKDFPAKLLRGVIEANLAYCSEKDRVTNERLVEPLMSLVKSYEGGRESHARVVVKSLFEEYLSVEELFNDNLQSDVIERLRLQHAKDLEKVVYIVFSHQGVRSKNKLILRLMEALVYPNPSAYRDQLIRFSALNHTSYSELALKASQLLEHTKLSELRTSIARSLSELEMFTEEGERLSTPRRKIAINERMEDLVCAPLAVEDALVALFDHSDPTLQRRVVETYIRRLYQPYLVSGSIRMQWHRAGLIAIWEFSEEHLKQRIGQDVPLQQVENSTEKRWGVMVVIKSLQFLATAIDVALKETSQYRVGVGSVSNGDHVNSNQSNMLHIALVGINNQMSTLQDSGDEDQAQERVNKLSKILKDNTITSHLNGASVKVVSCIIQRDEGRPPMRHSFQWSVDKLYYEEDPMLRHVEPPLSTFLELEKVNLEGYNEVKYTPSRDRQWHIYTLIKNKKDQRLNDQRMFLRTIVRQPSATNGFLSGNIDNEVGRTQASSSFTSNSILRSLMGALEEIELHAHSETVRSGHSQMYLCLLREQQLHELIPFSRMTDEIDQDEGTACTLLKHMVLNLYEHVGVRMHRLSVCQWEVKLWLVCDGQASGAWRVVVTNVTGHTCTIDIYREVEDPSTHQLLYHSATATAGPLHGVALNEPYKPLDAIDLKRYAARKNETTYCYDFPLAFETALKRLWKSSSYGVSEANERNQLYAEVKELIFVDSDGAWGTPLVSFERPPGINDIGIVAWNMKLSTPEFPSGREIIVVANDVTFKAGSFGPREDAFFDAVTNLACERKLPLIYLAATAGARLGVAEEIKSCFHVGWSDDESPERGFQYIYLTTQDYSRLSSSVIAHELQLENGETRWVVDTIVGKEDGLGCENLHGSGAIASAYSKAYKETFTLTFVTGRAVGIGAYLARLGMRCIQRLDQPIILTGFSALNKLLGREVYSSHMQLGGPKIMATNGVVHQTVSDDLEGVSAILKWLSYVPPYVGGPLPIMKPLDPPERPVAYFPENACDARAAICGIQDGEGKWLGGMFDRETFVETLEGWAKTVITGRAKLGGIPVGVIAVETQTVMQVIPADPGQLDSAERVVPQAGQVWFPDSAAKTAQALMDFNREELPLFILANWRGFSGGQRDLFEGILQAGSTIVENLRTYKQPAFVYIPMGGELRGGAWVVVDSKINPDHIEMYAERTAKGNVLEAEGLVEIKFRPKELEDCMLRLDPELIGLNARLKDMKKQNASISEMETIRRSMTIRMKQLMPIYTQVATRFAELHDTSARMAAKGVIGKVVDWEESRAFFYRRLRRRVAEDALAKEVKEAAGEQLSHRSALDSIKKWYLVSKGTEGGSEMWNDDESFFAWKDDSKNYENYLEELKAERVSNWFSHLAESSDVKALPNGLSLLLNKMNPLKREQVIDGLRQLLG

SEQ ID NO: 10497 - DNA, 1059 bp, Sorghum bicolor
  misc_feature: Ceres ANNOT ID no. 6113503
  misc_feature: Encodes the peptide sequence at SEQ ID NO 10498
atgtctcggagctgcagcatgacgccgacgtcgtcgccaccgctcgtcgtcgtccgcctccttgcgtcggccgtggcgacgatgctggtgctcgcgtccggcggcggcgtttgcgacggcgccgcgctgaaggcgcacttctaccggcgcagctgccccgcggcggaggctgtggtccgcgacatcgtggtggcgcgcgtcgccgccgaccccgccgcgctccccgccaagctgctccgcctcttcttccacgactgcttcgtcagggggtgcgacgcgtcggtgctgctggactcgacggcggggaacacggcggagaaggacgcggcgccgaacgggtcgctgggaggcttcgacgtgatcgacacggcgaaggccgtgctggaggccatctgcccaggcaccgtctcctgcgccgacatcgtggcgctcgccgccagggacgccgtgtcgctgcagctcgggcgggacctgtgggacgtgcagctggggcggcgcgacggcgtggtgtcgcgggcgtcggaggcgctggccgacatcccttcgccgtcggacaacttcaccaccctcgaggccagattcggcagcaaaggcctcgacgtcaaggacctcgtcatcctctcaggcgcgcacacgatcggcgtggcccactgcaacaccttcgcgtcacgcctctccggcttcggcagctccaactccggcgccgacccgacgctgaacgcggcgtacgcggcgcagctccggtcgcggtgcggtccggcgccggtggcctcgtcgaacaacgtgacggcggtgaccatggacccgggaagccccgcggggcggttcgacgcgcactactacgtgaacctgaagctggggcggggcctgttcgcgtccgacgccgcgctgctcgccgaccgccgcgccgccgccatgatccaccgcctcaccaggaagggctacttcctccaggagttcaggaacgccgttcgcaagatggggcgcgtcggcgtgcgcaccggcggccgcggggagatccgccggaactgcagggcggtcaactcagatgctatgtga

SEQ ID NO: 10498 - protein, 352 aa, Sorghum bicolor
  misc_feature: Ceres ANNOT ID no. 6113503
  misc_feature (59)..(313): Pfam Id: peroxidase Pfam Desc: Peroxidase
  misc_feature (14)..(348): NCBI GI: 55701143 NCBI Desc: tpa: class iii peroxidase 138 precursor [oryza sativa (japonica cultivar-group)]
  misc_feature (20)..(349): NCBI GI: 50261255 NCBI Desc: cbrci35 [capsella bursa-pastoris]
  misc_feature (44)..(348): NCBI GI: 575605 NCBI Desc: cationic peroxidase isozyme 40k precursor [nicotiana tabacum]
  misc_feature (20)..(348): NCBI GI: 575603 NCBI Desc: cationic peroxidase isozyme 38k precursor [nicotiana tabacum]
  misc_feature (14)..(349): NCBI GI: 55700915 NCBI Desc: tpa: class iii peroxidase 24 precursor [oryza sativa (japonica cultivar-group)]
  misc_feature (43)..(348): SWISSPROT Homolog: EC 1.11.1.7 Peroxidase 24 precursor
  misc_feature: Useful for making plants with altered cell wall content and/or composition
  misc_feature: Functional homolog of the protein sequence encoded by LOCUS at1g05260
  misc_feature: Functional homolog of the protein sequence encoded by LOCUS at2g39040
  misc_feature: Useful for making plants with altered carbohydrate content
  misc_feature: Functional homolog of the protein sequence given in SEQ ID NO 13626
MSRSCSMTPTSSPPLVVVRLLASAVATMLVLASGGGVCDGAALKAHFYRRSCPAAEAVVRDIVVARVAADPAALPAKLLRLFFHDCFVRGCDASVLLDSTAGNTAEKDAAPNGSLGGFDVIDTAKAVLEAICPGTVSCADIVALAARDAVSLQLGRDLWDVQLGRRDGVVSRASEALADIPSPSDNFTTLEARFGSKGLDVKDLVILSGAHTIGVAHCNTFASRLSGFGSSNSGADPTLNAAYAAQLRSRCGPAPVASSNNVTAVTMDPGSPAGRFDAHYYVNLKLGRGLFASDAALLADRRAAAMIHRLTRKGYFLQEFRNAVRKMGRVGVRTGGRGEIRRNCRAVNSDAM

SEQ ID NO: 10499 - DNA, 2094 bp, Sorghum bicolor
  misc_feature: Ceres ANNOT ID no. 6113507
  misc_feature: Encodes the peptide sequence at SEQ ID NO 10500
atggcgctgagtggggatccgttcagatctgccgtgataacaaatgtttgtaatgctgcaaacgcacctgaagaaaataggcttgctggtgacagcaacaccatttcagaaaatgcccaggaatcattgagttccttaccagaacaagagtcaaatgatgctagtgttaacacagaaaagaaagaacctggcatttcaaaatgcaaatcggtggaagaaataccaaaaacagtgaccataaagaggtgcaagaacattgattcaaagaaagtctccttgaataacaataataatccaagctttactggcagtccagctctgaaaaagcagccgacaaaggggggccaactttttcaactacatgaaaatggaatgtctcaagacacaaagcctcctagcacaaggatatgcataaattcagcatgcaaagctgtcttcaactcagataatgcattttgtaagaggtgttcatgttgtatttgccatggttttgatgataacaaagatcctagcctttggctggtatgctcatcagagactggtgatcaggattgctgtggatcatcctgccacattgagtgcgcactcaagcaccgaaaggcaggatgcatagaacttggacaatctatacagcttgatggtaactactgctgtgctgcatgtggcaaggttattggaatactggggttctggaagaggcagctggtagttgctaaagatgcccgtagagttgataatctctgttcccgcatatatctgagtcatagacttttggatggcacaactcgttttaaagagttgcatcagattgtagaggatgcaaaagcaaagttggaaagtgaagttggcccccttgatggtacgtcatccaagatggctcgtggtattgtaggccggctgcctgttgctgctgatgtgcagaaactttgctctttagcaattgaaaaagctgatgagtgtcttagttcaaacattcaatctgaaacaaaacaaaatgatacactcccatctgcctgcaggtttaaatttgaagatattacagcttcatctttggtgttggttctgaaggaagctgtttcctcacagtatcatactatcaaaggctataaactctggtactggaatagcagagaagcaccttacacaggggagcctgctgttttccccaaagaccaaagaaggattcttatatccaatctgcagccctgcacagagtactccttccgcattatttcatttactgaggatggtgaactgggccattctgaatcgaagatctttaccaagagtgtggaaattattcataagaacacagagcatggagcagaaggttgctcatcttctgccaaaagagttggtaagagacaaaatgttaggtcattaggcttccaggtgcgtcagctgggtaatgtattccgaaaagcacaaactgaggaaaatggttaccccaatgcactgtgtaaagatgagattgaagattcatgtgatcagagtgattctttgataccagataaggaccaggttccacgtggtgcctcccgcaagctcaatctgaatgagacctcagtcccagacctaaatgcagaggtagtcatgccaacagagtgctgtcagattgagaacggctgtagttctggaaagaatgcattcacaaagtcgaatggttgtggtgactctgaaacttgtgcggaggggcatgtaggggatgcaccagccatggaatcccggtctcagagtcgcaagcaggcatcagatttggagcaggagacctgtgttgatgatagcaatttggtggcccgtgctgctaggctcttcgccccgaagttaggccagttagatgacaactatgagtactgtgtgaagattatacgttggttggaatgttccggcctcattgagaaggatttcaggatgaaatttctaacctggttcagtttgagatcgacagagcaggagcggagagttgttatcaccttcatccgcaccctcattgatgaaccgagtagtttggctgcgcagcttttggattcctttgaagaaattgttaccagtaagaggctaagaactggtttctgtactaagttgtggcactaa

SEQ ID NO: 10500 - protein, 697 aa, Sorghum bicolor
  misc_feature: Ceres ANNOT ID no. 6113507
  misc_feature (5)..(697): NCBI GI: 116563005 NCBI Desc: vil1 protein [triticum monococcum subsp. aegilopoides]
  misc_feature (5)..(697): NCBI GI: 116563079 NCBI Desc: vil1 protein [triticum monococcum subsp. monococcum]
  misc_feature (76)..(697): NCBI GI: 116562979 NCBI Desc: vil3 protein [triticum monococcum subsp. aegilopoides]
  misc_feature (76)..(697): NCBI GI: 116563056 NCBI Desc: vil3 protein [triticum monococcum subsp. monococcum]
  misc_feature (32)..(484): NCBI GI: 92882107 NCBI Desc: fibronectin, type iii-like fold [medicago truncatula]
MALSGDPFRSAVITNVCNAANAPEENRLAGDSNTISENAQESLSSLPEQESNDASVNTEKKEPGISKCKSVEEIPKTVTIKRCKNIDSKKVSLNNNNNPSFTGSPALKKQPTKGGQLFQLHENGMSQDTKPPSTRICINSACKAVFNSDNAFCKRCSCCICHGFDDNKDPSLWLVCSSETGDQDCCGSSCHIECALKHRKAGCIELGQSIQLDGNYCCAACGKVIGILGFWKRQLVVAKDARRVDNLCSRIYLSHRLLDGTTRFKELHQIVEDAKAKLESEVGPLDGTSSKMARGIVGRLPVAADVQKLCSLAIEKADECLSSNIQSETKQNDTLPSACRFKFEDITASSLVLVLKEAVSSQYHTIKGYKLWYWNSREAPYTGEPAVFPKDQRRILISNLQPCTEYSFRIISFTEDGELGHSESKIFTKSVEIIHKNTEHGAEGCSSSAKRVGKRQNVRSLGFQVRQLGNVFRKAQTEENGYPNALCKDEIEDSCDQSDSLIPDKDQVPRGASRKLNLNETSVPDLNAEVVMPTECCQIENGCSSGKNAFTKSNGCGDSETCAEGHVGDAPAMESRSQSRKQASDLEQETCVDDSNLVARAARLFAPKLGQLDDNYEYCVKIIRWLECSGLIEKDFRMKFLTWFSLRSTEQERRVVITFIRTLIDEPSSLAAQLLDSFEEIVTSKRLRTGFCTKLWH

SEQ ID NO: 10501 - DNA, 2094 bp, Sorghum bicolor; identical to SEQ ID NO: 10499
  misc_feature: Ceres ANNOT ID no. 6113509
  misc_feature: Encodes the peptide sequence at SEQ ID NO 10502

SEQ ID NO: 10502 - protein, 697 aa, Sorghum bicolor; identical to SEQ ID NO: 10500
  misc_feature: Ceres ANNOT ID no. 6113509
  misc_feature (5)..(697): NCBI GI: 116563005 NCBI Desc: vil1 protein [triticum monococcum subsp. aegilopoides]
  misc_feature (5)..(697): NCBI GI: 116563079 NCBI Desc: vil1 protein [triticum monococcum subsp. monococcum]
  misc_feature (76)..(697): NCBI GI: 116562979 NCBI Desc: vil3 protein [triticum monococcum subsp. aegilopoides]
  misc_feature (76)..(697): NCBI GI: 116563056 NCBI Desc: vil3 protein [triticum monococcum subsp. monococcum]
  misc_feature (32)..(484): NCBI GI: 92882107 NCBI Desc: fibronectin, type iii-like fold [medicago truncatula]

SEQ ID NO: 10503 - DNA, 1317 bp, Sorghum bicolor
  misc_feature: Ceres ANNOT ID no. 6113517
  misc_feature: Encodes the peptide sequence at SEQ ID NO 10504
atggaaaaactgctacctgaagatgtactcaccaacatcatttgccgtcttgcaccacgctatgttgctatatcccgttgcgtctgcaagacctggtgtgccatcattgatgcccgcaaccttctgcgtgcggacctcctcccacgctcagtgcgtggaatattcattaacttcaatgagttaagcatgtcagaattcttcgtccgcccctcaaaaggccgaacggtatctggcaactttaactatttgcctcttgggtcccgcatcataggccactgcaatgggcttctcttgttttgcaactatgtgattaacccagccacacggcagtcagctccactgcccccatgcacaagcccaaatattgtcatagagcactttgtttgcagagactaccttgtatttgacccccaattgtcaccacattatgaggtattcatgatccctcaggtccgatgctatgggaggtatgaaatgttgaattctgatgatgaattagaccctgcaatggagggattagaatggccaccatcaccttggatcctgaacgtgttctcatcaaggacaaagatgtggcaggagaggtcatttgttcgagaaggggaggctgcagggaatgttgctgacaggcggttggattcttcatgtgttcaggacaactctgtctattggcggggagtactttatgtaaattgccaaaccaagtttgttatgagaatatccttgtcaaatggaaaataccaagtaatcaagccacctgtatattttgaaaggatggaatgcacagatctttatctgggaaaatcagtgaaaggagtgcactgtgctttatatggctttccatccagtttttggatttatattcttgatgaatcgagtggaagaatggagtgggtattcaagcattcctgtgatattcagccatatcaaagaatcgatgggcgtggaccctggactttacaagatattaactgtcaggactggtccaatgaatttgaagagggtaaggatgaggcactggtacaggagaagtttgaatgggactcggacaatgataatgttattgacaccataagcaggggcaatcatctgactcgtggtgatattacttttctcggatttcacccttacaaggaggttgtcttcttgagtgacacattaagacgaggattggcgtaccacttaaatagctcaaagattcaagacttgggcaatatccatccaacatattatgaaatagagacgggtattcagccatttatacaggcgtcttttccatacacaccctggacgggagtgtttccggaagacaattaa

SEQ ID NO: 10504 - protein, 438 aa, Sorghum bicolor
  misc_feature: Ceres ANNOT ID no. 6113517
  misc_feature (4)..(47): Pfam Id: F-box Pfam Desc: F-box domain
  misc_feature (1)..(438): NCBI GI: 115456876 NCBI Desc: os04g0113000 [oryza sativa (japonica cultivar-group)]
  misc_feature (1)..(438): NCBI GI: 116308824 NCBI Desc: osigba0112g01.1 [oryza sativa (indica cultivar-group)]
  misc_feature (5)..(420): NCBI GI: 53370641 NCBI Desc: f-box domain containing protein [oryza sativa (japonica cultivar-group)]
  misc_feature (1)..(323): NCBI GI: 57900269 NCBI Desc: f-box domain containing protein-like [oryza sativa (japonica cultivar-group)]
  misc_feature (1)..(323): NCBI GI: 115440773 NCBI Desc: os01g0824700 [oryza sativa (japonica cultivar-group)]
  misc_feature: The sequence is a functional homolog of SEQ ID NO. 456 in the 11/188,298 US application
MEKLLPEDVLTNIICRLAPRYVAISRCVCKTWCAIIDARNLLRADLLPRSVRGIFINFNELSMSEFFVRPSKGRTVSGNFNYLPLGSRIIGHCNGLLLFCNYVINPATRQSAPLPPCTSPNIVIEHFVCRDYLVFDPQLSPHYEVFMIPQVRCYGRYEMLNSDDELDPAMEGLEWPPSPWILNVFSSRTKMWQERSFVREGEAAGNVADRRLDSSCVQDNSVYWRGVLYVNCQTKFVMRISLSNGKYQVIKPPVYFERMECTDLYLGKSVKGVHCALYGFPSSFWIYILDESSGRMEWVFKHSCDIQPYQRIDGRGPWTLQDINCQDWSNEFEEGKDEALVQEKFEWDSDNDNVIDTISRGNHLTRGDITFLGFHPYKEVVFLSDTLRRGLAYHLNSSKIQDLGNIHPTYYEIETGIQPFIQASFPYTPWTGVFPEDN

SEQ ID NO: 10505 - DNA, 732 bp, Sorghum bicolor
  misc_feature: Ceres ANNOT ID no. 6113528
  misc_feature: Encodes the peptide sequence at SEQ ID NO 10506
atggaggcgctccggatcgcggaggcggagctcacggtgtacgtgcacccctccaacgccaagcgcgtccggcacgccgtcaaccgccagctcagctcgctcctcttcacgtatgacgaccgttttaatggcgtggtgctgatgcatgaagttgcattccatcttggccaaggcaatgagggcgaacccaacaaagatgaaagtggtggacccaaagatgaaagtggtgagcccaaatcttgtgcccaactgctgctcttctctccacaaccggacatgatccttgaagggaaggttgaaatgcttggaaaggagtcaatccatgccattgtattagggcttttctcagtggcaattatgtctgaagatattcatgaaaagttcagattcaaaaggaaaagtgatagagggaaatatgtgagccgcacagataaacatcatgtgattaaaagaggaacaatgataaggttttctgtcaaaagggtggatacagaaatgaattgtcatattactggatctttaatcccacctcacactggatgcatgcgttggttgtcagtacatgacactgaatatgcatcagaactcaaaagtggtgaaagtagaccaagggatacaagcatcaaatttgagcagaatgaacaagaacacagaatactcaagaatgaagatggcatggtgaaatctgaacggccacataagtcccgaaagaggcggcacactgaggaatga

SEQ ID NO: 10506 - protein, 243 aa, Sorghum bicolor
  misc_feature: Ceres ANNOT ID no. 6113528
  misc_feature (1)..(243): NCBI GI: 115466650 NCBI Desc: os06g0168400 [oryza sativa (japonica cultivar-group)]
  misc_feature (1)..(196): NCBI GI: 115488876 NCBI Desc: os12g0533600 [oryza sativa (japonica cultivar-group)]
  misc_feature (1)..(161): NCBI GI: 55296227 NCBI Desc: rna polymerase rpa43 subunit-like [oryza sativa (japonica cultivar-group)]
  misc_feature (84)..(203): NCBI GI: 140054303 NCBI Desc: nucleic acid-binding, ob-fold [medicago truncatula]
  misc_feature (83)..(209): NCBI GI: 9369364 NCBI Desc: f10a5.14 [arabidopsis thaliana]
MEALRIAEAELTVYVHPSNAKRVRHAVNRQLSSLLFTYDDRFNGVVLMHEVAFHLGQGNEGEPNKDESGGPKDESGEPKSCAQLLLFSPQPDMILEGKVEMLGKESIHAIVLGLFSVAIMSEDIHEKFRFKRKSDRGKYVSRTDKHHVIKRGTMIRFSVKRVDTEMNCHITGSLIPPHTGCMRWLSVHDTEYASELKSGESRPRDTSIKFEQNEQEHRILKNEDGMVKSERPHKSRKRRHTEE

SEQ ID NO: 10507 - DNA, 429 bp, Sorghum bicolor
  misc_feature: Ceres ANNOT ID no. 6113556
  misc_feature: Encodes the peptide sequence at SEQ ID NO 10508
atggcgcactccctcgccgcttccttctcgccggccgccgccgccgcccggcgccaggtgacaaatgtgatttcaagccggagctcggtttccttccagagccacaggatgacttctgtatccatccgttcaagaccaagttctcttcggtttaagatttgctgttcggctaagaaagagacagtcgacaaggtttgtagtatagtgaagcagcagctggctcttcccgatggtactgctctcaccggcgaatcaaaattcgctgaacttggtgctgattcactggatacggttgagattgtgatgggcctcgaggaggcattcaacataactgtcgacgaaactagtgcacaggacatcgcaacggtgcaggatgcggcggaccttattgagaagcttatgcaggaggcacctccaaaggtcgtctag

SEQ ID NO: 10508 - protein, 142 aa, Sorghum bicolor
  misc_feature: Ceres ANNOT ID no. 6113556
  misc_feature (63)..(130): Pfam Id: PP-binding Pfam Desc: Phosphopantetheine attachment site
  misc_feature (1)..(136): NCBI GI: 113165 NCBI Desc: acyl carrier protein i, chloroplast precursor (acp i)
  misc_feature (1)..(136): NCBI GI: 166967 NCBI Desc: acyl carrier protein i
  misc_feature (1)..(136): NCBI GI: 1838961 NCBI Desc: acyl carrier protein [casuarina glauca]
  misc_feature (7)..(134): NCBI GI: 113169 NCBI Desc: acyl carrier protein ii, chloroplast precursor (acp ii)
  misc_feature (6)..(136): NCBI GI: 2465010 NCBI Desc: acyl carrier protein [fragaria vesca]
MAHSLAASFSPAAAAARRQVTNVISSRSSVSFQSHRMTSVSIRSRPSSLRFKICCSAKKETVDKVCSIVKQQLALPDGTALTGESKFAELGADSLDTVEIVMGLEEAFNITVDETSAQDIATVQDAADLIEKLMQEAPPKVV

SEQ ID NO: 10509 - DNA, 1494 bp, Sorghum bicolor
  misc_feature: Ceres ANNOT ID no. 6113558
  misc_feature: Encodes the peptide sequence at SEQ ID NO 10510
atggcgggtgcggaggggagagggccgaggcgaagccgcgtggcgttcgtgctggtggacgggatcggggacgtgagcatcccgtcgctgggcgggcgcacgccgctggaggcggcgtgcgcgccgcggctggacgcggtggcggcggccggggtgaccgggctcatggaccccgtggagcctgggctcgcctgtggcagcgacacggcgcacctatccctcctcgggtacgacccacgggtgtactaccgcggccgcggcgcgttcgagtccatgggcgccgggttggccatggcgcctggcgacatcgccttcaagtcaaactttgctacactggatgagaacaccggagttatcgtcagcaggagggcggatcggcattttgaagaggaaggccctatcctctgcgctgcgttggatgggatgaagcttccctcgtttcctgagtatgaagtcagagtaaggtatgctactgagcacagatgtggtgtggttgtcaaaggaccaaagctgagtgggaacatttctggaaccgatcccttgaaggacaaccgcttgcatctgaaggctgaaccgctggatgactcagaagaagctaaaaacactgcagctgtggtcaacgagctttctaaggagattacacgcatactggtttcccaccccatcaacgcaaagcgtgcagctgaggggaagaacatcgcgaatgttgtgctgttgcgaggctgtggtatccgaattgaggtgcctgcctttgaaaccaagcatggacttgcaccatgcatggttgctccaactaagatcatagctggcctggggctatcactggggattgatatccttgaagcacctggagcaactggagattatcgtactcacctaacttctaaagctaaagctatagccaaggcactctctgcccctatggatacaccacctcgtgtttttgtgcctggagaggatgaatataaagctggaagagaaaatggatatgactttgggttcctgcacataaaggccattgatgatgctggtcatgataaggctgtcaagttaaaggtacggggtctagaagctgttgatcgagctattggtcagcttgcaaggcttctttgggaagctgaaaaagccggacactaccagtactttctttgtgtcaccggagaccattctactcctgttgaatatggtgatcatagcttcgaacccgtcccatttgcaatatgcagactcagagattatgcagcagccattggggaggataatgttataaatacacaacttgatgatttccccctcccttcagtaaaatccggagaagatttgcttgacgatatagaatcaccggagcgcaagcctgatcaactcaaagctttcagtggtgatgctgtgtgtgagttcaacgaggttgccactgcaaggggctgccttggacgattccctggaagtgagatgatgggcatcatcaagaagtttatcaaggcgaagaatgattaa

SEQ ID NO: 10510 - protein, 497 aa, Sorghum bicolor
  misc_feature: Ceres ANNOT ID no. 6113558
  misc_feature (311)..(424): Pfam Id: Metalloenzyme Pfam Desc: Metalloenzyme superfamily
  misc_feature (12)..(331): NCBI GI: 28828261 NCBI Desc: similar to arabidopsis thaliana (mouse-ear cress). phosphonopyruvate decarboxylase-like protein [dictyostelium discoideum]
  misc_feature (41)..(407): NCBI GI: 74025296 NCBI Desc: 2,3-bisphosphoglycerate-independent phosphoglycerate mutase-like protein [trypanosoma brucei]
  misc_feature (12)..(395): NCBI GI: 123438184 NCBI Desc: metalloenzyme superfamily protein [trichomonas vaginalis g3]
  misc_feature (17)..(341): NCBI GI: 15679586 NCBI Desc: phosphonopyruvate decarboxylase [methanothermobacter thermautotrophicus str. delta h]
  misc_feature (13)..(304): NCBI GI: 20454816 NCBI Desc: 2,3-bisphosphoglycerate-independent phosphoglycerate mutase (phosphoglyceromutase) (bpg-independent pgam) (apgam)
MAGAEGRGPRRSRVAFVLVDGIGDVSIPSLGGRTPLEAACAPRLDAVAAAGVTGLMDPVEPGLACGSDTAHLSLLGYDPRVYYRGRGAFESMGAGLAMAPGDIAFKSNFATLDENTGVIVSRRADRHFEEEGPILCAALDGMKLPSFPEYEVRVRYATEHRCGVVVKGPKLSGNISGTDPLKDNRLHLKAEPLDDSEEAKNTAAVVNELSKEITRILVSHPINAKRAAEGKNIANVVLLRGCGIRIEVPAFETKHGLAPCMVAPTKIIAGLGLSLGIDILEAPGATGDYRTHLTSKAKAIAKALSAPMDTPPRVFVPGEDEYKAGRENGYDFGFLHIKAIDDAGHDKAVKLKVRGLEAVDRAIGQLARLLWEAEKAGHYQYFLCVTGDHSTPVEYGDHSFEPVPFAICRLRDYAAAIGEDNVINTQLDDFPLPSVKSGEDLLDDIESPERKPDQLKAFSGDAVCEFNEVATARGCLGRFPGSEMMGIIKKFIKAKND

SEQ ID NO: 10511 - DNA, 624 bp, Sorghum bicolor
  misc_feature: Ceres ANNOT ID no. 6113565
  misc_feature: Encodes the peptide sequence at SEQ ID NO 10512
atgaagcggcagccaccacacgctcgcggcggcggcggcggcggcgacgcgccggtcggcgagggcggaagcggaagcggcggagggtttaagaaggggaagggacaagggaggtggggcggcgggagtcggaggcggaacgagcagcggctgggcgtcggcggcggcggggcgctatccctcgctgcattcgccagcgccaagtcccggagcaccggctacaacccggcccttatcaagaagcaaagggagttctacaagaatgctaaattaattagcaagtacaaaaagacaaagaagcaacaaagtcagtcaaacaaccgtccagaaattccaatccatgaggatggtggtgacactgcccaagatgtgccaaaggcacatcataaagggaagaagcgcattgcgcatagtttgaaggaagagtatgagaagaaatgcgcagaggatgagaaagctaagaaagagcgggatgcagaaattcaggcgaagagggaacatcgggagaagtctgaggcaaagcggaaagaactgagggagaagatgttcaagaagacaaggtctggacaacctgtgatgagataccggatcgagcatctcttggagactgcattaagcaaataa

SEQ ID NO: 10512 - protein, 207 aa, Sorghum bicolor
  misc_feature: Ceres ANNOT ID no. 6113565
  misc_feature (96)..(202): NCBI GI: 74633372 NCBI Desc: protein fyv7
  misc_feature (10)..(199): NCBI GI: 30526291 NCBI Desc: latency associated nuclear antigen [saimiriine herpesvirus 2]
  misc_feature (2)..(57): NCBI GI: 10303243 NCBI Desc: nona protein [drosophila virilis]
  misc_feature (91)..(201): NCBI GI: 2408090 NCBI Desc: spac8c9.07 [schizosaccharomyces pombe]
  misc_feature (2)..(57): NCBI GI: 16554779 NCBI Desc: no on or off transient a [drosophila virilis]
MKRQPPHARGGGGGGDAPVGEGGSGSGGGFKKGKGQGRWGGGSRRRNEQRLGVGGGGALSLAAFASAKSRSTGYNPALIKKQREFYKNAKLISKYKKTKKQQSQSNNRPEIPIHEDGGDTAQDVPKAHHKGKKRIAHSLKEEYEKKCAEDEKAKKERDAEIQAKREHREKSEAKRKELREKMFKKTRSGQPVMRYRIEHLLETALSK

SEQ ID NO: 10513 - DNA, 879 bp, Sorghum bicolor
  misc_feature: Ceres ANNOT ID no. 6113567
  misc_feature: Encodes the peptide sequence at SEQ ID NO 10514
atggggggagcgcagttcctcggcgacaacgacgtcgtcgcggcccgcgacggggaggcggtggaccaccgccgcgacgtcggcaagatggagcacgggtgcgagcattaccggcgcaggtgcaagatcgtggcgccgtgctgcaaccaggtgttcccctgccgccactgccacaacgaggctacggcttctggagatcggcatacaatagttcgtcaggatgttaaaaaagtagtttgcctactctgtgaaacagaacagccggtgtcacaagtgtgcataagctgtggagtcaatatgggagagtacttctgtgatatatgcaaattttatgatgatgatatagggaaagggcagtaccattgcaatgattgtggcatatgcagggttggtggcaaggaaaaattcttccactgtgtaaagtgtgggtcttgctattctgttgaactgcgtgataaccatcggtgcgtggagaactcaatgaggcagaattgcccaatctgttatgagtatctatttgactcattacaaggaacaagagttcttaactgtggacacacaatgcacttgacatgttttgaagagatggtggagcataacaaatacacttgtccaatatgctctaaaacagctcttgatatgacacgtcattgggagatgttggatcaagagatcgaagccacaatcatgcctcctgtatatcggtacaagatttgggtgctttgcaacgactgcaacaaggtctcagaggtgaacttccatgtgatcggccacaagtgcagccactgcagctcgtacaacacccgatcaacatcgcgccctgcagattcatcgggaagcagctcaccttcgacagactcatccgacaacaacatgtag

SEQ ID NO: 10514 - protein, 292 aa, Sorghum bicolor
  misc_feature: Ceres ANNOT ID no. 6113567
  misc_feature (34)..(112): Pfam Id: zf-CHY Pfam Desc: CHY zinc finger
  misc_feature (165)..(207): Pfam Id: zf-C3HC4 Pfam Desc: Zinc finger, C3HC4 type (RING finger)
  misc_feature (1)..(276): NCBI GI: 79456855 NCBI Desc: protein binding / ubiquitin-protein ligase/ zinc ion binding [arabidopsis thaliana]
  misc_feature (11)..(276): NCBI GI: 30102616 NCBI Desc: at3g62970 [arabidopsis thaliana]
  misc_feature (26)..(282): NCBI GI: 21593716 NCBI Desc: pgpd14 protein [arabidopsis thaliana]
  misc_feature (26)..(282): NCBI GI: 10177239 NCBI Desc: pgpd14 protein [arabidopsis thaliana]
  misc_feature (26)..(281): NCBI GI: 4105798 NCBI Desc: pgpd14 [petunia x hybrida]
  misc_feature: The sequence is a functional homolog of SEQ ID NO. 468 in the 11/188,298 US application
  misc_feature: The sequence is a functional homolog of SEQ ID NO. 350 in the 11/188,298 US application
  misc_feature: The sequence is a functional homolog of SEQ ID NO. 271 in the 11/188,298 US application
  misc_feature: The sequence is a functional homolog of SEQ ID NO. 329 in the 11/188,298 US application
MGGAQFLGDNDVVAARDGEAVDHRRDVGKMEHGCEHYRRRCKIVAPCCNQVFPCRHCHNEATASGDRHTIVRQDVKKVVCLLCETEQPVSQVCISCGVNMGEYFCDICKFYDDDIGKGQYHCNDCGICRVGGKEKFFHCVKCGSCYSVELRDNHRCVENSMRQNCPICYEYLFDSLQGTRVLNCGHTMHLTCFEEMVEHNKYTCPICSKTALDMTRHWEMLDQEIEATIMPPVYRYKIWVLCNDCNKVSEVNFHVIGHKCSHCSSYNTRSTSRPADSSGSSSPSTDSSDNNM

SEQ ID NO: 10515 - DNA, 318 bp, Sorghum bicolor
  misc_feature: Ceres ANNOT ID no. 6113570
  misc_feature: Encodes the peptide sequence at SEQ ID NO 10516
atggagcgcgtgatgaagatcgcatcggagcgtgcggtggtggtgttcacgctgagcagctgctgcatgtgccacacggtgacgcagctcatggcggaccagctgagcgtgaacgcgctggtgcacgagctggacagcgaccccaggggcaaggacatggagcgcgccctgctcaagatgctcggcgggagaggccccgccgtgcccgccgtcttcatcggcggcaagctcgtcggcggcaccaacagggtcatgtcgctccacctcgccggcgagctcgtgcccatgctcaagagcgccggcgcgctctggttgtag

SEQ ID NO: 10516 - protein, 105 aa, Sorghum bicolor
  misc_feature: Ceres ANNOT ID no. 6113570
  misc_feature (13)..(78): Pfam Id: Glutaredoxin Pfam Desc: Glutaredoxin
  misc_feature (1)..(105): NCBI GI: 119370624 NCBI Desc: glutaredoxin-c10
  misc_feature (1)..(89): NCBI GI: 115488910 NCBI Desc: os12g0538600 [oryza sativa (japonica cultivar-group)]
  misc_feature (1)..(105): NCBI GI: 102139809 NCBI Desc: glutaredoxin family protein [musa acuminata]
  misc_feature (1)..(105): NCBI GI: 75326792 NCBI Desc: glutaredoxin-c1 precursor
  misc_feature (1)..(105): NCBI GI: 102139810 NCBI Desc: glutaredoxin family protein [musa acuminata]
  misc_feature: Useful for making plants with altered protein content
  misc_feature: Functional homolog of the protein sequence given in SEQ ID NO 13359
  misc_feature: The sequence is a functional homolog of SEQ ID NO. 382 in the 11/188,298 US application
MERVMKIASERAVVVFTLSSCCMCHTVTQLMADQLSVNALVHELDSDPRGKDMERALLKMLGGRGPAVPAVFIGGKLVGGTNRVMSLHLAGELVPMLKSAGALWL

SEQ ID NO: 10517 - DNA, 318 bp, Sorghum bicolor
  misc_feature: Ceres ANNOT ID no. 6113605
  misc_feature: Encodes the peptide sequence at SEQ ID NO 10518
atggagcgtgtgatgcagctggcgtcggagcatggggtggttgagttcacgctgagcagctgctacatgtgccgcgcggtgaggctgatgatggcggagctgagcgtgaacgcgcgggtgcacgagctggacagcgaccccaggggcaaggacatggagcgcgccctgctcaagatgctcggcggcggcagggaccccgccgtgcccgccgtcttcatcagcggcaagctcgtcggcggcatcgtcagcgtcatgtcgctccacctagccggcgagctcgtgcccatgctcgtgaaatctggcatgtttttggaataa

SEQ ID NO: 10518 - protein, 105 aa, Sorghum bicolor
  misc_feature: Ceres ANNOT ID no. 6113605
  misc_feature (13)..(78): Pfam Id: Glutaredoxin Pfam Desc: Glutaredoxin
  misc_feature (1)..(101): NCBI GI: 119370624 NCBI Desc: glutaredoxin-c10
  misc_feature (1)..(101): NCBI GI: 102139809 NCBI Desc: glutaredoxin family protein [musa acuminata]
  misc_feature (1)..(89): NCBI GI: 115488910 NCBI Desc: os12g0538600 [oryza sativa (japonica cultivar-group)]
  misc_feature (1)..(101): NCBI GI: 75326792 NCBI Desc: glutaredoxin-c1 precursor
  misc_feature (2)..(101): NCBI GI: 77552326 NCBI Desc: glutaredoxin [oryza sativa (japonica cultivar-group)]
  misc_feature: Useful for making plants with altered protein content
  misc_feature: Functional homolog of the protein sequence given in SEQ ID NO 13359
  misc_feature: Useful for making plants with altered protein content
  misc_feature: Functional homolog of the protein sequence given in SEQ ID NO 13359
  misc_feature: The sequence is a functional homolog of SEQ ID NO. 382 in the 11/188,298 US application
MERVMQLASEHGVVEFTLSSCYMCRAVRLMMAELSVNARVHELDSDPRGKDMERALLKMLGGGRDPAVPAVFISGKLVGGIVSVMSLHLAGELVPMLVKSGMFLE

SEQ ID NO: 10519 - DNA, 2079 bp, Sorghum bicolor
  misc_feature: Ceres ANNOT ID no. 6113619
  misc_feature: Encodes the peptide sequence at SEQ ID NO 10520
atgtttggtttctcgcggcgacggggaaaacttggaaggtcgaagggtgacccaagtgattctttgaacagctctaggagtcctgttggccccagtaaacacctcagcctgcccaatgtatatgatgcagttatgacatcagtgagtggcggtgcagatgatctttccaaccgctgctcgtccgatacctttgatcctgatggacgcactttcaatatttcagaaaattggactgtgctgtccacagaggggaataaacctactcctcgtttctatcatgcagcagccattgtaagtagcaagatggtagtgtttggtggtgattctggtcaacgcttattagatgacacaaagatactgaatttagagaagcttacttgggattctgcgcctcctaaagtttgcccatcaccaagcggacgttcaatgaagttgccagcctgcaaaggtcattgtctggttccatggggaaatagtgtcattcttgttgggggtaaaactgagcctgcttctgatcgtttatcagtatggactttcaatacagaaacggagctttggtcacttatagaagccaagggtgatatccctgcagctcgaagtggccacaccgtgattagagctggtgctacattgatactttttggcggtgaggacacaaaaggaaagaaacggcatgacctgcacatgtttgatctaaagtcatcaacctggcttccattgaactataaaggcactggaccttctccaagatccaatcatgtcgctacactgtatgatgataagatccttctaatttttggaggccactcaaaatccaagacacttaatgacttgtattccttagattttgatacaatggtatggtcaagagtgaagactcatggtcctcacccatcacctcgagctggttgcagcggaactctctgtggaactaagtggtacatagctggcggtgcaagcaagaaaaaacgacatgctgaaacctgggcttttgatgttctacaatctaagtggtctgtttgtgtagtaccccctagttcatcaattactacaaaaaaaggtttcagcatggttcctttctaccacagggacaagattgctcttattgcatttggagggaacaaaaaagagccatccaacaaggttgaagtattagtggtactgcaaaatgagcattcttttagttggcgttcagccccaccagaagtggaccgcgtgctgtatgagtattctccaagcaataaggagcttgctgatcatctcaacaaatgtgcccccttgtactctaacagttccatcgcaaggcatagtctcacttctgtgatagaacacccacctagaagggaacccctctctgagtcattgttgaagcagtccagtttgggcacttcactccatgggcagttggatcaagtagaagagtgcagcttaggtcagaaactgcagaaaccaatggatgatgacagatacgatgacgtcgatgactcttcttcatgtcaagatagaactccaaaagggcatcggagcaaaaggacaggacctggtattcagaatgacatagcagaaaatatagtgactggaggatcaaatgtgagaaggatagctagatgctcttcagatgttagtcagagccacttatacaacacaaaaatagcagacttaatcagaagaaacaccacgctcgaagaccagctttcgaccgcgctggcaagcaaagaccagctagagaagagcttatcgtcggtcattcacagcagagaacagctggagaagatgcttgccaacaaagacaaggaggctgagatgctgaaagagaagatagcatgcttagagctggcgcaggaagagtcgaacagcctctcgaacacggtgcacgctgataatgtgcgccttgaacgtgaagtggcattcctgaaggccgtcacagatgaaacccagaaggagctgcattccactcgtagggttttagcaggagaacagtcacgcgcgttccagctccaggttgaagtgttccatctcaagcagaggctgcaaatactggaggggagatcaggaacacccaccaaacaacctctatag

SEQ ID NO: 10520 - protein, 692 aa, Sorghum bicolor
  misc_feature: Ceres ANNOT ID no. 6113619
  misc_feature (249)..(295): Pfam Id: Kelch_2 Pfam Desc: Kelch motif
  misc_feature (89)..(134): Pfam Id: Kelch_2 Pfam Desc: Kelch motif
  misc_feature (89)..(134): Pfam Id: Kelch_1 Pfam Desc: Kelch motif
  misc_feature (249)..(295): Pfam Id: Kelch_1 Pfam Desc: Kelch motif
  misc_feature (1)..(692): NCBI GI: 77556542 NCBI Desc: rangap1 interacting protein [oryza sativa (japonica cultivar-group)]
  misc_feature (154)..(689): NCBI GI: 115486499 NCBI Desc: os11g0657000 [oryza sativa (japonica cultivar-group)]
  misc_feature (1)..(644): NCBI GI: 21950739 NCBI Desc: rangap1 interacting protein [arabidopsis thaliana]
  misc_feature (1)..(644): NCBI GI: 30686896 NCBI Desc: kelch repeat-containing protein [arabidopsis thaliana]
  misc_feature (55)..(385): NCBI GI: 42572263 NCBI Desc: acyl-coa binding family protein [arabidopsis thaliana]
  misc_feature: The sequence is a functional homolog of SEQ ID NO. 354 in the 11/188,298 US application
MFGFSRRRGKLGRSKGDPSDSLNSSRSPVGPSKHLSLPNVYDAVMTSVSGGADDLSNRCSSDTFDPDGRTFNISENWTVLSTEGNKPTPRFYHAAAIVSSKMVVFGGDSGQRLLDDTKILNLEKLTWDSAPPKVCPSPSGRSMKLPACKGHCLVPWGNSVILVGGKTEPASDRLSVWTFNTETELWSLIEAKGDIPAARSGHTVIRAGATLILFGGEDTKGKKRHDLHMFDLKSSTWLPLNYKGTGPSPRSNHVATLYDDKILLIFGGHSKSKTLNDLYSLDFDTMVWSRVKTHGPHPSPRAGCSGTLCGTKWYIAGGASKKKRHAETWAFDVLQSKWSVCVVPPSSSITTKKGFSMVPFYHRDKIALIAFGGNKKEPSNKVEVLVVLQNEHSFSWRSAPPEVDRVLYEYSPSNKELADHLNKCAPLYSNSSIARHSLTSVIEHPPRREPLSESLLKQSSLGTSLHGQLDQVEECSLGQKLQKPMDDDRYDDVDDSSSCQDRTPKGHRSKRTGPGIQNDIAENIVTGGSNVRRIARCSSDVSQSHLYNTKIADLIRRNTTLEDQLSTALASKDQLEKSLSSVIHSREQLEKMLANKDKEAEMLKEKIACLELAQEESNSLSNTVHADNVRLEREVAFLKAVTDETQKELHSTRRVLAGEQSRAFQLQVEVFHLKQRLQILEGRSGTPTKQPL

SEQ ID NO: 10521 - DNA, 2730 bp, Sorghum bicolor
  misc_feature: Ceres ANNOT ID no. 6113629
  misc_feature: Encodes the peptide sequence at SEQ ID NO 10522
atgtcgtcatcgtcgggccagcagcacgagaccggaccgccgccgccgacggcgttcaagagcgcgtccacggacggcaagagcggtagccgccggagcacgcggttcaaggacgaggacgagtacgtcgaggtcacgctcgacgtccgcgacgacggcggcggcgacgtcgccgtccgggccatcaaggacgtcgtccttgccggcggccccggcgtcttgggcgacgcgcaggacgccacggcgctcctggaccccccacccaccggctctgctgctgctgctgcctcggggggcctgtcgtccaagctcagggccgcgcgggcgcacctcggtcgcatcgcctcggtcaagcgcgccgccgtgccgctctcggcgctgctccgccgcgaccgcgaccgggaccgggaccgctccagcaggctcgacaggagcgtcgtcacgggcgccgccagcgcgctcaggggcctccagttcctcaaccaggccgccgtcaccgaggggtggaccgaggtggagaagcgcttccagcgcctcgccgtcgacggtttcctcctccgctcacgcttcggacagtgcattggcatggttggatccgaggagtttgccgcgcagatcttcgacgcacttgcacggcgaaggggcatcacagccatggtgctcaccaaggatcaggtccgggagttctgggagcagctctctgatcctggattcgatgccaaggttgacaagaatgctgatggtcagatcactgaagaggagctcaaagaggtcctcactttgaccgcctctgccaacaagctgtccaagatcctggagcgcgtcgacgagtacaccgcgctgatcatggaggagctcgatcccgacaacctcggctacatcgagctcgcgaacctggagtcgctgctgctgcagccggcgccggcgtcgacgtcgacgaggctggtgacgcacagctccaacaacatcagccagctgatcagccagaggctggcgccggcgcgcgacgacagcgcgctccgccgcgccgccatggcattcctctacttcatggaggacaactggaagcgcgtgtgggtgatgtcgctgtggctggccatcaacgcggcgctcttcgcctggaagttcgccgcgtaccgccgccacccgacgttcgacgtgatgggctactgcgtctgcgtcgccaagggcggcgccgagaccaccaagttcaacatggcgctcatcctgctccccgtctgccggaacaccatcacctggctccggtcccggacaagactcggcgccgccgtcccgttcaacgacaacatcaacttccacaaggtggtggccgggggcgtcgccgtcggcgtcgcgctgcacgctgtgacgcacctcacgtgcgacttcccgaggctgctgcacgccagcgccgccgcgtacgagcccatgaaggcctacttcggccagcgccggatcccggactactggtggttcgtcaggggcgtcgagggcgtcaccggcgtcatcatggtcgtgctcatggccgtcgcctacacgctggcgcacccgtggttccgccggggaaagctcagcgagggcaacccgctgcgccgcctcagcggcttcaacatgttctggtactcgcaccacctcttcgtcatcgtctacgtcgccttcgtcgtccatggcgtctgcctctacatcaaccggacctggtacaagcagacgacatggatgtacctcgccatccccatcctgctctacgccggcgagcggcttttccgggcgctgaggtcccatggcctcaccaccgtgaggatcgagaaggtcgccctgtaccccggaaatgtcatcgccattcacatgagcaagccgcacgggttcagctacaagagcgggcagtacatctacgtcaactgcggcgaggtctcgccgttcgagtggcacccgttcaccatcacctcggcgcccggcgacgactacctgagcatgcacatccggtgccgcggcgactggacgaccagcttcagggcgctgttcgcgcaggtgtgccgcccgcccgccgccgggcagagcggcctcctgcgggccgacttcgcgtcctccacggcggcggcgtccgccggcggcgggaagctcccgaagctgctgatcgacgggccctacggcgcgcccgcgcaggactaccgcaagtacgacgtgctcctcctgatcggtctcggcatcggcgccaccccgctcatcagcatcgtcaaggacgtgctcaacaacatctccgacgacgacgaagagcagccgtcgtcatcatcgtcggcggcggcggagttcatgacgcggcgggtgtacttctactggtgcacgcgggaggaagggtccttcgagtggttccgcggcgtgatgaacgaggtggcggagcgggacgcccgcggcgacgtggtggagctccacaaccactgcaccagcgtgtacgaggaaggcgacgcgcggtcggcgctgctggtgatgctgcaggcgctgcaccacgccaagagcggcgtcgacgtggtgtcagggacgcgggtgcgcacgcacttcgcgcggcccaactggcgggacgtcttcaagcgggtggcctgcaaccaccagggccagcgcgtcggcgtcttctactgcggcgaccagaaggtcacgccggagctccgccggctgtcgcaggacttctcccacaagaccaccaccaagttcgtcttccacaaggagaacttctga

SEQ ID NO: 10522 - protein, 909 aa, Sorghum bicolor
  misc_feature: Ceres ANNOT ID no. 6113629
  misc_feature (726)..(892): Pfam Id: NAD_binding_6 Pfam Desc: Ferric reductase NAD binding domain
  misc_feature (141)..(240): Pfam Id: NADPH_Ox Pfam Desc: Respiratory burst NADPH oxidase
  misc_feature (596)..(720): Pfam Id: FAD_binding_8 Pfam Desc: FAD-binding domain
  misc_feature (396)..(554): Pfam Id: Ferric_reduct Pfam Desc: Ferric reductase like transmembrane component
  misc_feature (5)..(909): NCBI GI: 77556657 NCBI Desc: respiratory burst oxidase homolog [oryza sativa (japonica cultivar-group)]
  misc_feature (2)..(909): NCBI GI: 53793485 NCBI Desc: respiratory burst oxidase protein b [oryza sativa (japonica cultivar-group)]
  misc_feature (2)..(909): NCBI GI: 47525233 NCBI Desc: respiratory burst oxidase protein b [oryza sativa (indica cultivar-group)]
  misc_feature (137)..(909): NCBI GI: 16549089 NCBI Desc: respiratory burst oxidase homolog [solanum tuberosum]
  misc_feature (104)..(909): NCBI GI: 58532641 NCBI Desc: respiratory burst oxidase 2 [medicago truncatula]
MSSSSGQQHETGPPPPTAFKSASTDGKSGSRRSTRFKDEDEYVEVTLDVRDDGGGDVAVRAIKDVVLAGGPGVLGDAQDATALLDPPPTGSAAAAASGGLSSKLRAARAHLGRIASVKRAAVPLSALLRRDRDRDRDRSSRLDRSVVTGAASALRGLQFLNQAAVTEGWTEVEKRFQRLAVDGFLLRSRFGQCIGMVGSEEFAAQIFDALARRRGITAMVLTKDQVREFWEQLSDPGFDAKVDKNADGQITEEELKEVLTLTASANKLSKILERVDEYTALIMEELDPDNLGYIELANLESLLLQPAPASTSTRLVTHSSNNISQLISQRLAPARDDSALRRAAMAFLYFMEDNWKRVWVMSLWLAINAALFAWKFAAYRRHPTFDVMGYCVCVAKGGAETTKFNMALILLPVCRNTITWLRSRTRLGAAVPFNDNINFHKVVAGGVAVGVALHAVTHLTCDFPRLLHASAAAYEPMKAYFGQRRIPDYWWFVRGVEGVTGVIMVVLMAVAYTLAHPWFRRGKLSEGNPLRRLSGFNMFWYSHHLFVIVYVAFVVHGVCLYINRTWYKQTTWMYLAIPILLYAGERLFRALRSHGLTTVRIEKVALYPGNVIAIHMSKPHGFSYKSGQYIYVNCGEVSPFEWHPFTITSAPGDDYLSMHIRCRGDWTTSFRALFAQVCRPPAAGQSGLLRADFASSTAAASAGGGKLPKLLIDGPYGAPAQDYRKYDVLLLIGLGIGATPLISIVKDVLNNISDDDEEQPSSSSSAAAEFMTRRVYFYWCTREEGSFEWFRGVMNEVAERDARGDVVELHNHCTSVYEEGDARSALLVMLQALHHAKSGVDVVSGTRVRTHFARPNWRDVFKRVACNHQGQRVGVFYCGDQKVTPELRRLSQDFSHKTTTKFVFHKENF

SEQ ID NO: 10523 - DNA, 900 bp, Sorghum bicolor
  misc_feature: Ceres ANNOT ID no. 6113631
  misc_feature: Encodes the peptide sequence at SEQ ID NO 10524
atgacccgccgcgtcctccccttgctcctgctgctggcgctgctcccctccctagcgccgcctggtgcgtctgcacgcccgggcgcggggcaggatttgggacatcagtgtccggtgctggagcacgggctcccgccgttcgccgccgcgctccgggcaagctgccccgtctcgacggaggggtactcgccccccgaggaggttgttaatggggaggaacttcttaggatgttggatagcaaggaagagcacacagctgtccttttctatgcatcatggtgccctttctcgcaaagaatcagaccagtctttgatgatctgagctcaatgtttccacgggttaagcacgtggctgttgaagagtccaacatcgtgaaagccattttgtcgagatatcatgtccgtgcactaccttccataataatagctcgcagctcatacgtattctggcctcttggttcaaaagatctcgactccctggtcaacctttacactactgctacgggtcaagaaccagtcgcatatattggtactcggaagtggagcgcagcgcgaagtacagactatgctaagatttggaacagctctattagtgaaacagtgaagcgagaaccctacctagcattcagtatcctgtttatttgcctgaggatattctttttcttcttcccaaagttctttgctctcatccaagacttctggaccgaatactacgagcaaagcaaccttggaatcctcgccaaattgacccatgctgtggatgtgaggaaggtgtggagcaagctgaggctcatggttggagctaagaatggtaggatctgggcatctctagcttcggtgtcgcttggtgggcaaccttctccgcgagttgctgttggactgatgggctcgaccatctga

SEQ ID NO: 10524 - protein, 299 aa, Sorghum bicolor
  misc_feature: Ceres ANNOT ID no. 6113631
  misc_feature (1)..(299): NCBI GI: 58014110 NCBI Desc: adenosine 5'-phosphosulfate reductase 6 [zea mays]
  misc_feature (1)..(288): NCBI GI: 58014112 NCBI Desc: adenosine 5'-phosphosulfate reductase 7 [zea mays]
  misc_feature (10)..(291): NCBI GI: 58014114 NCBI Desc: adenosine 5'-phosphosulfate reductase 8 [zea mays]
  misc_feature (39)..(287): NCBI GI: 21536613 NCBI Desc: contains similarity to protein disulfide isomerase-related protein [arabidopsis thaliana]
  misc_feature (10)..(287): NCBI GI: 58014116 NCBI Desc: adenosine 5'-phosphosulfate reductase 9 [zea mays]
MTRRVLPLLLLLALLPSLAPPGASARPGAGQDLGHQCPVLEHGLPPFAAALRASCPVSTEGYSPPEEVVNGEELLRMLDSKEEHTAVLFYASWCPFSQRIRPVFDDLSSMFPRVKHVAVEESNIVKAILSRYHVRALPSIIIARSSYVFWPLGSKDLDSLVNLYTTATGQEPVAYIGTRKWSAARSTDYAKIWNSSISETVKREPYLAFSILFICLRIFFFFFPKFFALIQDFWTEYYEQSNLGILAKLTHAVDVRKVWSKLRLMVGAKNGRIWASLASVSLGGQPSPRVAVGLMGSTI

SEQ ID NO: 10525 - DNA, 582 bp, Sorghum bicolor
  misc_feature: Ceres ANNOT ID no. 6113633
  misc_feature: Encodes the peptide sequence at SEQ ID NO 10526
atggcagctgcggccgccgccatccgcgcggtcaccgccgtagctggcctctcggcggcagctcgtcatgtggcttctggtctccgccaatctgctcggcgtggcttcgtcggcgacaccgccgcctttacgcggcggccgctgctgccacaccacgccacatcgggcgcacacatcctccggcgcggcctcgctgttgtccccggcgaaggcgatgatcactctgtcggagtcggagtcgaggtctccccggtcgcccccgatccttttgacccttgcgaccctgaatctcctgacgatccggaaacctgcttcgcatacgacgacgtggacctggagtcggaagaaaccatgtgggcgatgtacgagcggtggtgcgtcttccacggcgtgaagcgcgaccgcgacgacatgctccggcgcttctctcttttcaaggacagggcgcgcagcatccacgagttcaacaagtctggtaagccttggacccagggactcaacaaatttggtgatcagacgccagaggagcgctccaaattgtttccgccacgtttctcgaggccttcaagtcatcaagcttaa

SEQ ID NO: 10526 - protein, 193 aa, Sorghum bicolor
  misc_feature: Ceres ANNOT ID no. 6113633
  misc_feature (122)..(177): Pfam Id: Inhibitor_I29 Pfam Desc: Cathepsin propeptide inhibitor domain (I29)
  misc_feature (100)..(179): NCBI GI: 115458224 NCBI Desc: os04g0405700 [oryza sativa (japonica cultivar-group)]
  misc_feature (107)..(176): NCBI GI: 537437 NCBI Desc: cysteine proteinase [hemerocallis hybrid cultivar]
  misc_feature (107)..(179): NCBI GI: 396568 NCBI Desc: thiol-protease [hemerocallis hybrid cultivar]
  misc_feature (111)..(179): NCBI GI: 4731374 NCBI Desc: papain-like cysteine protease [sandersonia aurantiaca]
  misc_feature (105)..(176): NCBI GI: 1336648 NCBI Desc: endopeptidase-like protein
MAAAAAAIRAVTAVAGLSAAARHVASGLRQSARRGFVGDTAAFTRRPLLPHHATSGAHILRRGLAVVPGEGDDHSVGVGVEVSPVAPDPFDPCDPESPDDPETCFAYDDVDLESEETMWAMYERWCVFHGVKRDRDDMLRRFSLFKDRARSIHEFNKSGKPWTQGLNKFGDQTPEERSKLFPPRFSRPSSHQA

SEQ ID NO: 10527 - DNA, 963 bp, Sorghum bicolor
  misc_feature: Ceres ANNOT ID no. 6113814
  misc_feature: Encodes the peptide sequence at SEQ ID NO 10528
atggctgcaactcgtccaaaggcactcgtgcttgcagtagtggtactgctcgtgagctccgcccagctatccatgggggcaaggaggcgcatggagctgtatcaacccaatccggcggacatgctctcctaccacaacggagccgtgctccacgccgacatcttcgtttccgtgctctggtacggcagtttcacgcaggtgcagaagacgatcatctacgacttcctgctctccctcaccatgatgccccaggccgcctcgccgtccgtgtcgcaatggtggaacatcattgaccagcagtacctgtccaaggcggcgcaagcctcgccggccaatgccggcggagccacgacgaaaacccgggtgatgctcgacaaccaggtgtccgacgacggctgctccatgggcacgtccctcaccctggcgcaaatctccgctctcgccgcgagggccaagcccaagaagggcggcgtcgcgctggtcttcaccgcgcaggacgtcaccgtggagggcttctgcatgagccagtgcggcctgcacggctcggacgccgagtccggcaccacgtacgtatgggtcggcaactcggccacgcagtgccccggccagtgcgcgtggccgttccaccagccgctgtacggaccgcagagcccgcccctcgttccgcccaacggcgacgctgccgtggacggcatgatcatcaacctggcgagccagttcgccggcgtggtgacgaacccgttccgtgacgcgtactaccagggctccagcgacgcgcccctggaggccgccacggcgtgcctggggcaattcggcagcggctcgtacccgggatacgccggcgacctgaagattgaccaagcgagcggtgccagctacaacgccaatggcgcgcaagggagaaaatacctcctccccgcgctctacaacccttccacgtctgcctgcagcacgctggtctag

SEQ ID NO: 10528 - protein, 320 aa, Sorghum bicolor
  misc_feature: Ceres ANNOT ID no. 6113814
  misc_feature (42)..(320): Pfam Id: Phi_1 Pfam Desc: Phosphate-induced protein 1 conserved region
  misc_feature (8)..(320): NCBI GI: 115448781 NCBI Desc: os02g0756800 [oryza sativa (japonica cultivar-group)]
  misc_feature (45)..(320): NCBI GI: 115467136 NCBI Desc: os06g0220000 [oryza sativa (japonica cultivar-group)]
  misc_feature (9)..(320): NCBI GI: 115467140 NCBI Desc: os06g0220300 [oryza sativa (japonica cultivar-group)]
  misc_feature (16)..(320): NCBI GI: 3759184 NCBI Desc: phi-1 [nicotiana tabacum]
  misc_feature (41)..(320): NCBI GI: 31074969 NCBI Desc: erg-1 [solanum tuberosum]
MAATRPKALVLAVVVLLVSSAQLSMGARRRMELYQPNPADMLSYHNGAVLHADIFVSVLWYGSFTQVQKTIIYDFLLSLTMMPQAASPSVSQWWNIIDQQYLSKAAQASPANAGGATTKTRVMLDNQVSDDGCSMGTSLTLAQISALAARAKPKKGGVALVFTAQDVTVEGFCMSQCGLHGSDAESGTTYVWVGNSATQCPGQCAWPFHQPLYGPQSPPLVPPNGDAAVDGMIINLASQFAGVVTNPFRDAYYQGSSDAPLEAATACLGQFGSGSYPGYAGDLKIDQASGASYNANGAQGRKYLLPALYNPSTSACSTLV

SEQ ID NO: 10529 - DNA, 2193 bp, Sorghum bicolor
  misc_feature: Ceres ANNOT ID no. 6113827
  misc_feature: Encodes the peptide sequence at SEQ ID NO 10530
atgtgggtgttctacctgatatcgctgcccctgacgctgggcatggtcgtcgtcacgctccgctacttcgccggccccgctgtgccgcgctacgttgtcgtcaccgtcggatacgcatggttctgctccctctccatcatcatcctcgtccccgccgacatctggcagacattaactggcagtgcaaagggtggcattggattcttttggagctggtcctattggagcacatttatcctaacatgggctgtagttcctactatccagggctatgaagatgcaggagacttcactgttaaagaaaggctgaaaactagcattcatatgaacctgcttttttattcaattgtgggagccattggccttattggtctcatactactcttaatcatgcatagagcttgggatggtggtattgtgggatttgcaatggcatgctcaaatacctttggattagtgactggtgcttttcttcttgggtttgggctaagcgaaattccaagaaacatttggaaaaacgcagactggtctcaccgccaaaaagtactttctcatagagttgctaagatggctgtaaagcttgataatgcccatcaagaatattcaaatgcaattgttgttgctcaagctacatcaaatcaaatgtcaaaacgtgacattttgaggccttacatggatattattgataacatgctgtctcaaatgctgcgggaggatccatcctttaaaccttctggtggtagattaggtgaaaatgatatggactatgatactgatgataaatcgatggccacacttcggcgccaactcaggagagctcatgaggagtactataggtgcaaaagtgagtatatgacttgtgtcatggaagccctcaaactagaagacacaataaaaaattatgaacgccgtgatgctaatggatggaaatatgtatcaagttttagagaaagtcgttcaggcacacttggatcaattttggacactattgagttcatttggcgctgtatactgagaaagcagcttcaaaaagcatttgctgttatccttggctgcatgtcagctgctatactgttggctgaagctactttacttccaagtggtgttgatctctctctcttttctattcttataaaagctgtaggaaaacaagaggttttagttcaggttgctgcttttgtccccttgatgtatatgtgcatttgcacatattattcattattcaagattggtatgttgatgttctattctctaactccaaggcaaaccagctctgtcagcttgcttatgatctgttcaatggttgcaagatatgcacctcctatttcttataactttcttaatctcatccgccttggtggcaatgctaaaactacatttgagaagagaatggggaacattgatgatgcagtccctttcttcggcagaggcttcaacaggatctacccactgattatggttgtttatacgctattggttgctagtaatttctttggccgtgtgattgactttttgggaagctggaaaaggttcaagttccaacgtgaagaagagaatatagatggtttagatccctctggaatgattattctacaaaaagagaggtcttggcttgaacaagggtgcaaagtgggcgagcaagttattccattggcaaggaatttcaatggcgtgaacacagatattgaatcacaaaatgttccattggttgaaaatacagtggagatgaaagttggggcaacctcttccagaaatgatgggagagccggtcagtcgaaatatgcaaacaacagggagactatcgccagcaaatacacttctattagagaacagaaccggcagtcagggaaggcagtgagaaaggaaatttcaccgaactctgtatctttgcttgaagaaagaaattctgagcagcggtccaatgcgggtgtaccaccaactggtgtgtctgcaacatgggcctcgatgaagaatggttttcaaaatttcaaagcaaatatgggttcaaagaagtttcttcctttgcgccaagatccaggatttgttctgaattcaaatgtctcttcacctgaatctcttgatgacatattccaaaggttgaaacggcggcctgcaaatgtacctgtggattaccttgacgatgacgatgatgacaacacaggagatatggatctgcatttccaggatcaatga

SEQ ID NO: 10530 - protein, 730 aa, Sorghum bicolor
  misc_feature: Ceres ANNOT ID no. 6113827
  misc_feature (2)..(497): Pfam Id: LMBR1 Pfam Desc: LMBR1-like membrane protein
  misc_feature (1)..(727): NCBI GI: 46805692 NCBI Desc: lmbr1 integral membrane protein-like [oryza sativa (japonica cultivar-group)]
  misc_feature (1)..(715): NCBI GI: 92893534 NCBI Desc: lmbr1-like conserved region [medicago truncatula]
  misc_feature (1)..(705): NCBI GI: 140039291 NCBI Desc: lmbr1-like conserved region [medicago truncatula]
  misc_feature (1)..(569): NCBI GI: 146162596 NCBI Desc: lmbr1-like conserved region family protein [tetrahymena thermophila sb210]
  misc_feature (70)..(556): NCBI GI: 24645348 NCBI Desc: cg8135-pa [drosophila melanogaster]
MWVFYLISLPLTLGMVVVTLRYFAGPAVPRYVVVTVGYAWFCSLSIIILVPADIWQTLTGSAKGGIGFFWSWSYWSTFILTWAVVPTIQGYEDAGDFTVKERLKTSIHMNLLFYSIVGAIGLIGLILLLIMHRAWDGGIVGFAMACSNTFGLVTGAFLLGFGLSEIPRNIWKNADWSHRQKVLSHRVAKMAVKLDNAHQEYSNAIVVAQATSNQMSKRDILRPYMDIIDNMLSQMLREDPSFKPSGGRLGENDMDYDTDDKSMATLRRQLRRAHEEYYRCKSEYMTCVMEALKLEDTIKNYERRDANGWKYVSSFRESRSGTLGSILDTIEFIWRCILRKQLQKAFAVILGCMSAAILLAEATLLPSGVDLSLFSILIKAVGKQEVLVQVAAFVPLMYMCICTYYSLFKIGMLMFYSLTPRQTSSVSLLMICSMVARYAPPISYNFLNLIRLGGNAKTTFEKRMGNIDDAVPFFGRGFNRIYPLIMVVYTLLVASNFFGRVIDFLGSWKRFKFQREEENIDGLDPSGMIILQKERSWLEQGCKVGEQVIPLARNFNGVNTDIESQNVPLVENTVEMKVGATSSRNDGRAGQSKYANNRETIASKYTSIREQNRQSGKAVRKEISPNSVSLLEERNSEQRSNAGVPPTGVSATWASMKNGFQNFKANMGSKKFLPLRQDPGFVLNSNVSSPESLDDIFQRLKRRPANVPVDYLDDDDDDNTGDMDLHFQDQ

SEQ ID NO: 10531 - DNA, 2805 bp, Sorghum bicolor
  misc_feature: Ceres ANNOT ID no. 6113847
  misc_feature: Encodes the peptide sequence at SEQ ID NO 10532
atgttcaagtcgatggtttattacgggaacacctcaatcggagaagttgaggtgtggcccaaaggcgaggcgagcgcgggcctggccgtggcggcgtgggcgcgagaaatccgcgttgaccgcctttccccgcccagcgagcggtgccctccgctggcggtcatgcacaccgtggccgtcggcgcccgatgcctcgtcatggagtccaggccgcccgtcgccgccgacgtggcgccgatgcctctcgtcgccatgcacgccgcttgcctcagggacaacaagaccgcggttgttccacttggagatggagaattgcatttagttgcgatgacatccagaagaaacttgacaaatcatgcatgtttctggggctataaattgccatttggcctgtataattcttgcttgaccatgttaaatcttcggtgcctgggtatcgtgtttgaccttgatgagacgttgattgtcgccaatacatcacggtcttttgaggacagaattgatggccttcaaagaaagctgagtaatgagactgatccacagcgtaggaatggtatgctatcagagatcaaaaggtaccaggatgataagtccatcctaaagcaatatatagaaggtgatcaggtctatgatgatggaaaagtgtataaagcacaacctgagattgttccaccattgtctgataaccagcaaccaatgacacgtccagttataagattacaagataaaaacattatcctgacaagaataaatcctctgattagggataccagtgtacttgtacgtttaaggccggcctgggaggatcttcgcagctacttaattgcaagaggtcgcaagcgttttgaggtgtatgtgtgtacgatggctgaaagagactatgctttagaaatgtggagattgcttgatccagattcaagattgattaattctgttcaacttcatgatcggatggtgtgtgtaaaatctggtttaaagaagtccttgctaaatgtcttccatgatggttcttgccatcctggtatggcattagtaattgacgatcgtctgaaagtttgggatgagaaggatcaattacgagttcatgtggttcctgcatttactccatattatgctcctcaggcagaggcaaattgttctatcccggttctgtgtgtagccagaaacgttgcatgcaatgttaggggtggtttcttcaaagacttcgatgaagggctcttaccaaggattagcaatgttcactatgaggatgaagtaaatgatatctcatctgcgccagatgttggcaattatttgataacagaggatgagaatgccgcattagtgaatggaaatcgagattcattgccttttgatggtatggcagatgcagaggttgagaggagaatgaaggaagctaatgctcaagcattccatcaaacagcggggaactttgtcatgccagtagcccctgctcagaattttgtttcgtcttcagttgcaccattagccccacctcttggcgttatgccaccaacattcagccaaccagttgttcaaccaggtttttcagattcactgcaaggttctccagctagagaagagggcgaagttccagagtctgagttggatccggacacaaggagaagacttctcatattacagcatggtcaagacataagagatcctacacctccactcccagcaataccaccagtgcaagttccagttcctccagtgcaacctcatgggaattggtttcccacagaggatgggctaaacccaagtaacctgaatagaggttcagcaggtttcactgtagaatctgatcctatgctctacgagaaaaaacaaccacctcatccttcattctttcatggtggggacagtcctatgtcgtctgatagatttggctatcagaaccagaggtttccctctcagctaccacacaccgaggatcaccacatgcttcagaaccatgcacctccaaaatacagatccttttctggtgaggagctagcagctcggcatgttccctcaagccagagaaacaaccagatagaatcaggaagacactttgcacaatatgctgggacctcagctggcatattagacggcattgctctgaaatgtggatctaaggtggagtacaggtcaacattatgtgatactgcagaactacaattctctattgaggtttggattgttggggaaaaggttggtgaaggaattggtaggacaaggagagaagcacagcacaaagctgcagaaatgtctttaagaaacttggccaataaatacttgtcatctgatccaaataagttgactgatatgaaagaaaatggtttcagtggcaacagaaatgtctttggttactctggaaataccagggatgatatgttgcctctttcaagtacttcagaggaatctcgctttatgaaaatggagaacaattccaggaaaacaggaggttctgttgctgctctcaaggaactttgcacggttgagggatataacttagtttttcaagagcgtccatctccagcagatggtttagttgggaaagaatcttatgctcaggtagaagttggtggacaaattctaggcaaaggagttggattaacatgggaagaggccaagctccaggctgctgatgaggctcttggaactttaagatccatgctaggtcaacttgctcataagcgatctggctctccaaggtcattggcaccaaattttaacaagcggttcaagccagattttccaaggaccgtacaaagagttccttatggaacgtattctaggatcgaaggtcatgttccgtag

SEQ ID NO: 10532 - protein, 934 aa, Sorghum bicolor
  misc_feature: Ceres ANNOT ID no. 6113847
  misc_feature (693)..(756): Pfam Id: dsrm Pfam Desc: Double-stranded RNA binding motif
  misc_feature (818)..(884): Pfam Id: dsrm Pfam Desc: Double-stranded RNA binding motif
  misc_feature (1)..(934): NCBI GI: 49388720 NCBI Desc: double-stranded rna-binding domain (dsrbd)-containing protein-like [oryza sativa (japonica cultivar-group)]
  misc_feature (1)..(933): NCBI GI: 38346621 NCBI Desc: osjnba0074l08.12 [oryza sativa (japonica cultivar-group)]
  misc_feature (1)..(897): NCBI GI: 116312020 NCBI Desc: osigba0155k17.3 [oryza sativa (indica cultivar-group)]
  misc_feature (165)..(933): NCBI GI: 115459562 NCBI Desc: os04g0529500 [oryza sativa (japonica cultivar-group)]
  misc_feature (6)..(514): NCBI GI: 79481163 NCBI Desc: cpl1 (fiery 2); double-stranded rna binding [arabidopsis thaliana]
  misc_feature: The sequence is a functional homolog of SEQ ID NO. 347 in the 11/188,298 US application
MFKSMVYYGNTSIGEVEVWPKGEASAGLAVAAWAREIRVDRLSPPSERCPPLAVMHTVAVGARCLVMESRPPVAADVAPMPLVAMHAACLRDNKTAVVPLGDGELHLVAMTSRRNLTNHACFWGYKLPFGLYNSCLTMLNLRCLGIVFDLDETLIVANTSRSFEDRIDGLQRKLSNETDPQRRNGMLSEIKRYQDDKSILKQYIEGDQVYDDGKVYKAQPEIVPPLSDNQQPMTRPVIRLQDKNIILTRINPLIRDTSVLVRLRPAWEDLRSYLIARGRKRFEVYVCTMAERDYALEMWRLLDPDSRLINSVQLHDRMVCVKSGLKKSLLNVFHDGSCHPGMALVIDDRLKVWDEKDQLRVHVVPAFTPYYAPQAEANCSIPVLCVARNVACNVRGGFFKDFDEGLLPRISNVHYEDEVNDISSAPDVGNYLITEDENAALVNGNRDSLPFDGMADAEVERRMKEANAQAFHQTAGNFVMPVAPAQNFVSSSVAPLAPPLGVMPPTFSQPVVQPGFSDSLQGSPAREEGEVPESELDPDTRRRLLILQHGQDIRDPTPPLPAIPPVQVPVPPVQPHGNWFPTEDGLNPSNLNRGSAGFTVESDPMLYEKKQPPHPSFFHGGDSPMSSDRFGYQNQRFPSQLPHTEDHHMLQNHAPPKYRSFSGEELAARHVPSSQRNNQIESGRHFAQYAGTSAGILDGIALKCGSKVEYRSTLCDTAELQFSIEVWIVGEKVGEGIGRTRREAQHKAAEMSLRNLANKYLSSDPNKLTDMKENGFSGNRNVFGYSGNTRDDMLPLSSTSEESRFMKMENNSRKTGGSVAALKELCTVEGYNLVFQERPSPADGLVGKESYAQVEVGGQILGKGVGLTWEEAKLQAADEALGTLRSMLGQLAHKRSGSPRSLAPNFNKRFKPDFPRTVQRVPYGTYSRIEGHVP

SEQ ID NO: 10533 - DNA, 1155 bp, Sorghum bicolor
  misc_feature: Ceres ANNOT ID no. 6113861
  misc_feature: Encodes the peptide sequence at SEQ ID NO 10534
  misc_feature: Up-regulated in shoot tissues in response to methyl jasmonate treatment
  misc_feature: Up-regulated in root tissues in response to methyl jasmonate treatment
atggctgccgccgctgcatcttcgtcgcctccggctgccatcacctgccgagctgcggtggcctgggggccgggccagccgctggtcatggaggaggtggaggtcgccccgccggggcccatggagatccgcgtcaaggtcgtctccacctccgtctgccgcagcgacgtcactgcctggcaatccaaggcgcaacctgatctgttccctagagtcttcggccacgaagcatccggagtagtagagagtgtcggtgaaggtgtgaccgagttccaagtcggagaccacgttctcactgtcttcattggggaatgcaagagctgtaagcattgcgtctcggggaaaagcaacatgtgccagaagctcggtttggagaggaagggtgtcatgcacagtgatcagaagacccgcttctctgtcaaggggaaacctgcgtaccattactgtgccgtgtcaagcttcagcgagtacacggttgtccattctggatgtgcggtgaaggttggcctgaccgtgccaatggacagggtgtgcctgctgagctgcggtgtgtctgcaggactcggtgcagtctggaacgtagctaatgtatcaaagggctcaagtgtagctatatttggtcttgggaccgtaggactttctgtcgctcaaggtgctaagcttcggggggcgtccaagattataggagttgacactaatgctgagaagcaagaaaaggggaaattatttggtgtcacggattttattaacccagatgaattgagtgaacctgttcaacaggtaatcaaaaggattactgatggaggggtggattactcttttgaatgtgttggtgatactggagtagtatccactgcacttcaatcatgttctgatggctggggagtaactgtaactcttggtgtaccaaaaacaaaaccagaagtgtctgctcattatgcatttcttctatccggaagaacactgaagggatctttgtttggaggatggagacctaaatctgatctaccttcattggtggataaatatgcagacaaggaaatccaagttgatggcctagtcacgcatgatataccattcagtgaaatcaacaaagcacttgagctcatgctagaaaacaagtgcttgagatgtgtgattcacatgccacagtaa

SEQ ID NO: 10534 - protein, 384 aa, Sorghum bicolor
  misc_feature: Ceres ANNOT ID no. 6113861
  misc_feature (199)..(341): Pfam Id: ADH_zinc_N Pfam Desc: Zinc-binding dehydrogenase
  misc_feature (40)..(168): Pfam Id: ADH_N Pfam Desc: Alcohol dehydrogenase GroES-like domain
  misc_feature (1)..(384): NCBI GI: 21553654 NCBI Desc: alcohol dehydrogenase-like protein [arabidopsis thaliana]
  misc_feature (6)..(382): NCBI GI: 92872531 NCBI Desc: alcohol dehydrogenase superfamily, zinc-containing [medicago truncatula]
  misc_feature (1)..(384): NCBI GI: 10129655 NCBI Desc: alcohol dehydrogenase-like protein [arabidopsis thaliana]
  misc_feature (7)..(382): NCBI GI: 7264740 NCBI Desc: alcohol dehydrogenase 6 [vitis vinifera]
  misc_feature (7)..(382): NCBI GI: 18027092 NCBI Desc: alcohol dehydrogenase 2 [vitis vinifera]
  misc_feature (7)..(382): SWISSPROT Homolog: EC 1.1.1.1 Alcohol dehydrogenase 1
  misc_feature: Up-regulated in shoot tissues in response to methyl jasmonate treatment
  misc_feature: Up-regulated in root tissues in response to methyl jasmonate treatment
  misc_feature: The sequence is a functional homolog of SEQ ID NO. 530 in the 11/188,298 US application
MAAAAASSSPPAAITCRAAVAWGPGQPLVMEEVEVAPPGPMEIRVKVVSTSVCRSDVTAWQSKAQPDLFPRVFGHEASGVVESVGEGVTEFQVGDHVLTVFIGECKSCKHCVSGKSNMCQKLGLERKGVMHSDQKTRFSVKGKPAYHYCAVSSFSEYTVVHSGCAVKVGLTVPMDRVCLLSCGVSAGLGAVWNVANVSKGSSVAIFGLGTVGLSVAQGAKLRGASKIIGVDTNAEKQEKGKLFGVTDFINPDELSEPVQQVIKRITDGGVDYSFECVGDTGVVSTALQSCSDGWGVTVTLGVPKTKPEVSAHYAFLLSGRTLKGSLFGGWRPKSDLPSLVDKYADKEIQVDGLVTHDIPFSEINKALELMLENKCLRCVIHMPQ

SEQ ID NO: 10535 - DNA, 1086 bp, Sorghum bicolor
  misc_feature: Ceres ANNOT ID no. 6113880
  misc_feature: Encodes the peptide sequence at SEQ ID NO 10536
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
atggctctggtgccctcaggctcgggtgccggccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaagctgctgggtatggttcacagttagttgtctttccggaagcttttattggaggctatcctcgtggatccacatttggcttcgggatcagtattagtattattaatccaaaagacaagggaaaggaagcattccggaggtatcatgcagctgctatagatgtgcctggtccagaggttacacgattagctgctatggctggaaaatataaggttttcttggttatgggggtgattgaaagggaaggttataccctttattgttcagtgcttttctttgatcctcttggccgttacctgggtaagcaccgcaagctcatgccaacagcattagagagaattatatggggatttggggatggatcgactattcctgtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactaccctcccccaccggagtatgagtttgctggtttaggtgaagagccatctgcagacactgttgtttgctctggaggcagcgttatcatttctccatctggagaagtcttagcaggtcccaactatgagggagaggcactgattacagccgaccttgacctgggagagattgttcgagccaagtttgatttcgacgtggtgggccactattctcgacctgaagtccttagcttggtagtgaatgaccagccacatctccctgtgtctttcacgtctgccggtgagaagactccagctgccaagagtgacagcgatgctaagtcttactga

SEQ ID NO: 10536 - protein, 361 aa, Sorghum bicolor
  misc_feature: Ceres ANNOT ID no. 6113880
  misc_feature (31)..(220): Pfam Id: CN_hydrolase Pfam Desc: Carbon-nitrogen hydrolase
  misc_feature (1)..(361): NCBI GI: 143328338 NCBI Desc: nitrilase 2 [zea mays]
  misc_feature (1)..(361): NCBI GI: 37654214 NCBI Desc: nitrilase 2 [zea mays]
  misc_feature (1)..(361): NCBI GI: 4835588 NCBI Desc: nitrilase-like protein [oryza sativa (japonica cultivar-group)]
  misc_feature (1)..(352): NCBI GI: 1181615 NCBI Desc: nitrilase [nicotiana tabacum]
  misc_feature (1)..(348): NCBI GI: 47606796 NCBI Desc: nit4a [lupinus angustifolius]
  misc_feature (1)..(352): SWISSPROT Homolog: EC 3.5.5.1 Nitrilase 4
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
MALVPSGSGAGQVIAEVAMNGGADPNATTVRATVVQASTIFHDTPATLDKAERLIAEAAGYGSQLVVFPEAFIGGYPRGSTFGFGISISIINPKDKGKEAFRRYHAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIALEGGCFVLSANQFCRRKDYPPPPEYEFAGLGEEPSADTVVCSGGSVIISPSGEVLAGPNYEGEALITADLDLGEIVRAKFDFDVVGHYSRPEVLSLVVNDQPHLPVSFTSAGEKTPAAKSDSDAKSY

SEQ ID NO: 10537 - DNA, 1092 bp, Sorghum bicolor
  misc_feature: Ceres ANNOT ID no. 6113881
  misc_feature: Encodes the peptide sequence at SEQ ID NO 10538
atggccctcgctccagcgagctccggcaaagagcccgtgatcagcccgccggaggtggagatgaacggcggcgctgaccagcccgccgccacaaccgtgcgtgcctccgtcgtgcaggcgtcgtccgtgttctacgacacccccgccactctcgataaagcggagaaattcatagcggaggcagccggaaacggttcacagctggtgctatttccagaagccttcattggtggctaccctcatggatctacatttggactggctattggcaatcgcactgccaagggaaaggaagacttccaaaagtaccatgcagctgccatagatgttcctggcccagaagtgtcccgcttagcttcattagccggaaaatacaaggtgtttctggtgatgggggtggttgaaagggcaggctatacactctacaacacggcgctcttcttcgatcctctgggaaaatttctagggaagcaccgcaagctcgtgcctactgcactggaacgtacattctggggttttggagatggatctacgctgcccgtctttgataccccgttgggaaaaatcggtgccctcctctgctgggaaaacaagatgccacttgccaggacagccatgtacgccaaagggattcagatatattgtgctcccacagctgatgcgtccccaacttgggtggcttccatgacgcatatcgccctcgaagggggatgcttcgtggtgtcggcaaaccagttctgtcgcaggaaggactacccaccccctccggagtatacattcggtggcctcgacgaagagccatccccggagactgttgtgtgtcctggaggaagtgtcatcgtttcaccgtccgggacagtgttggcaggccccaacttcgagggtgagggcctcgttacagctgacctcgaccttggagagattgttcgagccaagtttgatttcgacgtggtggggcactactcgcgacgtgaggtgctgagtttggtggtgaagactgatccaaagtctgctgtctctttcactgcttcagccgatggagagaggccggcttccgctgggaagaagcgcgacgactctgtgtacaaataa

SEQ ID NO: 10538 - protein, 363 aa, Sorghum bicolor
  misc_feature: Ceres ANNOT ID no. 6113881
  misc_feature (34)..(219): Pfam Id: CN_hydrolase Pfam Desc: Carbon-nitrogen hydrolase
  misc_feature (1)..(345): NCBI GI: 37654216 NCBI Desc: nitrilase 1 [zea mays]
  misc_feature (1)..(345): NCBI GI: 143328311 NCBI Desc: nitrilase 1 [zea mays]
  misc_feature (1)..(346): NCBI GI: 4835588 NCBI Desc: nitrilase-like protein [oryza sativa (japonica cultivar-group)]
  misc_feature (1)..(362): NCBI GI: 143328338 NCBI Desc: nitrilase 2 [zea mays]
  misc_feature (1)..(362): NCBI GI: 37654214 NCBI Desc: nitrilase 2 [zea mays]
  misc_feature (1)..(345): SWISSPROT Homolog: EC 3.5.5.1 Nitrilase 4
MALAPASSGKEPVISPPEVEMNGGADQPAATTVRASVVQASSVFYDTPATLDKAEKFIAEAAGNGSQLVLFPEAFIGGYPHGSTFGLAIGNRTAKGKEDFQKYHAAAIDVPGPEVSRLASLAGKYKVFLVMGVVERAGYTLYNTALFFDPLGKFLGKHRKLVPTALERTFWGFGDGSTLPVFDTPLGKIGALLCWENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLDLGEIVRAKFDFDVVGHYSRREVLSLVVKTDPKSAVSFTASADGERPASAGKKRDDSVYK

SEQ ID NO: 10539 - DNA, 1047 bp, Sorghum bicolor
  misc_feature: Ceres ANNOT ID no. 6113882
  misc_feature: Encodes the peptide sequence at SEQ ID NO 10540
atggccctggccccatcgaggtccggtagcgagcctgtgatcccggaggtggagatgaatgccggcgccgaccaggccgcctcaacggtgcgggtcaccgtcgttcaggcgtcgtccgtgttctacgacacccctgcgactctcgataaagtggagaaattgatagcagaggcagctgggtatggttcacagttggttttgtttccagaagtctttgttggtggctacccacatggatctacctttggactggttatcggcaatcgaactgccaaaggaaaggaagactttcagaagtatcacgcatctgccatagatgtgcctggcccagaagtgtcccgcttatctgcattagctggaaagtttaaggtgtatctggtgataggggtggttgagagggcagggtatacactttacaacacagtgctctcctttgatccgctgggaaaatacctagggaagcaccgcaaagtcatgcctactgcattagaacgagtattctgggggtttggagatggatctacaatacctgtctatgatactccgcttggaaaaatcggtgctctcatttgctgggaaaacagaatgccacttatgaggacggccatgtatgccaaaggtattcagatatattgtgcccccacagttgattgcatgccaagttggcagtcttctatgacacatattgcccttgaagggggatgctttgtgctatcagcgagccagttctgtcaccgaaagaactatcctccccctcctgagtatacatttggtggcctagaggaagagccatccccggaatctgctgtttgttccggagggagtgtcatcatttcaccatccggaacagtgttggcaggtcccaactacgaaagtgaggcccttctcactgctgacctggaccttggagagattgttcgagccaagtttgatttcgacgtggtgggccactactcgcgacctgaggtgctgagtttggtggtgaagactgatccaaagcctgctgtctccttcacttccgcatcagagaagactaacgctggatag

SEQ ID NO: 10540 - protein, 348 aa, Sorghum bicolor
  misc_feature: Ceres ANNOT ID no. 6113882
  misc_feature (31)..(216): Pfam Id: CN_hydrolase Pfam Desc: Carbon-nitrogen hydrolase
  misc_feature (1)..(342): NCBI GI: 37654216 NCBI Desc: nitrilase 1 [zea mays]
  misc_feature (1)..(342): NCBI GI: 143328311 NCBI Desc: nitrilase 1 [zea mays]
  misc_feature (1)..(347): NCBI GI: 4835588 NCBI Desc: nitrilase-like protein [oryza sativa (japonica cultivar-group)]
  misc_feature (1)..(347): NCBI GI: 143328338 NCBI Desc: nitrilase 2 [zea mays]
  misc_feature (1)..(347): NCBI GI: 37654214 NCBI Desc: nitrilase 2 [zea mays]
  misc_feature (1)..(347): SWISSPROT Homolog: EC 3.5.5.1 Nitrilase 4
MALAPSRSGSEPVIPEVEMNAGADQAASTVRVTVVQASSVFYDTPATLDKVEKLIAEAAGYGSQLVLFPEVFVGGYPHGSTFGLVIGNRTAKGKEDFQKYHASAIDVPGPEVSRLSALAGKFKVYLVIGVVERAGYTLYNTVLSFDPLGKYLGKHRKVMPTALERVFWGFGDGSTIPVYDTPLGKIGALICWENRMPLMRTAMYAKGIQIYCAPTVDCMPSWQSSMTHIALEGGCFVLSASQFCHRKNYPPPPEYTFGGLEEEPSPESAVCSGGSVIISPSGTVLAGPNYESEALLTADLDLGEIVRAKFDFDVVGHYSRPEVLSLVVKTDPKPAVSFTSASEKTNAG

SEQ ID NO: 10541 - DNA, 1212 bp, Sorghum bicolor
  misc_feature: Ceres ANNOT ID no. 6113886
  misc_feature: Encodes the peptide sequence at SEQ ID NO 10542
atggcttccctcttcaacaagatccaagaggcgatcagaacaattgctaagagccccatgtttgctcgtgatccaaggcatcttcaatttgaagctgatgtaaatcgtttgtttctctatacgagctattctcgtctgggggagaatgctgaagagaaggacgcagaggagattattgacttggctagcaaagcttctgttgctgatcagcagaaacaagtgcaggaaaatgttcattatcaacttaggcatatgtgccaatcaatggataacattttatgccctgatacaacaaatgatccgtcaaaggaaccttcagaagcacataatcattctcggcgtagtggattgagttttgccgttggtggggctgcatctacaaacaagcaaagtgcagttatccctgctacacgacctttgactcgagcagaattgtcaaagaaattcagggatcattttgggtacacccttgacatcggaccatctggaattcctcacaaagatgcaggccaaggtctgttcttatccggaaaagcaaatgttggtgctgtcctagccatctatcctggtgttatatattcacctgcttactatcgatatatacctggatacccaagaattgatgtttgcaacaactatctgatcacaagatatgatggaacaataattgacgcaaaaccatggtattttggtggtgaaacaagagaattatgggatggttcagatttggtggattacaatgctatgccacctaaaggctcagagaacaactctgatcgagtgtggagaatgcttagcaagcctctagagaaaagtgtaagggaaaattttggtgaagtgcttgaacgacgaaatccccttgcttttggtcattttgcaaaccatccacctaaaggttcaagtcctaatgtcatgatctgtccatacgattttcccttgacagagaagaacatgagagtatacatccctaacgttacgtttggtggtgaagagaccattaagatgaagaggtttggctccttctatttcaagtctggaggttctgataatcaggctggtgattctctagtgctgaagacgctagtgctagtgagtacaaggtccatctgtgatgaagaactcttccttaattaccgttacagtaactcaaagcgacggccagagtggtacagccctgtcgatgaagaagaggataagaggagatggagctag

SEQ ID NO: 10542 - protein, 403 aa, Sorghum bicolor
  misc_feature: Ceres ANNOT ID no. 6113886
  misc_feature: Useful for making plants with modulated drought sensitivity
  misc_feature: Useful for making plants with modulated oxidative stress sensitivity
  misc_feature: Useful for making plants with modulated seed size
  misc_feature: Useful for making plants with modulated cold sensitivity
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13486
  misc_feature: GREAT-hit functional homolog of the protein sequence given in SEQ ID NO 13489
  misc_feature: Useful for making plants with modulated oxidative stress sensitivity
  misc_feature: Functional homolog of the protein sequence given in SEQ ID NO 13489
MASLFNKIQEAIRTIAKSPMFARDPRHLQFEADVNRLFLYTSYSRLGENAEEKDAEEIIDLASKASVADQQKQVQENVHYQLRHMCQSMDNILCPDTTNDPSKEPSEAHNHSRRSGLSFAVGGAASTNKQSAVIPATRPLTRAELSKKFRDHFGYTLDIGPSGIPHKDAGQGLFLSGKANVGAVLAIYPGVIYSPAYYRYIPGYPRIDVCNNYLITRYDGTIIDAKPWYFGGETRELWDGSDLVDYNAMPPKGSENNSDRVWRMLSKPLEKSVRENFGEVLERRNPLAFGHFANHPPKGSSPNVMICPYDFPLTEKNMRVYIPNVTFGGEETIKMKRFGSFYFKSGGSDNQAGDSLVLKTLVLVSTRSICDEELFLNYRYSNSKRRPEWYSPVDEEEDKRRWS

SEQ ID NO: 10543 - DNA, 3582 bp, Sorghum bicolor
  misc_feature: Ceres ANNOT ID no. 6113911
  misc_feature: Encodes the peptide sequence at SEQ ID NO 10544
atggacaatgttcagagtgagaaccgaactgataccaagcaagatgatgatgtgcgccaaagcaaacaggatgatgaggaggcccgccttgaagaatataaaaagataattgatcaaaagacttccctccgccggagcaacctaaaccctgaaaggcctgatgcaaactacctgagaaccctagactccagtatcaagcgaaatacaacagttataaagaagttgaagacaataaatgatgaacagaaggatgggctaatggatgagttaaaaagtgtgaatttgagcaaatttgtcagcgaagcagtttcttatatttgtgaggccaaacttcgctcagctgatatacaagctgctgttcaggtttgctccctccttcatcaaagatacaaggacttctctccttgtcttatacaaggtctacttaaggtcttctttcctggaaaatctggagatgatttggatgcagataaaaattcgagagccatgaagaagagaagcacattgaaacttttgattgagctgtattttgttggaattgtcgaagatgctagtatatttgtaaatattataaaagatcttacatcagctgaacatttgaaggaccgtgaaggaactcaaacaaacttgtctcttctatctacctttgctcgtcaagggaagttttttttagggctacaatctcatggtcaagaagcttatgatgagttctttaaggacctaaatgttactgctgagcagaagaagttctttaagaaagccctgaactcttactatgatgctgtagctgaactactacaatcagaacatgcgtctcttcgtctaatggaggcagagaatgcaaaagttttaagtgccaaaggtgaactaagtgatgagaacacagcctcatatgagaaactcaggaagtcttttgatcagttactacgtggtgtatcctcgctggctgaatctcttgacatgcagcctccagtgatgccagatgatggaaatacaacaagagttactacaggaaccgatgccttgccttcttctggaaaagaatcatctgcattggaacctatctgggatgatgaagataccaaagctttttatgaatctttacctgatctcagagcatttgtaccggctgtattactgggagaggttgagccaaaattgaatgagcaacatgctaagggccgcgagcaatctagtgagtccacttcagaacaagatactgaactacatgacaatgttcaaacttctgccactgaacatcaactagaagttaaagtagatgatgtagtgaaagagagtgaagacaaagataaagagaagggaaaggatggtgaaaaggaaaaatccaaggagaaggatctggataagaaaaatgaaagagagaaggagaaaggaagagccttggatggtgcaagtctggataacctcctgcagaggctgccggggtgtgtcagtcgtgatctcattgatcaattgacggttgagttttgctacctaaattctaaagcaaatcgaaagaaacttgtgcgtgccttattcaatgttaataggacttcactggaactgttgccttactattctcgtttggttgcgacactatcaacttgtatgaaagatgttccaagtatgcttctgtctatgcttgaagaggagttcaactttttaataaataagaaggatcagatcaacattgaaacgaaaataaaaaatatacggtttatcggggagttgtgcaagttcaaaatggctcctccagctcttgtttttagctgtttgaaggcctgccttgatgatttcagtcatcataatattgatgtggcttgcaaccttctcgagacttgtggccgttttttgtatcgctcacctgaaactacgatccgcatggctaacatgctggagatactgatgagattgaaaaatgtcaagaatttggatccacgccacagtacacttgtagaaaatgcctactacctttgtaaaccgcccgaaagatctgcacggatatcaaaagttcggccacctttgcatcaatacataagaaagttgcttttctcagatcttgacaaatcaagtgttgaacatgttttgcgccaactacgcaagttaccttgggcagaatgtcaacaataccttctgaagtgctttctaaaggttcacaaaggaaagtacagccaggttcatctgattgcgcttctcactgctagtctcagccgctatcacgatgactttgctgtcgcagtggtagatgaggttttagaagagataagggttggattggagttgaatgactatgggatgcaacaaaggcggcttgcccacatgcggttccttggagagctatacagctacaagcatatagattcatctgttgtttttgatacactgtaccttatcattgtgtttggtcatggaactcctgaacaagatgtgttggatccaccagaagattgcttcagaatcaggttgatcattacacttttacagacctgtggccactatttcagtaagggatcttcaaaaaggaagctggacaaattcttgctacacttccaaagatacattattagtaaagggcccttaccactcgacatagagtttgacattcaggatttattcgccgagctacgaccaaacatgtctaggtactcgtcaattgaggaacttgttgctgcgttagttgagcttgaagaaaatgaacgttcagccccagtagaaaaggttgaaagtgaaagacactcggacaatgaatctcagaaaaggcagccacgagatgctggtccatctgtgaatggtgaaagcgctgcaaatggagttgaggaaaatggcaaggatcatgaagtagcagatagtgagagctattcagatagtggcagcattgatgggcgggaagaagaggatatattatctgaggataaatcaaatgatggctcagataatgaaggcgacgatgaagatgatggcattcctgttggttctgatgaagatgagaatgttgaggttagacagaaagtcatgaaggttgatcctaaggagcaagaagactttgatcgagagctcaaagcccttcttcaggagagcttggagtcacgcaaatcagaggcccgttcaaggctccctttgaatatgatggtaccgatgaatgtccttgagggttcaaaggactcaagggccacagaatctgagagtggagaagaaacagtagatgaagagggtggcaatgctgggagtagcagcaaggtgcgtgttaaggtgctaatgaagaaaggacacaaacaacagacaagacaaatgctaattcccgctgatagttcaattgtgcaaagcacgaagcagcaagaagccgctgagcttgaggagaagcagagcattaagcgaaggatcctcgaatacaatgaaagggaggaggaagaactgaatggagcatcacaaatggggaactggggtcaaggagctaccaataccagcagtatcagatcaggtggccggggcagctgggatggttcaacacggggaggtggtcgacaacggcaccacatcgcgggttctggtggtttctatcacagttatggcaggagaagataa

SEQ ID NO: 10544 - protein, 1193 aa, Sorghum bicolor
  misc_feature: Ceres ANNOT ID no. 6113911
  misc_feature (474)..(662): Pfam Id: MIF4G Pfam Desc: MIF4G domain
  misc_feature (677)..(878): Pfam Id: MIF4G Pfam Desc: MIF4G domain
  misc_feature (950)..(1129): Pfam Id: Upf2 Pfam Desc: Up-frameshift suppressor 2
  misc_feature (7)..(1193): NCBI GI: 124359836 NCBI Desc: initiation factor eif-4 gamma, middle; up-frameshift suppressor 2 [medicago truncatula]
  misc_feature (15)..(1193): NCBI GI: 79570971 NCBI Desc: rna binding [arabidopsis thaliana]
  misc_feature (7)..(1024): NCBI GI: 140052391 NCBI Desc: initiation factor eif-4 gamma, middle [medicago truncatula]
  misc_feature (5)..(1137): NCBI GI: 12232320 NCBI Desc: hupf2 [homo sapiens]
  misc_feature (5)..(1137): NCBI GI: 60390647 NCBI Desc: regulator of nonsense transcripts 2 (nonsense mrna reducing factor 2) (up-frameshift suppressor 2 homolog) (hupf2)
MDNVQSENRTDTKQDDDVRQSKQDDEEARLEEYKKIIDQKTSLRRSNLNPERPDANYLRTLDSSIKRNTTVIKKLKTINDEQKDGLMDELKSVNLSKFVSEAVSYICEAKLRSADIQAAVQVCSLLHQRYKDFSPCLIQGLLKVFFPGKSGDDLDADKNSRAMKKRSTLKLLIELYFVGIVEDASIFVNIIKDLTSAEHLKDREGTQTNLSLLSTFARQGKFFLGLQSHGQEAYDEFFKDLNVTAEQKKFFKKALNSYYDAVAELLQSEHASLRLMEAENAKVLSAKGELSDENTASYEKLRKSFDQLLRGVSSLAESLDMQPPVMPDDGNTTRVTTGTDALPSSGKESSALEPIWDDEDTKAFYESLPDLRAFVPAVLLGEVEPKLNEQHAKGREQSSESTSEQDTELHDNVQTSATEHQLEVKVDDVVKESEDKDKEKGKDGEKEKSKEKDLDKKNEREKEKGRALDGASLDNLLQRLPGCVSRDLIDQLTVEFCYLNSKANRKKLVRALFNVNRTSLELLPYYSRLVATLSTCMKDVPSMLLSMLEEEFNFLINKKDQINIETKIKNIRFIGELCKFKMAPPALVFSCLKACLDDFSHHNIDVACNLLETCGRFLYRSPETTIRMANMLEILMRLKNVKNLDPRHSTLVENAYYLCKPPERSARISKVRPPLHQYIRKLLFSDLDKSSVEHVLRQLRKLPWAECQQYLLKCFLKVHKGKYSQVHLIALLTASLSRYHDDFAVAVVDEVLEEIRVGLELNDYGMQQRRLAHMRFLGELYSYKHIDSSVVFDTLYLIIVFGHGTPEQDVLDPPEDCFRIRLIITLLQTCGHYFSKGSSKRKLDKFLLHFQRYIISKGPLPLDIEFDIQDLFAELRPNMSRYSSIEELVAALVELEENERSAPVEKVESERHSDNESQKRQPRDAGPSVNGESAANGVEENGKDHEVADSESYSDSGSIDGREEEDILSEDKSNDGSDNEGDDEDDGIPVGSDEDENVEVRQKVMKVDPKEQEDFDRELKALLQESLESRKSEARSRLPLNMMVPMNVLEGSKDSRATESESGEETVDEEGGNAGSSSKVRVKVLMKKGHKQQTRQMLIPADSSIVQSTKQQEAAELEEKQSIKRRILEYNEREEEELNGASQMGNWGQGATNTSSIRSGGRGSWDGSTRGGGRQRHHIAGSGGFYHSYGRRR

SEQ ID NO: 10545 - DNA, 486 bp, Sorghum bicolor
  misc_feature: Ceres ANNOT ID no. 6113931
  misc_feature: Encodes the peptide sequence at SEQ ID NO 10546
atggcaagacccacttcacgcgcatacctccactttgctcaggcaccgcacgccgtcgtcgtgccaacgagcccgaccaccgttggcgcgagcgaggacttcgacgagtcggacatctggggcgcgttcgcgccagcggacctgccgcaggggggcccatttctttccacgcggaaggcatcgccggcgaagccggcgccggcgccggcgccgaacggcagggccgcgcacgggtcgctgccgatgaagatcccggactggtccaagatcctgggcagcgagtaccgccctagctaccgctacggtggcggcgtcagggactggtgggagctcgacgaggaggaggactccgtggactggttgccgccccacgagctggcggggcgccgccgcgccgcgtcgatgtcgctgatgaatggggtcgtcggcaggacgctcaaggttcgggacgcggtgtggaagcacaccaccgggttccaggactga

SEQ ID NO: 10546 - protein, 161 aa, Sorghum bicolor
  misc_feature: Ceres ANNOT ID no. 6113931
  misc_feature (8)..(161): NCBI GI: 116310726 NCBI Desc: osigba0131l05.3 [oryza sativa (indica cultivar-group)]
  misc_feature (62)..(161): NCBI GI: 21741306 NCBI Desc: osjnbb0103i08.8 [oryza sativa (japonica cultivar-group)]
MARPTSRAYLHFAQAPHAVVVPTSPTTVGASEDFDESDIWGAFAPADLPQGGPFLSTRKASPAKPAPAPAPNGRAAHGSLPMKIPDWSKILGSEYRPSYRYGGGVRDWWELDEEEDSVDWLPPHELAGRRRAASMSLMNGVVGRTLKVRDAVWKHTTGFQD

SEQ ID NO: 10547 - DNA, 1005 bp, Sorghum bicolor
  misc_feature: Ceres ANNOT ID no. 6113942
  misc_feature: Encodes the peptide sequence at SEQ ID NO 10548
atgactgccggtttccagctcggtgtgattgggtctcttacgctctccgtcgcgtcatcggttgccattgtcatctgcaacaaagccctcatcagcactctaggctttccatttgctacaactttgacaagctggcacctgatggtgaccttctgcacccttcacgtcgcgcagcgtctgcgcttcttcgagcccaaggccattgatgggcagacggtagttttgtttgggttgctaaatggaacctcgattggccttctgaaccttagcttaggattcaattccattggattctaccagatgacaaagttggccataatacccttcacagtgctattggagactatattcctcaagaaaagattcagtgagacaatcaagttttctcttctggtcttgctacttggagttggcatcgcttcagttaccgacctcaagttaaattacctcggatctgttctttctggcctcgccatagccacgacttgtgttggccaaattaggaagctgaaggtctcatcaacgcagcttctgtaccaatcagcgccttaccaggcagccattctgttcgccactggccccttcgtggaccatctcctcaccggccgcagcgtcttcgcccacatatacactttcccagttgtgggcttcatcatcctgtcgtgcctgatcgcggtgtcggtgaacttcagcacgttcctggtgatcgggacgacgtcgccggtgacgtaccaggtgctgggccacctcaagacgtgcctggtcctgtcgttcggctacacgctgctgcacgaccccttcaccgcgcggaacatcctgggcatcctcgtcgccatcttcggcatggcgctctactccgtcttctcggtgcgtgagggcaagaagaagtccgcgggcgacgccctcccggtgtcacagatgcctgacaaggaaacggagccgctggtggcgaccaaggacaacagcgacaccaaaaaagccaacggggtagctcacgactgctaa

SEQ ID NO: 10548 - protein, 334 aa, Sorghum bicolor
  misc_feature: Ceres ANNOT ID no. 6113942
  misc_feature (151)..(287): Pfam Id: TPT Pfam Desc: Triose-phosphate Transporter family
  misc_feature (1)..(334): NCBI GI: 48717036 NCBI Desc: phosphate translocator-like [oryza sativa (japonica cultivar-group)]
  misc_feature (1)..(215): NCBI GI: 115468244 NCBI Desc: os06g0506200 [oryza sativa (japonica cultivar-group)]
  misc_feature (101)..(326): NCBI GI: 42570326 NCBI Desc: transporter-related [arabidopsis thaliana]
  misc_feature (12)..(286): NCBI GI: 145355238 NCBI Desc: dmt family transporter: glucose-6-phosphate/phosphate [ostreococcus lucimarinus cce9901]
  misc_feature (1)..(179): NCBI GI: 115440755 NCBI Desc: os01g0823200 [oryza sativa (japonica cultivar-group)]
  misc_feature: The sequence is a functional homolog of SEQ ID NO. 484 in the 11/188,298 US application
  misc_feature: The sequence is a functional homolog of SEQ ID NO. 360 in the 11/188,298 US application
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNYLGSVLSGLAIATTCVGQIRKLKVSSTQLLYQSAPYQAAILFATGPFVDHLLTGRSVFAHIYTFPVVGFIILSCLIAVSVNFSTFLVIGTTSPVTYQVLGHLKTCLVLSFGYTLLHDPFTARNILGILVAIFGMALYSVFSVREGKKKSAGDALPVSQMPDKETEPLVATKDNSDTKKANGVAHDC

SEQ ID NO: 10549 - DNA, 2100 bp, Sorghum bicolor
  misc_feature: Ceres ANNOT ID no. 6113945
  misc_feature: Encodes the peptide sequence at SEQ ID NO 10550
atggcatccggtgcttcacgaaatgtcaggtttcagaacgagatcgaggtccagagcttcagaacaaaccctctgcagccgaacctcagcagcagaaagcacggcagagttcacgatcccaggaaatgccggctgggtttccgcggcggctgcctggagaaggcgtgccggaacccgacgctgaaggacagggtgctgtcgcgcgccttctcggaggagctggagtccctgctgcacgccgccggcagcggcagccacttcttcttcgacccgcgcgggcagctgatccacctgtggaacaagatcttcctgtccgcctgcctgctgtcgctgttcgtggacccgctgttcctgtacctgacgggcacgcagcgggacaaggacaacgtgtgcatcgagttcaggtactcgctggcgctcacgctctccatgatccgctcgctgctggacctcttctacgccgcgcacatcctgttccgcttccgcaccgccttcatcgcgccgtcgtcgcgtgtgttcggccgcggcgagctcgtcatccagccctacaagatcgccaggcggtaccttggccggacgttctggttcgacctcgtcaccgcgctgcccctgccgcagttcgtgatctggatcgttataccgaagctgaatgagtcgccgacggcgaacaggaagagcatcctccgcttcagcatcatcttccagtacctcccgcggctgttccagatcttcccgctctcgagccagatcgtcatggcgacgggcgtcatggcggagacggcgtgggcctgcgccgcgtacaacctgatcctctacatgctcgcaagccacgtgctgggagcgctgtggtatctcttctcggtgcagaggcaggaggcgtgctggagggaggcgtgcctgctggagagcccgacgtgccagaccatgtccttcgactgcaaggcgttgagcagcaacaggaccgtctggtacgagctcagcaacatcacaaggctgtgcacgccgggcaacgggttctacccgttcggcatctacgcggaggcgctgcaagccaagctcccgtcgtcgtccttcacccagaagtacttctactgcttctggtggggactcaagaacctgaggtctgtactctgcttagggcagaatctgtcgacgagcttgttcatcggcgaaataaccttcgcgatcgtcatcggcgttcttgggttggtgctgtttggcctgctcatcggcaacatgcaatcttatctccaaacaacgatggtgcggctggaggagtggcggacgaagcggacggacatggagcggtggatgcaccaccggcagatcccgcagccgctgaagcagtgcgtgaggaggtaccaccagtaccagtgggtggcgacgcgcggcgtcgacgaggaggccctgctccaggacctccccatggacatccgccgcgacatcaagcgccacctctgcctggacctcgtccggagggtgcccctgttcgacgagatggacgagcggatgctggaggcgatctgcgagcggctgaggccggcgctgtacacgcgcggcacgcggctggtgcgggagctggaccccgtcgactccatgctcttcatcatccggggctacctcgactccttcacgacgcagggcgggcggtcgggcttcttcaactcgtgccgcatcggcgccggcgagttctgcggggaggagctcctgacgtgggcgctggacccgcggcccaccgcgaagaagctgccgctgtccacccgcaccgtgcgcgccgtgtccgaggtcgaggcgttcgcgctcgtcgccgacgacctccgcttcgtggcgtcgcagttcaggcgactgcacagcgcgcggatccggcacaggttccgcttctactcgcaccagtggcgcacgtgggccgcgtgcttcatccaggccgcctggcgccggcacaagcggcgccgcgcgtccgtggagctcagggcgcgcgagggcggcgaggtgttggcaggagtggggagcctgaggcggtcccgccgacacagcgtcgacggcaaggcgccgattaagaagcccatggaaccggacttcacggtggaagaagaggactga

SEQ ID NO: 10550 - protein, 699 aa, Sorghum bicolor
  misc_feature: Ceres ANNOT ID no. 6113945
  misc_feature (145)..(413): Pfam Id: Ion_trans Pfam Desc: Ion transport protein
  misc_feature (514)..(615): Pfam Id: cNMP_binding Pfam Desc: Cyclic nucleotide-binding domain
  misc_feature (55)..(668): NCBI GI: 92887759 NCBI Desc: cyclic nucleotide-binding; ion transport protein [medicago truncatula]
  misc_feature (90)..(663): NCBI GI: 7269936 NCBI Desc: cyclic nucleotide and calmodulin-regulated ion channel-like protein [arabidopsis thaliana]
  misc_feature (68)..(669): NCBI GI: 6969231 NCBI Desc: cyclic nucleotide-gated calmodulin-binding ion channel [nicotiana tabacum]
  misc_feature (89)..(658): NCBI GI: 9758363 NCBI Desc: cyclic nucleotide and calmodulin-regulated ion channel [arabidopsis thaliana]
  misc_feature (89)..(679): NCBI GI: 20197298 NCBI Desc: cyclic nucleotide and calmodulin-regulated ion channel [arabidopsis thaliana]
  misc_feature: The sequence is a functional homolog of SEQ ID NO. 503 in the 11/188,298 US application
MASGASRNVRFQNEIEVQSFRTNPLQPNLSSRKHGRVHDPRKCRLGFRGGCLEKACRNPTLKDRVLSRAFSEELESLLHAAGSGSHFFFDPRGQLIHLWNKIFLSACLLSLFVDPLFLYLTGTQRDKDNVCIEFRYSLALTLSMIRSLLDLFYAAHILFRFRTAFIAPSSRVFGRGELVIQPYKIARRYLGRTFWFDLVTALPLPQFVIWIVIPKLNESPTANRKSILRFSIIFQYLPRLFQIFPLSSQIVMATGVMAETAWACAAYNLILYMLASHVLGALWYLFSVQRQEACWREACLLESPTCQTMSFDCKALSSNRTVWYELSNITRLCTPGNGFYPFGIYAEALQAKLPSSSFTQKYFYCFWWGLKNLRSVLCLGQNLSTSLFIGEITFAIVIGVLGLVLFGLLIGNMQSYLQTTMVRLEEWRTKRTDMERWMHHRQIPQPLKQCVRRYHQYQWVATRGVDEEALLQDLPMDIRRDIKRHLCLDLVRRVPLFDEMDERMLEAICERLRPALYTRGTRLVRELDPVDSMLFIIRGYLDSFTTQGGRSGFFNSCRIGAGEFCGEELLTWALDPRPTAKKLPLSTRTVRAVSEVEAFALVADDLRFVASQFRRLHSARIRHRFRFYSHQWRTWAACFIQAAWRRHKRRRASVELRAREGGEVLAGVGSLRRSRRHSVDGKAPIKKPMEPDFTVEEED

SEQ ID NO: 10551 - DNA, 585 bp, Sorghum bicolor
  misc_feature: Ceres ANNOT ID no. 6113990
  misc_feature: Encodes the peptide sequence at SEQ ID NO 10552
atggcagagacggtgttcaccccatctttggaagggatgaagcatgtcaaggcagagaacggagtcattctcaccaagcccttccttgatgtctgcaagcaaatcttgcctgtcctcgataaatttggagctgctatggcaattgtaaagactgatatcggtggcaatatcacaagactggaaaacaagtattgttcagatccatcaaagtatgaacatttgtacaccatggctcaggaagaagttcaaaacaagaccgcaaaaggttcctcaagctgcacaaatgggcttctgtggctcacgagggccatggatttccttgtcgagttgtttcgtaacctgcttgagcatccagattggaccatgagtcaagcttgcactgattcatacaccaagactctgaagaaatttcatggctggcttgccagttctagttttacggtggccatgaagcttgctcccaatagagataaatttatggaggtcattagtggaactggtgacatcaatgcagatattgagaaattttgcacaaccttctcacctttcctcaaagaaaatcacaactttctgctggaattttag

SEQ ID NO: 10552 - protein, 194 aa, Sorghum bicolor
  misc_feature: Ceres ANNOT ID no. 6113990
  misc_feature (10)..(195): Pfam Id: GLTP Pfam Desc: Glycolipid transfer protein (GLTP)
  misc_feature (1)..(191): NCBI GI: 47847777 NCBI Desc: glycolipid transfer protein-like [oryza sativa (japonica cultivar-group)]
  misc_feature (25)..(194): NCBI GI: 38344077 NCBI Desc: osjnba0006b20.21 [oryza sativa (japonica cultivar-group)]
  misc_feature (25)..(194): NCBI GI: 116309799 NCBI Desc: h0525c06.1 [oryza sativa (indica cultivar-group)]
  misc_feature (20)..(193): NCBI GI: 44980802 NCBI Desc: abl064wp [eremothecium gossypii]
  misc_feature (20)..(193): NCBI GI: 45185166 NCBI Desc: abl064wp [eremothecium gossypii]
  misc_feature: Useful for making plants with modulated oxidative stress sensitivity
  misc_feature: GREAT-hit functional homolog of the protein sequence given in SEQ ID NO 13075
  misc_feature: Useful for making plants with modulated oxidative stress sensitivity
  misc_feature: Functional homolog of the protein sequence given in SEQ ID NO 13075
MAETVFTPSLEGMKHVKAENGVILTKPFLDVCKQILPVLDKFGAAMAIVKTDIGGNITRLENKYCSDPSKYEHLYTMAQEEVQNKTAKGSSSCTNGLLWLTRAMDFLVELFRNLLEHPDWTMSQACTDSYTKTLKKFHGWLASSSFTVAMKLAPNRDKFMEVISGTGDINADIEKFCTTFSPFLKENHNFLLEF

SEQ ID NO: 10553 - DNA, 1398 bp, Sorghum bicolor
  misc_feature: Ceres ANNOT ID no. 6113992
  misc_feature: Encodes the peptide sequence at SEQ ID NO 10554
atggagcacgtggttggagcgaggtttaagcttgggaagaagatagggagcggatctttcggggagctctatctcggcgtcaacatacagaacggcgaggaggtggctatcaagttggaatctgtgaaatcaaggcatcctcagcttatttatgaatcgaaaatatacatgtttctccatggaggaactggaattcctaatttgaaatattttggagtggagggtgattacaatgtcatggtcattgatcttcttggtccaagtctcgaagacttgttcaactactgcaacagaaagttctctcttaaaacagtacttatgctagctgatcagatgatagccagggtagagtatatgcacacgagagggtttcttcatcgtgatatcaagccagacaacttcctcatgggcttaggctgtaaagcaagtcaggtttatgtcattgactatggccttgcgaagaagtatcgagacctccatactcatagacacataccatacagggaggacaaaaacctcacaggaacagcacgatatgctagtgtaaacacccatcttggagtagaacaaagcaggagagacgacttagagtctcttggttatgtgctgatgtacttcttaagaggaagccttccctggcaaggcctgaaagctggaacgaaaaaacaaaagtatgacaaaattagtgagaagaaaatgctaacctcaattgaggccctttgtaaatcttatccatcagaattcattacatacttccattattgccgctctttgcgatttgaagataagccagactatagctatttgaagaaaatcttccgggatttattcatccgtgaaggttaccagcctgattatgtatttgattggactgtatcaaggcaagctgcggacaataacagattgcgactgagcgggaagacaggtgggttggtgggaccatctgtggatcgggctgaacgagctgcagcaagacatgatgttgcggaaagattcactggtccagctgatgcatttactagaagaactggctctggttctggtcattatggagaacacacaaagcacagaactctgttggattctcttatggcatccaagatggctgttgattcagataaaagaaggcattcatcatctcggaatggaagcacatcaaggaaggctcttctgtcaagcagccgaggttctggagatcccagtgatccaaatcgcagtagccacctagtcccgaccactactagcagcagccgtccatcgactaatcaaaggcttcaccagtcaactggacttgagggcaggacctcatcatttccaaaagctggaagaatcggccatgatgatcctactatgaggagtattggacgccttactattagcgcagagaggaggaaatga

SEQ ID NO: 10554 - protein, 465 aa, Sorghum bicolor
  misc_feature: Ceres ANNOT ID no. 6113992
  misc_feature (9)..(278): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(465): NCBI GI: 1103318 NCBI Desc: casein kinase i [arabidopsis thaliana]
  misc_feature (1)..(459): NCBI GI: 21536851 NCBI Desc: protein kinase adk1-like protein [arabidopsis thaliana]
  misc_feature (1)..(459): NCBI GI: 18087640 NCBI Desc: at5g44100/mln1_2 [arabidopsis thaliana]
  misc_feature (1)..(458): NCBI GI: 121501708 NCBI Desc: casein kinase [beta vulgaris]
  misc_feature (26)..(438): NCBI GI: 1197461 NCBI Desc: casein kinase i [arabidopsis thaliana]
  misc_feature (1)..(401): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 332 in the 11/188,298 US application
  misc_feature: The sequence is a functional homolog of SEQ ID NO. 312 in the 11/188,298 US application
  misc_feature: The sequence is a functional homolog of SEQ ID NO. 498 in the 11/188,298 US application
  misc_feature: The sequence is a functional homolog of SEQ ID NO. 340 in the 11/188,298 US application
  misc_feature: The sequence is a functional homolog of SEQ ID NO. 399 in the 11/188,298 US application
  misc_feature: The sequence is a functional homolog of SEQ ID NO. 310 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 520 in the 11/188,298 US application
  misc_feature: The sequence is a functional homolog of SEQ ID NO. 464 in the 11/188,298 US application
  misc_feature: The sequence is a functional homolog of SEQ ID NO. 323 in the 11/188,298 US application
  misc_feature: The sequence is a functional homolog of SEQ ID NO. 441 in the 11/188,298 US application
MEHVVGARFKLGKKIGSGSFGELYLGVNIQNGEEVAIKLESVKSRHPQLIYESKIYMFLHGGTGIPNLKYFGVEGDYNVMVIDLLGPSLEDLFNYCNRKFSLKTVLMLADQMIARVEYMHTRGFLHRDIKPDNFLMGLGCKASQVYVIDYGLAKKYRDLHTHRHIPYREDKNLTGTARYASVNTHLGVEQSRRDDLESLGYVLMYFLRGSLPWQGLKAGTKKQKYDKISEKKMLTSIEALCKSYPSEFITYFHYCRSLRFEDKPDYSYLKKIFRDLFIREGYQPDYVFDWTVSRQAADNNRLRLSGKTGGLVGPSVDRAERAAARHDVAERFTGPADAFTRRTGSGSGHYGEHTKHRTLLDSLMASKMAVDSDKRRHSSSRNGSTSRKALLSSSRGSGDPSDPNRSSHLVPTTTSSSRPSTNQRLHQSTGLEGRTSSFPKAGRIGHDDPTMRSIGRLTISAERRK

SEQ ID NO: 10555 - DNA, 2331 bp, Sorghum bicolor
  misc_feature: Ceres ANNOT ID no. 6113994
  misc_feature: Encodes the peptide sequence at SEQ ID NO 10556
atgggcgcgggcaacaagcgcggacaccctctcctgaggggagtaggcgcgaggagtgagaagtacacccacgggttctcggcgtcccagatggccgcgctcaccgccctctgcggcgcgctggtgccgtccctgccgccggaccgccgcaacggccaccaccaccaccaccacccgcaggaggacgacggcggccgcggcgggggcgacggcgacggcaacagcagcaaggtcgtggaggagttcctcctcgcgtcggccgccgacccgcccgtgcccggcgaggtggccgagctcatgtcgcgcaagtgcctccccgaggcgctggcgctggtgcgcacggtgctgtggctgctgggcacgcggcccggctcgctggcgctgtgcggggcccggccgtgcctgtcgtggcggctcccgttcgtgcgccggttcgacgagctgcctctggagcagcgggaggccgcgctccggcggtggagccggcagaccctgctcccaccgctgcgcatgttcttcgtcatcgtcaaggtcttctgcctctacgtcttctactcctggaccgatgagaacttaaagaatccgcactggcgcgcgatcgggtacagcccgcccctagccgacgacgagccgacgccggcggaatcagagcgtcccgagaagcgtcccctcgacgacggcatcgtggagacgaccaaggagactgacgcgtccctgccggcgttgctagccgagaagggcctcgcggtggccgatgacgcggcgcggaacgtgtggagggtcgagtgcgacgttgtcatcatcggttccggctgcggcgggggcgtggcggcagcggtgctcgcgggggctgggcacaaggcggtcgtcatcgagaaaggaaactacttcacgtcgagcgattacacggccgtcgaggcgccgtcgatggagcatctctatgagggcggagggttcgtcagcacgctcagcggaagcgcgctgctcctggcaggctcgacggtcggaggcggcacggcggtgaactggtcagcctgcatcaagacccctgacgacgttcgcgaggagtgggcgcgcaaccaggggctcccgttgttcgccaccgacgagtacgccgccgccatggacaaggtgttcgagcggctcggcgtgacggccgggtgcgcggaggaggggctccagaacaaagtcctccgcaagggatgcgagaagctcgggtacaaagtggagtcggtgtcgaggaactcgtcggaggggcactactgcggcagctgcggttacggctgccgcaccggcgacaagcgcggcacggaccgtacgtggctggtcgacgcggtgacccgcggcgcggtcatcttgacggggtgcaaggccgagaagctgctgctggagcgtatggtcactggaggacgtgcggacggcagggcgaaacgatgcgtcggcgtggtggcgaggagcaccaacccggcgatcacgaggacgctggaggtgcgcgccagggcgaccgtctcggcgtgcgggtcgctcctgacgccggtgctgctgcgcgggagcgggctgagcaatcggcacatcggcaagaacctccacctccacccgacagccctggtgtggggctacttcccggacaccatgccggacctcaagggcaagacgtacgagggcggcatcatcacgtccctgcacaaggtggaaggcgctccgggcgcgccggcccgcgccatcctcgaaacgccggcgatggggctggccggcgcggggacgcagttcccctgggtgtccgggagcgacatgaaggagcggatactcaggtacggccgcacggtgcacctcttctccatggtaagagaccgcggttccggcaccgtgcacggcgagcggcgggtcgcgtaccacttggacgccacggaccgggagaacatgcgcgagggcctacgccgcgcgctgcgcgtcctggcggcggcgggcgcggcggagatcggcacgcaccgcagcgacggacagcggttcgtgtgcaggggcgccacggaggcggcgctggaggagttcctggacggcgtggacgtggtgcgcgggccccagtcgaaggccgaggcgtggagcctgtgctgcacggcgcaccagatgggcagctgccggatgggcgccacggcccgggacggcgccgtggacgcgcgcggcgagagctgggaggtggagagcctgtacgtgtgcgacggcagcgtcctgcccagcgccgtgggcgtcaaccccatggtcaccatccagtccgtggcctactgcctcgccacgggcatcgccgagtcgctcaggcgcggaaagatccagtga

SEQ ID NO: 10556 - protein, 776 aa, Sorghum bicolor
  misc_feature: Ceres ANNOT ID no. 6113994
  misc_feature (310)..(547): Pfam Id: GMC_oxred_N Pfam Desc: GMC oxidoreductase
  misc_feature (609)..(766): Pfam Id: GMC_oxred_C Pfam Desc: GMC oxidoreductase
  misc_feature (98)..(773): NCBI GI: 22798796 NCBI Desc: alcohol oxidase [arabidopsis thaliana]
  misc_feature (82)..(774): NCBI GI: 42561674 NCBI Desc: alcohol oxidase-related [arabidopsis thaliana]
  misc_feature (71)..(774): NCBI GI: 42566953 NCBI Desc: alcohol oxidase-related [arabidopsis thaliana]
  misc_feature (261)..(772): NCBI GI: 144925050 NCBI Desc: glucose-methanol-choline oxidoreductase [medicago truncatula]
  misc_feature (262)..(771): NCBI GI: 6983581 NCBI Desc: long chain fatty alcohol oxidase [candida cloacae]
MGAGNKRGHPLLRGVGARSEKYTHGFSASQMAALTALCGALVPSLPPDRRNGHHHHHHPQEDDGGRGGGDGDGNSSKVVEEFLLASAADPPVPGEVAELMSRKCLPEALALVRTVLWLLGTRPGSLALCGARPCLSWRLPFVRRFDELPLEQREAALRRWSRQTLLPPLRMFFVIVKVFCLYVFYSWTDENLKNPHWRAIGYSPPLADDEPTPAESERPEKRPLDDGIVETTKETDASLPALLAEKGLAVADDAARNVWRVECDVVIIGSGCGGGVAAAVLAGAGHKAVVIEKGNYFTSSDYTAVEAPSMEHLYEGGGFVSTLSGSALLLAGSTVGGGTAVNWSACIKTPDDVREEWARNQGLPLFATDEYAAAMDKVFERLGVTAGCAEEGLQNKVLRKGCEKLGYKVESVSRNSSEGHYCGSCGYGCRTGDKRGTDRTWLVDAVTRGAVILTGCKAEKLLLERMVTGGRADGRAKRCVGVVARSTNPAITRTLEVRARATVSACGSLLTPVLLRGSGLSNRHIGKNLHLHPTALVWGYFPDTMPDLKGKTYEGGIITSLHKVEGAPGAPARAILETPAMGLAGAGTQFPWVSGSDMKERILRYGRTVHLFSMVRDRGSGTVHGERRVAYHLDATDRENMREGLRRALRVLAAAGAAEIGTHRSDGQRFVCRGATEAALEEFLDGVDVVRGPQSKAEAWSLCCTAHQMGSCRMGATARDGAVDARGESWEVESLYVCDGSVLPSAVGVNPMVTIQSVAYCLATGIAESLRRGKIQ

SEQ ID NO: 10557 - DNA, 2322 bp, Sorghum bicolor
  misc_feature: Ceres ANNOT ID no. 6113997
  misc_feature: Encodes the peptide sequence at SEQ ID NO 10558
atgggcgcgggcgacaagcggggacaccctctcctgaggggaggagccgcgaacagggagcggtacacccacggcttctcggcgtcccagatgaccgcgctcaccgccctctgcggcgcgttggtgccgtccctgccgccggaccgccggaacggtcaccagcagcaggaggacggcggccgcggcgggggcagcggcggcaacaaggacaaggtcgtggaggagttcctcctcgcctcggccgccgacccgcccgtgcccggcgaggtggccgagcagatgtcgcgcaagtgcctccccgaggcgctggcgctggtacgcacggtgctgtggctgctgggcacccggctcggctcgctggcgctgtgcggggcccggtcgtgcctgtcgtggcggttcccgttcgtgcgccggttcgacgagctgcccctggagcagcgggaggccgcgctccggcggtggagccggcagaccctgctcctgccgctgcgcatgttcttcgtcattatcaaggccatctgcctccacgtcttctactcctggaccgatgagaactcaaagaatccgcactggcgggcgatcgggtacagcccgccgctggccgacgacgagccggcgccggcggaatcagagcgtcccgagaagcgtcccctcgacgacggcgtcgtggagacgaccaaggagaccgacgcgtccctgccggcgttgctagcggcgaagggcctcacggtggccgatgactcggcgcagaacgtgtgcagggtcgagtgcgacgtcgtcatcgtcggttccgggtgcggcgggggcgtggcggcagcggtgctcgcgggggcggggcacaaggtggtcgtcatcgagaaaggaaactacttcacggcgcgggattacacggctatcgaggcgccgtcgatggagcagctctacgagggcggaggtgccgtcagcacgctcagcggcagcgcgctagtcctggcaggctctacggttggcggcggtacggcggtgaactggtcagcttgcatcaagacccctgacgacgttcgcgaggagtgggcgagcgaccaggggctcccgttgttcgccaccgacgagtacgccgccgccatggacaaggtgttcgagcggctcggcgtgacggccgggtgcgcggaggaggggctccagaacaaggtcctccgcaaggggtgcgagaagctcgggtacaaggtggagtcggtgtcaaggaactcgtcggaggggcactactgcggcagctgcggttatggctgccgcagcggcgacaagcgcggcacggaccgaacgtggctggtcgacgcggtgagccgcggcgcggtgatccttacgggatgcaaggccgagaagctgctgcttgagcgtactggcactggcggcgcggagagcagggcgaagcgatgcgtcggcgtggtggcgaggagcaccaacccgacgatcacgaggacgctggaggtgcgcgccagggtgaccgtctcggcgtgcgggtcgctcctgacgccggtgctgctgcgcgggagcgggctcagcaaccggcacatcggcaagaacctccacctccacccgacggccctggtgtggggctacttcccggacaccatgccggacctcaagggcaagacgtacgagggcggcatcatcacgtccctgcacaaggtggaaggcgctccgggcgcgccggcccgcgccatcctcgaaacgccggcgatgggcctggccggcgcggggacgctgttcccttgggtgtccgggagcgatttgaaggagcggatgctcaggtacggccgcacggtgcacctcttctccctggtgagggaccgcggttccggcagcgtgctcggagagcggcgggtcgcgtaccacttggacgccacggacgcggagaacatgcgcgagggcctgcgccgcgcgctgcgcatcctcgccgcggcgggcgcggcggagatcggcacccaccgcagcgacgggcagcggttcgcgtgcaggggcgccacggaggcggcgctggaggagttcctggacggcgtggacgtggtgcgcgggccccagtcgaaggccgaggcgtggagcctgtgctgcacggcgcaccagatgggcagctgccggatgggcgtcacggcccgggacggcgccgtggacgcgcgcggcgagagctgggaggtcgagagcctgtacgtgtgcgacggcagcgtcctacccagcgccgtgggtgtcaaccccatggtcaccatccagtccgtggcctactgcctcgccacgggcatcgccgagtcgctcaggcgtggcccggttcccgaaaagatccagtga

SEQ ID NO: 10558 - protein, 773 aa, Sorghum bicolor
  misc_feature: Ceres ANNOT ID no. 6113997
  misc_feature (304)..(540): Pfam Id: GMC_oxred_N Pfam Desc: GMC oxidoreductase
  misc_feature (92)..(766): NCBI GI: 22798796 NCBI Desc: alcohol oxidase [arabidopsis thaliana]
  misc_feature (6)..(765): NCBI GI: 42561674 NCBI Desc: alcohol oxidase-related [arabidopsis thaliana]
  misc_feature (65)..(765): NCBI GI: 42566953 NCBI Desc: alcohol oxidase-related [arabidopsis thaliana]
  misc_feature (24)..(765): NCBI GI: 144925050 NCBI Desc: glucose-methanol-choline oxidoreductase [medicago truncatula]
  misc_feature (256)..(764): NCBI GI: 6983581 NCBI Desc: long chain fatty alcohol oxidase [candida cloacae]
MGAGDKRGHPLLRGGAANRERYTHGFSASQMTALTALCGALVPSLPPDRRNGHQQQEDGGRGGGSGGNKDKVVEEFLLASAADPPVPGEVAEQMSRKCLPEALALVRTVLWLLGTRLGSLALCGARSCLSWRFPFVRRFDELPLEQREAALRRWSRQTLLLPLRMFFVIIKAICLHVFYSWTDENSKNPHWRAIGYSPPLADDEPAPAESERPEKRPLDDGVVETTKETDASLPALLAAKGLTVADDSAQNVCRVECDVVIVGSGCGGGVAAAVLAGAGHKVVVIEKGNYFTARDYTAIEAPSMEQLYEGGGAVSTLSGSALVLAGSTVGGGTAVNWSACIKTPDDVREEWASDQGLPLFATDEYAAAMDKVFERLGVTAGCAEEGLQNKVLRKGCEKLGYKVESVSRNSSEGHYCGSCGYGCRSGDKRGTDRTWLVDAVSRGAVILTGCKAEKLLLERTGTGGAESRAKRCVGVVARSTNPTITRTLEVRARVTVSACGSLLTPVLLRGSGLSNRHIGKNLHLHPTALVWGYFPDTMPDLKGKTYEGGIITSLHKVEGAPGAPARAILETPAMGLAGAGTLFPWVSGSDLKERMLRYGRTVHLFSLVRDRGSGSVLGERRVAYHLDATDAENMREGLRRALRILAAAGAAEIGTHRSDGQRFACRGATEAALEEFLDGVDVVRGPQSKAEAWSLCCTAHQMGSCRMGVTARDGAVDARGESWEVESLYVCDGSVLPSAVGVNPMVTIQSVAYCLATGIAESLRRGPVPEKIQ

SEQ ID NO: 10559 - DNA, 441 bp, Sorghum bicolor
  misc_feature: Ceres ANNOT ID no. 6114003
  misc_feature: Encodes the peptide sequence at SEQ ID NO 10560
atgaggccgcagcagcgtcgccagcagcagcatcaggtgcaggaaggcgcccgcgcccgcctcctcgcggcgaccccgtcgcggcacgacgcgccggacgacgacgcggcgcggacggcggcggtcaccaaggggtgcgcgacgttcttggtcggggaggaaggggaggccccgcggcgggtggcggtgcccgtggcgcgcctgggacacccgcggatgctggagctgctcggggaggccagggaggagtacggcttcgcgcaccagggcgccgtcgtcgtcccgtgcgccgtcgagcggttcatgcgggcggtggaggaggcgtcggcggggaacaggcacgagcaccgccacggacaccaccaccaccaccaccaccactttcgcctgcctcacgttcgcatcgcccgctgctttaggccgtcgcgcgtccttgtttag

SEQ ID NO: 10560 - protein, 146 aa, Sorghum bicolor
  misc_feature: Ceres ANNOT ID no. 6114003
  misc_feature (3)..(109): Pfam Id: Auxin_inducible Pfam Desc: Auxin responsive protein
  misc_feature (44)..(140): NCBI GI: 115482888 NCBI Desc: os10g0510500 [oryza sativa (japonica cultivar-group)]
  misc_feature (26)..(139): NCBI GI: 38603994 NCBI Desc: at5g53590 [arabidopsis thaliana]
  misc_feature (42)..(124): NCBI GI: 92897061 NCBI Desc: auxin responsive saur protein [medicago truncatula]
  misc_feature (34)..(111): NCBI GI: 49388650 NCBI Desc: auxin-responsive protein-like [oryza sativa (japonica cultivar-group)]
  misc_feature (52)..(113): NCBI GI: 115459650 NCBI Desc: os04g0537100 [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
MRPQQRRQQQHQVQEGARARLLAATPSRHDAPDDDAARTAAVTKGCATFLVGEEGEAPRRVAVPVARLGHPRMLELLGEAREEYGFAHQGAVVVPCAVERFMRAVEEASAGNRHEHRHGHHHHHHHHFRLPHVRIARCFRPSRVLV

SEQ ID NO: 10561 - DNA, 1383 bp, Sorghum bicolor
  misc_feature: Ceres ANNOT ID no. 6114015
  misc_feature: Encodes the peptide sequence at SEQ ID NO 10562
atggacaccaccgtcgccatcgcggtggctgtcgcgaccgccgccgcactcctcgtgcgggttgcccacgccgacatcaagataacgcacatcgtgtccgacgccaggccgatcatcttcttcgaggagttcggcttcgcgagcggcggcagggccgcggtctccatacgccgcgcgacgtggcaactccgtccggggtcacgcctcaccagcgtcgacgtcgactccagcctcatgggattcgtgctcatcgccggcgcccagttcccatggatcaacaaccagacacagtactacgccgccgatccgggagacggcggcggcggcttctgcctgctgacgagcgacgactacgcgctcccgatggtccggctcagcgacgtcccgccgggcggggtcaccaccaccgtgaccatcgactaccccgacgcgtacgccgtcgtgttcagcaactgccagggcggcgtggaggtcaccatggacgtgcgcaccgagatgtacaatctgcgccgcgacgacgacgcctcctcctccggcggcgggatgatgatcagggactacctccccgtcgggctgcagccgctgccgggcatctacgcgggcgtggcggcggtgtacctggcgttcctggcggcgtgggtgtggacgtgcgcccggcagcacgccacggcggagcggatccacgccgtgatgggcgcgctgctgctgttcaaggcgctcaagtcggcgtgcgccgccgaggacacgtggttcatcgagcgcaccggcacgtcgcacggctgggacgtcgccttctacgtcttcggcttcttcaagggcgtcctgctcttcaccgtcatcgtcctcatcggcaccggctggtccttcctcaaaccctacctccaggagcgcgacaagtgcgtgcttatggtcgtgatcccgctgcaagtgatggagaacctgctgctggtggtgatcggagagacgggcccggcgcggcggggctggatcgcgtggacgcgggtcttcctgctcgtcgacgtcgtgtgctgctgcgccgtcatcttccccatcctctggtccatccggggcctgcgagaggcgtccaggaccgacggcaaggcggcgcgcaacctcaagaagctcacgctcttcaagcgcttctacttggtcgtcgtcggctacctctacttcacccggatcatcgtgtcggcgttcctcgcgctgctcaactacaggtaccggtggggagtcgacgtcgcagtcgagggcgccagcttcgccttctacctgttcgtcttctacaacttcaagccggaggagaagaacccgtacttgtacgtcggcgacgaggaggaggaggaggaggaggccgccggtgagacggacgatggggctttctga

SEQ ID NO: 10562 - protein, 460 aa, Sorghum bicolor
  misc_feature: Ceres ANNOT ID no. 6114015
  misc_feature (161)..(437): Pfam Id: Lung_7-TM_R Pfam Desc: Lung seven transmembrane receptor
  misc_feature (1)..(460): NCBI GI: 115447341 NCBI Desc: os02g0618700 [oryza sativa (japonica cultivar-group)]
  misc_feature (186)..(458): NCBI GI: 24640781 NCBI Desc: cg12121-pa [drosophila melanogaster]
  misc_feature (186)..(449): NCBI GI: 54642896 NCBI Desc: ga11416-pa [drosophila pseudoobscura]
  misc_feature (186)..(449): NCBI GI: 125981157 NCBI Desc: ga17090-pa [drosophila pseudoobscura]
  misc_feature (166)..(456): NCBI GI: 116126212 NCBI Desc: ensangp00000021419 [anopheles gambiae str. pest]
MDTTVAIAVAVATAAALLVRVAHADIKITHIVSDARPIIFFEEFGFASGGRAAVSIRRATWQLRPGSRLTSVDVDSSLMGFVLIAGAQFPWINNQTQYYAADPGDGGGGFCLLTSDDYALPMVRLSDVPPGGVTTTVTIDYPDAYAVVFSNCQGGVEVTMDVRTEMYNLRRDDDASSSGGGMMIRDYLPVGLQPLPGIYAGVAAVYLAFLAAWVWTCARQHATAERIHAVMGALLLFKALKSACAAEDTWFIERTGTSHGWDVAFYVFGFFKGVLLFTVIVLIGTGWSFLKPYLQERDKCVLMVVIPLQVMENLLLVVIGETGPARRGWIAWTRVFLLVDVVCCCAVIFPILWSIRGLREASRTDGKAARNLKKLTLFKRFYLVVVGYLYFTRIIVSAFLALLNYRYRWGVDVAVEGASFAFYLFVFYNFKPEEKNPYLYVGDEEEEEEEAAGETDDGAF

SEQ ID NO: 10563 - DNA, 633 bp, Sorghum bicolor
  misc_feature: Ceres ANNOT ID no. 6114016
  misc_feature: Encodes the peptide sequence at SEQ ID NO 10564
atggcggcggccgccggaagctcccgcgttttccccgcgctgatgatcctcaccggcgtcttcgtcttcctcctcctcgtcgttgctcccggcgtcgccgcggaggcagcagctccgccgccgccggggctggagttccgcgtgggcgggccgcgcggttggcgcgtcccggacgccaacaccagctacgactggtgggccatgaacaaccgcttccacgtcggcgaccacctctatttcaagtacgcgaacgactcggtgctggtggtggaccgcctggccttcgacgcctgcaacgccagcgagcctctggccgcgttcgcggacggcgccaccaaattccgcctcgaccgcccgggcttcttctgcttcatcagcggcgaggcggggcactgccaggaaggccagaggctcatcgtgcgcgtcatggtgcacccggcactggcctcggcgcccgcgcctggagctccgacgacagagccagccggccatgccggcgggcgccccaggccgtcggagtgctcgtgctccgacgcctcctccagtgttggcacagctatcgccgccgccgccggcgtcgccatctcggcggcaatggctacggttgttgtcctcgtcttgttgctccagtga

SEQ ID NO: 10564 - protein, 210 aa, Sorghum bicolor
  misc_feature: Ceres ANNOT ID no. 6114016
  misc_feature (54)..(136): Pfam Id: Cu_bind_like Pfam Desc: Plastocyanin-like domain
  misc_feature (17)..(208): NCBI GI: 53792667 NCBI Desc: ntepc-like [oryza sativa (japonica cultivar-group)]
  misc_feature (22)..(161): NCBI GI: 27529822 NCBI Desc: ntepc-like protein [nicotiana tabacum]
  misc_feature (44)..(158): NCBI GI: 22775566 NCBI Desc: phosphoprotein ntepb3 [nicotiana tabacum]
  misc_feature (45)..(202): NCBI GI: 119720752 NCBI Desc: copper ion binding/electron transporter [brassica rapa]
  misc_feature (44)..(153): NCBI GI: 22775562 NCBI Desc: phosphoprotein ntepb1 [nicotiana tabacum]
MAAAAGSSRVFPALMILTGVFVFLLLVVAPGVAAEAAAPPPPGLEFRVGGPRGWRVPDANTSYDWWAMNNRFHVGDHLYFKYANDSVLVVDRLAFDACNASEPLAAFADGATKFRLDRPGFFCFISGEAGHCQEGQRLIVRVMVHPALASAPAPGAPTTEPAGHAGGRPRPSECSCSDASSSVGTAIAAAAGVAISAAMATVVVLVLLLQ

SEQ ID NO: 10565 - DNA, 1575 bp, Sorghum bicolor
  misc_feature: Ceres ANNOT ID no. 6114027
  misc_feature: Encodes the peptide sequence at SEQ ID NO 10566
  misc_feature: Up-regulated in shoot tissues in response to salicylic acid treatment
atggtaggcggcggcgagggggatcgagtgggcggcggcggcggaggcggaggcggtttgggggttgggggaggccagcagttcgtggaccggagcaaggtgaggattcttctctgcgacggtgatgccaccagctccagggaggtgctgcggctcctctgcaactgctcgtaccatgtaacttgcgccaagtctccgcggcaggtgatcaatattctcaactatgagggtggcgagatcgacatcatcctggctgaggttgatctgccggtctccaagtgcttcaagatgctcaagtacattgccaggaacaaggacctgcgccacatcccaatcatcatgatgtccaacagagatgaggtgtctgttgttgtcaagtgcttgcggcttggtgcggctgagtacctggtgaagccgctgcgcacgaatgagctgctgaacctttggacccatgtgtggcggcggagacggatgcttggtttgcccgagaaaaacttcttccatgacaacttcgagttggtgctctcagaacctagtgatgccaacaccaatagcaccaccctcctctcagacgagacagacgataggcctaaagaaaacatgaatcaagaaacgggcacctcaaatcaacttgaatacgagtccaatccttctgttgctgagcctgaccagagagacaagatggagggtgtaccaggttctgtcgtagatgccagtcaagcatcctctccgggaagaatgttttcacgccctataaaaactaacctgaggattgctgagtcgtctgcatttctagcatatgttaagacaagcacaccaaccaccagctcacttgatagcgaattacaaagaggtggcagtcagttagattctttggataaccagggtaattgctctagtgcaacagatagaagtgacaccgttactgatgtaaatattcggaataaagaagcttttgagatgcctgtgcagtaccctatggtgtgcttttcttcctctaacacacatatggagcgaagcaatgaaggccataatgatacttcaggaactccacctgtataccatttcccattttattatccagggatggtagagcacaacatggcagtttcatcagtgcaaaattttcaagcaaacataaacaatgctcaagcacatacaccaccaacgatgcttccccagtacaatgtttatccccaatgccatggtttacctatgatatcatcatttcagtttaatcctgcgggcatgaatatgcactcaagtcatttaccgacacaaaatgtgtggtcatcggcatcaagcacaccaatgcctgaggaaacatgcaatcgctctgaaaggagggctgcagcacttgccaaattcaggcagaaaaggaaagagcgctgctttgacaagaaggtgaggtatgtgaaccggaagaaacttgctgaaacaaggcctagggtgcgaggtcaatttgttagacaggcaagcaatacagatatcaccagcactggagatgatatctctgaagacgaagatgacgatccatcgtccagggaggtagatatcgtttcctctccagagtag

SEQ ID NO: 10566 - protein, 524 aa, Sorghum bicolor
  misc_feature: Ceres ANNOT ID no. 6114027
  misc_feature (449)..(493): Pfam Id: CCT Pfam Desc: CCT motif
  misc_feature (34)..(150): Pfam Id: Response_reg Pfam Desc: Response regulator receiver domain
  misc_feature (1)..(524): NCBI GI: 68565719 NCBI Desc: two-component response regulator-like prr1 (pseudo-response regulator 1) (osprr1)
  misc_feature (1)..(524): NCBI GI: 51571875 NCBI Desc: pseudo-response regulator 1 [oryza sativa (japonica cultivar-group)]
  misc_feature (24)..(238): NCBI GI: 29028744 NCBI Desc: at5g61380/mfb13_150 [arabidopsis thaliana]
  misc_feature (24)..(238): NCBI GI: 6996313 NCBI Desc: abi3-interacting protein, aip1 [arabidopsis thaliana]
  misc_feature (14)..(341): NCBI GI: 51980216 NCBI Desc: timing of cab expression 1 protein [castanea sativa]
  misc_feature: The sequence is a functional homolog of SEQ ID NO 932 in the 10/666,642US patent application
  misc_feature: The sequence is a functional homolog of SEQ ID NO 934 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 932 in the 20070033671 US patent application
  misc_feature: The sequence is a functional homolog of SEQ ID NO 934 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: Up-regulated in shoot tissues in response to salicylic acid treatment
  misc_feature: The sequence is a functional homolog of SEQ ID NO. 378 in the 11/188,298 US application
  misc_feature: The sequence is a functional homolog of SEQ ID NO. 370 in the 11/188,298 US application
MVGGGEGDRVGGGGGGGGGLGVGGGQQFVDRSKVRILLCDGDATSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFHDNFELVLSEPSDANTNSTTLLSDETDDRPKENMNQETGTSNQLEYESNPSVAEPDQRDKMEGVPGSVVDASQASSPGRMFSRPIKTNLRIAESSAFLAYVKTSTPTTSSLDSELQRGGSQLDSLDNQGNCSSATDRSDTVTDVNIRNKEAFEMPVQYPMVCFSSSNTHMERSNEGHNDTSGTPPVYHFPFYYPGMVEHNMAVSSVQNFQANINNAQAHTPPTMLPQYNVYPQCHGLPMISSFQFNPAGMNMHSSHLPTQNVWSSASSTPMPEETCNRSERRAAALAKFRQKRKERCFDKKVRYVNRKKLAETRPRVRGQFVRQASNTDITSTGDDISEDEDDDPSSREVDIVSSPE

SEQ ID NO: 10567 - DNA, 1677 bp, Sorghum bicolor
  misc_feature: Ceres ANNOT ID no. 6114032
  misc_feature: Encodes the peptide sequence at SEQ ID NO 10568
atggatccagcacaatatttccaacccaggacattctcaataaagttgtggccaccaagtgaaagcacacggctcatgcttgttgagaggatgacaaagaatctgtccacagagtcagagtccattttctctcgcaaatacggtactttgggcaaggaagaagctcatgagaatgcaaaaaggattgaagaactttgctttgcctcggctgatgagcatttcaaaagggagccagatggtgatgggagttctgctgtccagctatatgcaaaggaaacgagcaagatgatgttggaagttctgaaaaaaggccctaggactactgcagaactggaagcacctgtagctgatacacctctagtgcctgatacacctcttgtgcctgctgatacacctcttgtgcctgctgatactgtactagatatatctggtggcaagcgtgcttttattgaggcagatgaagcaaaggaactgctgagtccacttacaaaaccaggaaattcatatcaaagaatatgctttagcaacaggagctttggtattggcgctgctaatgttgctgggccaattcttgagtcagttaagaatcagctcacagaggtagatatctcagattttgtggcaggaaggcctgaggatgaagctcttgatgtgatgcgcatattctccaaagcattagagggttctgtcctgagatatctgaacatctctgacaatgctttgggtgagaagggtgtcagggcattcagtgagcttctgaaatcacaggaatccctggaagaactatatgtgatgaatgacggtatatcagaggaagctgcaaaagctctatctgagcttattcctgcaactgagaagctcaaggttcttcacttccacaacaatatgactggagatgaaggtgctatgtatatcgctgagatggttaagcgttctccaaatgtagagagtttcaggtgctcagcaacaaggataggatctgatggtggagtcgcattgtctgaggcattagggacatgcactcgtctgaagaaacttgatctccgggacaacttgtttggtgttgatgcagggttagctctcagcaaaacccttccaaagcttcctgatcttgttgagctttatctcagtgatctcaatcttgagaacgagggcacaatcgcaattgtcaaagccctcaaacagtcagcaccgcagttggaggtccttgaaatggcaggaaatgaaataaatgccaaagcagccccagatttggcagaatgcttaacagcaatgcagtcactgaagaagctgaccttggctgaaaatgaactgaaggatggcggtgctgtgattattgcaaaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctctgatgaagggattgatgaggtgaaggaaattctgaaggctggtaagaaatccctggatgttctgggctcactagatgagaatgaacctgacggggagcctgatgatgaggaagaggaccaggatgctgaggacaatgaggatgagctggattcgaagctgcagagtgtgaaggttgagcaggatgattga

SEQ ID NO: 10568 - protein, 558 aa, Sorghum bicolor
  misc_feature: Ceres ANNOT ID no. 6114032
  misc_feature (7)..(554): NCBI GI: 6626184 NCBI Desc: ran gtpase activating protein [medicago sativa subsp. x varia]
  misc_feature (8)..(558): NCBI GI: 15239712 NCBI Desc: ran gtpase activating protein 2 (rangap2) [arabidopsis thaliana]
  misc_feature (8)..(558): NCBI GI: 6708468 NCBI Desc: ran gtpase activating protein 2 [arabidopsis thaliana]
  misc_feature (8)..(555): NCBI GI: 140071286 NCBI Desc: mhc class ii transactivator [medicago truncatula]
  misc_feature (190)..(558): NCBI GI: 47085695 NCBI Desc: zgc:66165 [danio rerio]
MDPAQYFQPRTFSIKLWPPSESTRLMLVERMTKNLSTESESIFSRKYGTLGKEEAHENAKRIEELCFASADEHFKREPDGDGSSAVQLYAKETSKMMLEVLKKGPRTTAELEAPVADTPLVPDTPLVPADTPLVPADTVLDISGGKRAFIEADEAKELLSPLTKPGNSYQRICFSNRSFGIGAANVAGPILESVKNQLTEVDISDFVAGRPEDEALDVMRIFSKALEGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSKTLPKLPDLVELYLSDLNLENEGTIAIVKALKQSAPQLEVLEMAGNEINAKAAPDLAECLTAMQSLKKLTLAENELKDGGAVIIAKSLEDGHTDLKELDVSTNMLQRVGARCFARAVADKPAFVQLNINGNFISDEGIDEVKEILKAGKKSLDVLGSLDENEPDGEPDDEEEDQDAEDNEDELDSKLQSVKVEQDD

SEQ ID NO: 10569 - DNA, 1035 bp, Sorghum bicolor
  misc_feature: Ceres ANNOT ID no. 6114044
  misc_feature: Encodes the peptide sequence at SEQ ID NO 10570
atggcgatcaagcttgctcgggcattggcgatctggtgcctcgccgtcctgcttctactcctgccgtgcacggctcgccccatctccgaaacgagcaccatcgacgggagccggagcaagcacctgccgctccgcggttcgctgctgcgcggcccggagagcgtggccttcgacggcgcgggcgccggtccttacagcggcgtctccgacggccgcgtcctcaagtggaacggcttcgcgcgcgggtggtcgacgtacgcgtacgggccgggctacgacgccgcggcctgcacggcgtccagggctcggccggcggagctcaccgagagcaagtgcggccgcccgctaggcctgcggttccaccacgcgtcgggcaacctctacatcgcggacgcgtacaaggggctgatgcgcgtcggcccgggcggcggcgaggccacggtgctggccgcggaggccgacggcgtgccgctccgcttcaccaacggggtcgacgtcgaccaggtcaccggggacgtcttcttcacggacagcagcatgaactacccgcggtcgcagcacgagagggtgaccgccaccggggactcgtccggccgcatcatgaagtacgaccccaagacgggccaagttcgcgtgctgctggccggcgtcacgtaccccaatggcctcgccattagcgccgacaggacgcacctcgtggtcgcgctcactgggccgtgcaagctgcttagatactggatcgaaggtcccaaggcgggcacggctgagcacctcgctgacttgccgggctaccctgacaatgtgagggccgatggcagaggagggttttgggtggcactgcaccgcgaaaagatggagctgccctttggtccggacagccacctgctcgccgtcagggtcggagccgacggacaggtggtccaggtgatgagagggcccaagagcgtgaggccgacggaggtggtggagaggggaggcggcaagctgtacatgggctcggtagaactaccctatgtcgccgttgttagggaatag

SEQ ID NO: 10570 - protein, 344 aa, Sorghum bicolor
  misc_feature: Ceres ANNOT ID no. 6114044
  misc_feature (162)..(250): Pfam Id: Str_synth Pfam Desc: Strictosidine synthase
  misc_feature (44)..(335): Pfam Id: SGL Pfam Desc: SMP-30/Gluconolaconase/LRE-like region
  misc_feature (16)..(343): NCBI GI: 115478879 NCBI Desc: os09g0374900 [oryza sativa (japonica cultivar-group)]
  misc_feature (51)..(280): NCBI GI: 14028757 NCBI Desc: male fertility protein [zea mays]
  misc_feature (15)..(284): NCBI GI: 30694556 NCBI Desc: strictosidine synthase family protein [arabidopsis thaliana]
  misc_feature (49)..(281): NCBI GI: 140040327 NCBI Desc: strictosidine synthase [medicago truncatula]
  misc_feature (21)..(281): NCBI GI: 115455371 NCBI Desc: os03g0750700 [oryza sativa (japonica cultivar-group)]
MAIKLARALAIWCLAVLLLLLPCTARPISETSTIDGSRSKHLPLRGSLLRGPESVAFDGAGAGPYSGVSDGRVLKWNGFARGWSTYAYGPGYDAAACTASRARPAELTESKCGRPLGLRFHHASGNLYIADAYKGLMRVGPGGGEATVLAAEADGVPLRFTNGVDVDQVTGDVFFTDSSMNYPRSQHERVTATGDSSGRIMKYDPKTGQVRVLLAGVTYPNGLAISADRTHLVVALTGPCKLLRYWIEGPKAGTAEHLADLPGYPDNVRADGRGGFWVALHREKMELPFGPDSHLLAVRVGADGQVVQVMRGPKSVRPTEVVERGGGKLYMGSVELPYVAVVRE

SEQ ID NO: 10571 - DNA, 1005 bp, Sorghum bicolor
  misc_feature: Ceres ANNOT ID no. 6114068
  misc_feature: Encodes the peptide sequence at SEQ ID NO 10572
atggcgaagggcggcggggagaggggcgcgctgctgccggtctcggcggacgacgacgggaagggcaacggcggagggggaggcggcgacgatgccgtgctgttcaagggctccgccatgacccgccgcggcgccgccgccgcgctctcctacatggcatgctccgtattgctagtgatgtttaacaaagcagctctgtcttcgtataatttcccttgtgcaaatgtcatcacgctccttcagatggtgtgctcaacgtgccttctttatgttctgagacggttaaagatcatctccttcacaaatagtgatccatcagtgccttctgattcactattctttgtgccgtttaggttactgttgcgcaccacacctctttccttggcttatttactctacatgctggcctcgatggaatcagtccgtggagttaacgttcctatgtatacaactctacggcgcacaacagtcgtgtttacaatgacaatggaatatttcctggcaaagcagaagcacaccccacctataataggcagtgtggctttgattgtattcggagcattcgttgctggagctcgagacttgtcatttgatgctcgtgggtatgctattgtctttgtggccaacattacgacagctgtttatcttgctactatcaaccgtataggacttgtctgtggaccttcagtactgttcttgacatatattcagggtgacctaaggaggaccgtggaatttccgtacctttactcccctgggttcatggttgtgctgttattttcgtgcatcttagcatttctactgaactacactatcttctggaacacaatcctgaattctgcactcacacaatcgatgtgtgggaacttgaaggatttcttcaccgttggaattggttgggttctatttggtgggcttccttttgatcttcttaatgttatcggacagggattaggctttttgggctctggattgtatgcctactgcaagatcaaaggaaagtag

SEQ ID NO: 10572 - protein, 334 aa, Sorghum bicolor
  misc_feature: Ceres ANNOT ID no. 6114068
  misc_feature (201)..(328): Pfam Id: TPT Pfam Desc: Triose-phosphate Transporter family
  misc_feature (44)..(334): Pfam Id: UAA Pfam Desc: UAA transporter family
  misc_feature (20)..(334): NCBI GI: 119613052 NCBI Desc: solute carrier family 35, member d2, isoform cra_a [homo sapiens]
  misc_feature (20)..(334): NCBI GI: 42734308 NCBI Desc: solute carrier family 35, member d2 [homo sapiens]
  misc_feature (47)..(328): NCBI GI: 1665787 NCBI Desc: similar to a c.elegans protein encoded in cosmid c52e12 (u50135) [homo sapiens]
  misc_feature (47)..(328): NCBI GI: 85567498 NCBI Desc: solute carrier family 35 (udp-glucuronic acid/udp-n-acetylgalactosamine dual transporter), member d1 [homo sapiens]
  misc_feature (46)..(328): NCBI GI: 51468006 NCBI Desc: solute carrier family 35 (udp-glucuronic acid/udp-n-acetylgalactosamine dual transporter), member d1 [danio rerio]
  misc_feature: The sequence is a functional homolog of SEQ ID NO. 360 in the 11/188,298 US application
  misc_feature: The sequence is a functional homolog of SEQ ID NO. 484 in the 11/188,298 US application
MAKGGGERGALLPVSADDDGKGNGGGGGGDDAVLFKGSAMTRRGAAAALSYMACSVLLVMFNKAALSSYNFPCANVITLLQMVCSTCLLYVLRRLKIISFTNSDPSVPSDSLFFVPFRLLLRTTPLSLAYLLYMLASMESVRGVNVPMYTTLRRTTVVFTMTMEYFLAKQKHTPPIIGSVALIVFGAFVAGARDLSFDARGYAIVFVANITTAVYLATINRIGLVCGPSVLFLTYIQGDLRRTVEFPYLYSPGFMVVLLFSCILAFLLNYTIFWNTILNSALTQSMCGNLKDFFTVGIGWVLFGGLPFDLLNVIGQGLGFLGSGLYAYCKIKGK

SEQ ID NO: 10573 - DNA, 672 bp, Sorghum bicolor
  misc_feature: Ceres ANNOT ID no. 6114069
  misc_feature: Encodes the peptide sequence at SEQ ID NO 10574
atgggtgaggaggccagctgcaacgccgtcagcgcgatggaggccgccaccaacgccaagccggcggccaaggagaacggctgcgcggccgccgtggcccaggaggaggcggcccccgtggccgcggccgacccccggctgcagggcatctccgacgccatccgcgtcgtgccgcacttccccaagcaaggcatcatgttcaacgacatcaccacgctgctgctgcgccccggggtgttcaaggacgccgtcgacctgttcgtcgagcgctaccgtgggatgcgcatcgacgccgtcgccgggattgaggccaggggcttcatatttggcccagcaattgcgttggctattggcgccaagttcataccgctgcgcaagcctaggaagctcccaggtgaggtgatctctgagaagtatgttctcgagtacgggactgattgcttagagatgcatgttggagctatcgaacggcctggtgagcgtgtgctgatcatcgatgacttggttgcaaccggagggacactttgtgctgcaattaggcttcttgaacgtgctgaagctgatgttgtcgagtgtgcatgtctcattgggctcccaaaattcaaggatttctacaagttgaatggaaagcctgtatacgtgctggttgagtcccgtgaatcagataaataa

SEQ ID NO: 10574 - protein, 223 aa, Sorghum bicolor
  misc_feature: Ceres ANNOT ID no. 6114069
  misc_feature (69)..(204): Pfam Id: Pribosyltran Pfam Desc: Phosphoribosyl transferase domain
  misc_feature (1)..(220): NCBI GI: 32693279 NCBI Desc: adenine phosphoribosyltransferase [triticum aestivum]
  misc_feature (30)..(220): NCBI GI: 32490261 NCBI Desc: osjnbb0116k07.3 [oryza sativa (japonica cultivar-group)]
  misc_feature (30)..(220): NCBI GI: 29826070 NCBI Desc: adenine phosphoribosyltransferase form 2 [oryza sativa (indica cultivar-group)]
  misc_feature (1)..(220): NCBI GI: 40019121 NCBI Desc: adenine phosphoribosyltransferase [zea mays]
  misc_feature (30)..(202): NCBI GI: 70663925 NCBI Desc: osjnba0014k14.11 [oryza sativa (japonica cultivar-group)]
  misc_feature (44)..(223): SWISSPROT Homolog: EC 2.4.2.7 Adenine phosphoribosyltransferase 2
  misc_feature: The sequence is a functional homolog of SEQ ID NO. 524 in the 11/188,298 US application
MGEEASCNAVSAMEAATNAKPAAKENGCAAAVAQEEAAPVAAADPRLQGISDAIRVVPHFPKQGIMFNDITTLLLRPGVFKDAVDLFVERYRGMRIDAVAGIEARGFIFGPAIALAIGAKFIPLRKPRKLPGEVISEKYVLEYGTDCLEMHVGAIERPGERVLIIDDLVATGGTLCAAIRLLERAEADVVECACLIGLPKFKDFYKLNGKPVYVLVESRESDK

SEQ ID NO: 10575 - DNA, 1749 bp, Sorghum bicolor
  misc_feature: Ceres ANNOT ID no. 6114077
  misc_feature: Encodes the peptide sequence at SEQ ID NO 10576
atgggtggtgtctgctcaaggaagagaagccaattggtggatgaaggtgactctctccagacatccccaaggttctcaaagaccagcagcttaaaatggttgttgcttacactgccccgcagcaattctgatgtctctgggaaggggcaggggaatgaacctggacggtgcccgtccctcatggagctctgtgtcgctagaatctgccaggatatcggcaagtattctacttttgcaatgctgccgagggatctcagccagcagattttcaatgaattggtaaattcaaaccgtcttatggaggcatcgcttcaagttttcagggattgtgctctgcaggacattggcttaggggagtaccctggagtaaaggatgcttggatggaagtagtggcatctcaaaggcagtcattgttgtcggttgatatttcttgctctgaagtaactgatagtgggatagatcttcttagagattgctcaagcatgcaaagcttggcatgtaattactgtgatcaaatatccgaaagtgggctggtcgtattgtcaggactgtcaaacctgacttctctaagcctcaagagaagtaatgctgttactgctgaaggaatgagagcctttgcaaatttagtgaacttactaagtctcgaccttgaaggttgcctaaagattcatggtggccttattcatttaaaagatctgacaaagctcgagtcattgaatatgagatattgcaattatattgcggattcagatatcaaatatttaacagatcttacaaatttgaaggaccttcgattgtcatgttgtaagatcacagatctgggggtgtcgtatatcagaggcttgcagaagctcactcacttgaacctagagggctgcccagtgaccgcttcttgtttggaagctatttcaggattgtcttcattggtattgttgaacttgaaccgttgtggtatatacgatgatggctgtgaaaactttgaaggtcttaaaaggttgaaggttttaaacttggggtttaactatattacagatgcttgtttggtgcatctcaaaggattaatcagtttggagtctttgaacttggattcgtgcaaggttggagatgatggtctatcacagctgaaaggtcttgtgctgcttcaaagcttggatctttctgatactgaagttggaaacaatggactccagcatctatctggtctttgtgatctgcaaagtattaatctctcatttacttcggtcacggacattggtatgaagaagatctccatgttgaattcgctgaagtcagtcaaccttgacaatcgccaaattactgatgttggcttggcagcacttacaagtctcactaggctgactcatcttgacctttttggagctcgcataactgactatggcacaaactgcttcagatattttaagaatcttctttctcttgaagtctgtggtgggttcgttactgatgctggagtgaagaacatcaaggatctaaaggctctgacactgctaaatctttctcaaaatgttaatctgacagacaaaaccttggaactgatctctggcctgactgctttggtcaacttgaacgtgtcaaactcgcgggtatccaatgctggtctcaaacacctgaatgacctgcagaacctgcgttcactgtctctagactccacccgggtcacggcaaacgagatgaggaagctccgagcaacgatgctgccaaatctgatcagcatgcggccagagtaa

SEQ ID NO: 10576 - protein, 582 aa, Sorghum bicolor
  misc_feature: Ceres ANNOT ID no. 6114077
  misc_feature (1)..(582): NCBI GI: 116310796 NCBI Desc: osigba0112m24.4 [oryza sativa (indica cultivar-group)]
  misc_feature (1)..(582): NCBI GI: 115459280 NCBI Desc: os04g0503500 [oryza sativa (japonica cultivar-group)]
  misc_feature (1)..(582): NCBI GI: 140064242 NCBI Desc: leucine-rich repeat; leucine-rich repeat, cysteine-containing subtype [medicago truncatula]
  misc_feature (1)..(582): NCBI GI: 92896655 NCBI Desc: leucine-rich repeat; leucine-rich repeat, ribonuclease inhibitor subtype; leucine-rich repeat, cysteine-containing subtype [medicago truncatula]
  misc_feature (46)..(582): NCBI GI: 8927653 NCBI Desc: contains similarity to f-box protein fbl2 from homo sapiens gbaf176518 and contains multiple leucine rich pf00560 repeats. ests gbz34572, gbz34571, gbai100681, gbai100675,
  misc_feature (46)..(582): NCBI GI: 8927653 (continued) gbaa395320, gbai100674, gbaa651378, gbaa007067, gbt46145, gbt22090, gbai995016, gbh36884, gbai995066, gbh37061, gbt43537 come from this gene. [arabidopsis thaliana]
MGGVCSRKRSQLVDEGDSLQTSPRFSKTSSLKWLLLTLPRSNSDVSGKGQGNEPGRCPSLMELCVARICQDIGKYSTFAMLPRDLSQQIFNELVNSNRLMEASLQVFRDCALQDIGLGEYPGVKDAWMEVVASQRQSLLSVDISCSEVTDSGIDLLRDCSSMQSLACNYCDQISESGLVVLSGLSNLTSLSLKRSNAVTAEGMRAFANLVNLLSLDLEGCLKIHGGLIHLKDLTKLESLNMRYCNYIADSDIKYLTDLTNLKDLRLSCCKITDLGVSYIRGLQKLTHLNLEGCPVTASCLEAISGLSSLVLLNLNRCGIYDDGCENFEGLKRLKVLNLGFNYITDACLVHLKGLISLESLNLDSCKVGDDGLSQLKGLVLLQSLDLSDTEVGNNGLQHLSGLCDLQSINLSFTSVTDIGMKKISMLNSLKSVNLDNRQITDVGLAALTSLTRLTHLDLFGARITDYGTNCFRYFKNLLSLEVCGGFVTDAGVKNIKDLKALTLLNLSQNVNLTDKTLELISGLTALVNLNVSNSRVSNAGLKHLNDLQNLRSLSLDSTRVTANEMRKLRATMLPNLISMRPE

SEQ ID NO: 10577 - DNA, 1416 bp, Sorghum bicolor
  misc_feature: Ceres ANNOT ID no. 6114080
  misc_feature: Encodes the peptide sequence at SEQ ID NO 10578
atggctgccgcgttaacccgcctccgatccgccgtcgagcggctcgggccctcccgcgcccgcgtccgcgccttctccgcagccgctgctgaggccgaggcggccagcgactctagggctttcaccgcggccgcggtggccgccggctcggggctggggatctggctgctgtcctcgaacccgcagccgctcgcggactccggcctggcggaggatgccaccaccgcaggcggcggaggcaacagcggcttccccgcagctttcggcggtgttggagccaccggggagcgggaggccagattcctcttcggggattcatatcgccgaagggtgttcttcaagtatgagaaaaggattaggacgcgcagccctccagagaagatctttgagtacttcgcatccgtccacagcccggagggtgagatgtacatgttacctaccgacctgatgagggcggtcgttcccgttttccccccatcagagtccaaaattgtcagggaagggagattgaggggggagcgccaccctggcgagctacagtgtgccccatctgagtttttcatgctattcgatacaaatggtgatggagtcatctccttttctgagtatatcttctttgtaacattacttagcatccctgaatcaagcttcaatgtggctttcaagatgtttgatcttgatcacaatggggaaattgacaaagatgagtttaggaaagtgatgacactgatgcgatcctataatagacaaggagctgctcatagggatggtttacgctttggacgtaaggtttgtcagccggtggaagatggtggactggtcgagtacttctttggcaaggatgggaatgaacatctacactatgataagttctctagttttttgaagcaattgcatgatgagattgtccgcttggagttcagtcactacgatgtgaaatcatccaacacaatacctgtgaaggactttgctttatccatggttgcttctgctgatatgaattacatagacaaattactggatagagtcgacgatttggatgacaatcttgacctcaaggatctgcgcattaccttcgaggagttcaaggcatttgctgatcttcgaagaaggttggaaccatttgcaatggccatcttcagctatggcaaagtaaatggtttgttgacgaagcaggatctaaaacgtgctgcatcacatgtttgtggagtggacttgactgacaaagtagtggacataattttccatgtgtttgatgctaactctgatggtaacctgagctcagaggagttcctgaggtcattacaaagaagagaaggtgacattcgccagccagcaacttcaggtttcctaggggtgattgcctgctggctgaactgtacgaagtgttctcttcaacagatgctgccccagtag

SEQ ID NO: 10578 - protein, 471 aa, Sorghum bicolor
  misc_feature: Ceres ANNOT ID no. 6114080
  misc_feature (182)..(210): Pfam Id: efhand Pfam Desc: EF hand
  misc_feature (216)..(244): Pfam Id: efhand Pfam Desc: EF hand
  misc_feature (61)..(467): NCBI GI: 115447275 NCBI Desc: os02g0613000 [oryza sativa (japonica cultivar-group)]
  misc_feature (3)..(469): NCBI GI: 116310795 NCBI Desc: osigba0112m24.3 [oryza sativa (indica cultivar-group)]
  misc_feature (2)..(469): NCBI GI: 115459274 NCBI Desc: os04g0502900 [oryza sativa (japonica cultivar-group)]
  misc_feature (2)..(442): NCBI GI: 70663918 NCBI Desc: osjnba0014k14.4 [oryza sativa (japonica cultivar-group)]
  misc_feature (39)..(462): NCBI GI: 92896653 NCBI Desc: calcium-binding ef-hand [medicago truncatula]
MAAALTRLRSAVERLGPSRARVRAFSAAAAEAEAASDSRAFTAAAVAAGSGLGIWLLSSNPQPLADSGLAEDATTAGGGGNSGFPAAFGGVGATGEREARFLFGDSYRRRVFFKYEKRIRTRSPPEKIFEYFASVHSPEGEMYMLPTDLMRAVVPVFPPSESKIVREGRLRGERHPGELQCAPSEFFMLFDTNGDGVISFSEYIFFVTLLSIPESSFNVAFKMFDLDHNGEIDKDEFRKVMTLMRSYNRQGAAHRDGLRFGRKVCQPVEDGGLVEYFFGKDGNEHLHYDKFSSFLKQLHDEIVRLEFSHYDVKSSNTIPVKDFALSMVASADMNYIDKLLDRVDDLDDNLDLKDLRITFEEFKAFADLRRRLEPFAMAIFSYGKVNGLLTKQDLKRAASHVCGVDLTDKVVDIIFHVFDANSDGNLSSEEFLRSLQRREGDIRQPATSGFLGVIACWLNCTKCSLQQMLPQ

SEQ ID NO: 10579 - DNA, 549 bp, Sorghum bicolor
  misc_feature: Ceres ANNOT ID no. 6114081
  misc_feature: Encodes the peptide sequence at SEQ ID NO 10580
atggcggagcagcccgagtggggaatactagccttcccgcagcgttcttttggcccaatttgctatggtgccttgcttacagagaaggctttcctcaagcagcctaaggttttcctctgctcgaagaaggccgccaaggggaataagcctggcaagggtggcaacaggttctggaagaacattggccttggtttcaagactcccagggaagccatcgaaggaacctacattgataagaaatgcccattcactggcactgtgtcaattagaggccgcatcattgctggaacatgccatagcgccaaaatgaacaggaccatcattgttcgtaggaactaccttcactttgtcaagaaatatcagaggtatgagaagaggcactctaacatccccgcccacatttccccttgctttcgtgtgaaggaaggagaccatgtgattattggccagtgcaggccactgtccaagacggtgaggtttaatgtgctgaaggttatccctgccgggtcaaagagtggtgcagtgaagaaggcattcactgctgcctga

SEQ ID NO: 10580 - protein, 182 aa, Sorghum bicolor
  misc_feature: Ceres ANNOT ID no. 6114081
  misc_feature (96)..(165): Pfam Id: Ribosomal_S17 Pfam Desc: Ribosomal protein S17
  misc_feature (27)..(182): NCBI GI: 115459270 NCBI Desc: os04g0502300 [oryza sativa (japonica cultivar-group)]
  misc_feature (27)..(182): NCBI GI: 116310793 NCBI Desc: osigba0112m24.1 [oryza sativa (indica cultivar-group)]
  misc_feature (27)..(180): NCBI GI: 92876749 NCBI Desc: nucleic acid-binding, ob-fold, subgroup [medicago truncatula]
  misc_feature (27)..(181): NCBI GI: 62287477 NCBI Desc: 40s ribosomal protein s11
  misc_feature (27)..(182): NCBI GI: 22470 NCBI Desc: ribosomal protein s11 [zea mays]
MAEQPEWGILAFPQRSFGPICYGALLTEKAFLKQPKVFLCSKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 10581 - DNA, 666 bp, Sorghum bicolor
  misc_feature: Ceres ANNOT ID no. 6114094
  misc_feature: Encodes the peptide sequence at SEQ ID NO 10582
atggcgtcccttttcaaggacccgagcaagctttcggcgtacagggaccgtcgattcaaggggacgcaggaggagtatgaggcgacgctgcttgcgtcgactacgctgtacattgggaacatgtccttctacaccacggaggagcaagcctacgagctcttctcccgcgccggcgagatcaagaagatcatcatgggcctcgacaagaactccaagaccccatgcggtttctgcttcgtgctgtactactctagagaggatgctgaagatgctgtcaaatacattagtggaacgatgcttgatgatcgtccaatccgtgttgatttcgattggggctttgaagaaggcaggcaatggggccgtggacgaagtggtggacaaagggaactagaagcacaaagagaattagttgactatggtggatcttttcaaccgaatgcaccacctccctatgagagaggtgagcggaagagaggatacggagattctcataggaatgacagaggagattaccagcggaaacgctatcggaacgacgaccggtcggcaccagaggagtccaagagagcaccagactctgatccagcggagaagaatcccagattccgtgagaaaggtgactctgatgaagaagaggatgactacgacaagagacgtcgtcgctag

SEQ ID NO: 10582 - protein, 221 aa, Sorghum bicolor
  misc_feature: Ceres ANNOT ID no. 6114094
  misc_feature (36)..(107): Pfam Id: RRM_1 Pfam Desc: RNA recognition motif. (a.k.a. RRM, RBD, or RNP domain)
  misc_feature (1)..(217): NCBI GI: 30692291 NCBI Desc: cap-binding protein cbp20 [oryza sativa (japonica cultivar-group)]
  misc_feature (1)..(127): NCBI GI: 46949206 NCBI Desc: cap-binding protein [mirabilis jalapa]
  misc_feature (10)..(127): NCBI GI: 61371311 NCBI Desc: nuclear cap binding protein subunit 2 [synthetic construct]
  misc_feature (10)..(127): NCBI GI: 119574009 NCBI Desc: nuclear cap binding protein subunit 2, 20kda, isoform cra_d [homo sapiens]
  misc_feature (10)..(127): NCBI GI: 60654827 NCBI Desc: nuclear cap binding protein subunit 2 [synthetic construct]
  misc_feature: Useful for making plants with modulated water use efficiency
  misc_feature: Functional homolog of the protein sequence given in SEQ ID NO 13633
  misc_feature: The sequence is a functional homolog of SEQ ID NO. 458 in the 11/188,298 US application
  misc_feature: The sequence is a functional homolog of SEQ ID NO. 339 in the 11/188,298 US application
MASLFKDPSKLSAYRDRRFKGTQEEYEATLLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQRELEAQRELVDYGGSFQPNAPPPYERGERKRGYGDSHRNDRGDYQRKRYRNDDRSAPEESKRAPDSDPAEKNPRFREKGDSDEEEDDYDKRRRR

SEQ ID NO: 10583 - DNA, 336 bp, Sorghum bicolor
  misc_feature: Ceres ANNOT ID no. 6114101
  misc_feature: Encodes the peptide sequence at SEQ ID NO 10584
atgaaattaagtgttctgaatgttcaggctgggaggcacaccattattctgatgcagccatctcagaatagggcttctagaacatttatggattacaattcggttaatcatgcattggatgggatctgtgggctttatgaaaggaaaattagggatatcaacccaatggtcccaaacataacttatgatatcagcgacctctataacttcattgatggcctagctgacattagtgctctggtttatgatcactcgattcaggcatttctgccatacgatcgacagtggataaagcaaaagttgtttcaacacctgaagaaactggctcagcggtag

SEQ ID NO: 10584 - protein, 111 aa, Sorghum bicolor
  misc_feature: Ceres ANNOT ID no. 6114101
  misc_feature (11)..(111): Pfam Id: ER Pfam Desc: Enhancer of rudimentary
  misc_feature (10)..(111): NCBI GI: 90265134 NCBI Desc: h0711g06.8 [oryza sativa (indica cultivar-group)]
  misc_feature (10)..(111): NCBI GI: 115459236 NCBI Desc: os04g0499200 [oryza sativa (japonica cultivar-group)]
  misc_feature (10)..(109): NCBI GI: 3452091 NCBI Desc: rudimentary enhancer [glycine max]
  misc_feature (13)..(110): NCBI GI: 92882167 NCBI Desc: enhancer of rudimentary [medicago truncatula]
  misc_feature (13)..(110): NCBI GI: 28829284 NCBI Desc: similar to xenopus laevis (african clawed frog). enhancer of rudimentary homologue erh [dictyostelium discoideum]
MKLSVLNVQAGRHTIILMQPSQNRASRTFMDYNSVNHALDGICGLYERKIRDINPMVPNITYDISDLYNFIDGLADISALVYDHSIQAFLPYDRQWIKQKLFQHLKKLAQR

SEQ ID NO: 10585 - DNA, 303 bp, Sorghum bicolor
  misc_feature: Ceres ANNOT ID no. 6114107
  misc_feature: Encodes the peptide sequence at SEQ ID NO 10586
atggccgagctacggtatcgttttgattgggatcagaaatgcgtggatgtatctcctcatccgcggttacagattcagattgagataaaaacagcacctgctgacttccgcttccctacaacaaaccaaacaaggcattgttttactcgctacgtcgagtaccacaggtgtgtgaacgccaaaggggacgatgctggtgattgtgaaaaatttgccaagtattacaggtccctttgccctggagaatgggttgagaaatggaacgagcagagggagagtgggacgtttccaggacctctctga

SEQ ID NO: 10586 - protein, 100 aa, Sorghum bicolor
  misc_feature: Ceres ANNOT ID no. 6114107
  misc_feature (27)..(99): Pfam Id: COX6B Pfam Desc: Cytochrome oxidase c subunit VIb
  misc_feature (26)..(100): NCBI GI: 90265127 NCBI Desc: h0711g06.1 [oryza sativa (indica cultivar-group)]
  misc_feature (26)..(100): NCBI GI: 38345393 NCBI Desc: osjnba0067k08.22 [oryza sativa (japonica cultivar-group)]
  misc_feature (26)..(100): NCBI GI: 115459224 NCBI Desc: os04g0498200 [oryza sativa (japonica cultivar-group)]
  misc_feature (26)..(100): NCBI GI: 116310722 NCBI Desc: osigba0092e01.14 [oryza sativa (indica cultivar-group)]
  misc_feature (23)..(100): NCBI GI: 21592329 NCBI Desc: cytochrome c oxidase subunit 6b [arabidopsis thaliana]
  misc_feature (30)..(100): SWISSPROT Homolog: EC 1.9.3.1 Cytochrome c oxidase subunit VIb isoform 1
MAELRYRFDWDQKCVDVSPHPRLQIQIEIKTAPADFRFPTTNQTRHCFTRYVEYHRCVNAKGDDAGDCEKFAKYYRSLCPGEWVEKWNEQRESGTFPGPL

SEQ ID NO: 10587 - DNA, 1359 bp, Sorghum bicolor
  misc_feature: Ceres ANNOT ID no. 6114118
  misc_feature: Encodes the peptide sequence at SEQ ID NO 10588
atgctctggtcaatggacccgcaggtgaccgtccatggggactgggtgtcagccgtggtgccgctgatgaagctgctgtgcctggcggtcatcggcctgctcctcgccaaccctcgggttcaggtcgtgcccagggccaccttcaagctgctgagcaagctcgtcttcgcgctcttcctcccctgcctcatcttcgtccacctcggcaagtcggtcaccatagacaacgtcctgcactggtggttcatccctgtcaacgtgctcatcagcactgccatcgggtgcgttcttgggtacatcgtggccctgatctgccgcccgccgccgcacctgttccggttcacggtgatcatgaccggttttggcaacacggggaacctcccgattgcgatcatcgggtcggtctgccataccaatgatcatcccttcggtcctggatgtgacaccatgggtatcgcttatgtctcgttcgcacagtgggttgcagttattcttgtgtacactttggtctaccacatgatggagccaccgatgcagttctatgagattgttggtgaggggaatgagatacagcaagaacctgaacagatcagcagcaactacagtagatctctgcttcatgaggcggagtggccagggatggttgacaaagtaactgagcattcaaagacaccattcattgcaagagttttcatgagcatttcaggttcctcacagaatacatttcctgaaattgattttactgaagaaggaacttctggtgctggacctagcagccctaagtcgctcagatgtttggcagagccaagagtggtcaggaggatcagggttgtagctgagaagactccaattcagcacgtccttcagccaccgacaatcgcctctttacttgccattatcattggcatggttcctgtcttgaaagattttgtgtttggggctgatgcaccgctctcattcttcactgacagtttggaaatcctagctgctgctgtggttccatcagtgatgttaattctaggaggcatgcttgcggaaggcccaaaagataatgccttgggcatgaggactatcatcggtataattgtggccaggcttttggttctcccatgcattggcattggtgttgtgaccctagcagacaagttgcatctactcgttgagcaaaaccatatgtaccgctttgtgctttccctccagtactccacaccaagtgctatcctgcttggagcaattgccagtctcagaggctatggtgttaaggaagcatccgcccttctattctggcagcatatttgtgcagtgttctctctttccctctacctgattgtatacttcaagttgttttctttcatttga

SEQ ID NO: 10588 - protein, 452 aa, Sorghum bicolor
  misc_feature: Ceres ANNOT ID no. 6114118
  misc_feature (17)..(442): Pfam Id: Mem_trans Pfam Desc: Membrane transport protein
  misc_feature (270)..(448): NCBI GI: 56201894 NCBI Desc: auxin efflux carrier family protein-like [oryza sativa (japonica cultivar-group)]
  misc_feature (270)..(448): NCBI GI: 115440695 NCBI Desc: os01g0818000 [oryza sativa (japonica cultivar-group)]
  misc_feature (270)..(441): NCBI GI: 22329697 NCBI Desc: auxin efflux carrier family protein [arabidopsis thaliana]
  misc_feature (18)..(450): NCBI GI: 115480587 NCBI Desc: os09g0554300 [oryza sativa (japonica cultivar-group)]
  misc_feature (18)..(206): NCBI GI: 92867962 NCBI Desc: auxin efflux carrier [medicago truncatula]
MLWSMDPQVTVHGDWVSAVVPLMKLLCLAVIGLLLANPRVQVVPRATFKLLSKLVFALFLPCLIFVHLGKSVTIDNVLHWWFIPVNVLISTAIGCVLGYIVALICRPPPHLFRFTVIMTGFGNTGNLPIAIIGSVCHTNDHPFGPGCDTMGIAYVSFAQWVAVILVYTLVYHMMEPPMQFYEIVGEGNEIQQEPEQISSNYSRSLLHEAEWPGMVDKVTEHSKTPFIARVFMSISGSSQNTFPEIDFTEEGTSGAGPSSPKSLRCLAEPRVVRRIRVVAEKTPIQHVLQPPTIASLLAIIIGMVPVLKDFVFGADAPLSFFTDSLEILAAAVVPSVMLILGGMLAEGPKDNALGMRTIIGIIVARLLVLPCIGIGVVTLADKLHLLVEQNHMYRFVLSLQYSTPSAILLGAIASLRGYGVKEASALLFWQHICAVFSLSLYLIVYFKLFSFI

SEQ ID NO: 10589 - DNA, 1479 bp, Sorghum bicolor
  misc_feature: Ceres ANNOT ID no. 6114135
  misc_feature: Encodes the peptide sequence at SEQ ID NO 10590
atgtctgtcgcctcctcccaccacctgcggccgtcgccgtcgccggcagcggccggcccggcgcggcgcccgggctgcgccgcggcgccacgcgtgtcgctctggccagccggtgcctcgcccccgtaccgcggccgctgcaccgtcgtggcggcggctgcgcctgccgcgggcgccggcggaggcgaggcagcctcggcccccgctgctgtgtcggcggtcgcccccgcggccgccgccgctagggacaaggtgcggcgccacacgatttcggtgttcgtcggggacgaaagcggcatgatcaaccgcatcgccggggtcttcgccaggagaggctacaacatcgagtcgctcgccgtggggctcaacaaggacaaggccctcttcaccattgtcgtctccgggaccgacagggtgctcaaccaagtcatcgagcagctcaataagcttgtcaacgtccttagtgtcgaagatctatctaaagaacctcaggttgaaagagagctgatgcttataaaactaaacgttgaacctgatcagcgccctgaggtcatggttttagttgatattttcagagcaaaagttgttgatatatctgagaaaacacttaccatagaggtagctggagatcctggcaaaattgctgcagtgcagcggaatctaaggaaattcggaatcaaagaaatttgcaggacaggaaaaattgctttgagacgtgaaaagattggtgcaacagcccgtttctggcaattttctgctgcttcttacccagaccttatagaggcattgccgaaaaatccaattacatctgtaaataggacagtgaatggcagttttgatcaaccatccaatgctgggggtgatgtctatcctgtggaatcttacgagagcttatcagcaaaccatgtacttgatgctcattggggtgttctggatgatgatgatgatgcaactggacttcgctcgcataccctctccattcttgtgaatgactgtcctggtgtcctcaacattgtaacaggagtctttgctcgcaggggctacaatatacagagccttgctgttggcccagctgagaaggaaggcatttcgcgtattacaacagttgttcctggtactgttgaatccattgagaagttagttcagcagctttacaagcttgttgatgtgcatgaagttcatgacattactccctcaccttttgctgaaagggaactgatgcttattaaggtttctgtaaacactgctgctcggagggaaatcctagatattgccgaaatcttccgagcaaaacctgttgatgtttctgaccatacagtaacgcttcagcttactggagattttgacaagatggttgcactacaaaggttattggagccatatggcatctgcgaggtcgccagaactggacgagtggcactggtccgcgaatcgaaggtcgactccaagtacctccgcggctactctcttccattgtag

SEQ ID NO: 10590 - protein, 492 aa, Sorghum bicolor
  misc_feature: Ceres ANNOT ID no. 6114135
  misc_feature (88)..(152): Pfam Id: ACT Pfam Desc: ACT domain
  misc_feature (323)..(389): Pfam Id: ACT Pfam Desc: ACT domain
  misc_feature (100)..(469): NCBI GI: 5931761 NCBI Desc: acetolactate synthase small subunit [nicotiana plumbaginifolia]
  misc_feature (156)..(492): NCBI GI: 144924647 NCBI Desc: acetolactate synthase, small subunit [medicago truncatula]
  misc_feature (28)..(397): NCBI GI: 115484977 NCBI Desc: os11g0256000 [oryza sativa (japonica cultivar-group)]
  misc_feature (323)..(486): NCBI GI: 67921725 NCBI Desc: acetolactate synthase, small subunit [crocosphaera watsonii wh 8501]
  misc_feature (323)..(486): NCBI GI: 126657041 NCBI Desc: acetolactate synthase small subunit [cyanothece sp. ccy0110]
  misc_feature (323)..(486): SWISSPROT Homolog: EC 2.2.1.6 Acetolactate synthase small subunit
MSVASSHHLRPSPSPAAAGPARRPGCAAAPRVSLWPAGASPPYRGRCTVVAAAAPAAGAGGGEAASAPAAVSAVAPAAAAARDKVRRHTISVFVGDESGMINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTIEVAGDPGKIAAVQRNLRKFGIKEICRTGKIALRREKIGATARFWQFSAASYPDLIEALPKNPITSVNRTVNGSFDQPSNAGGDVYPVESYESLSANHVLDAHWGVLDDDDDATGLRSHTLSILVNDCPGVLNIVTGVFARRGYNIQSLAVGPAEKEGISRITTVVPGTVESIEKLVQQLYKLVDVHEVHDITPSPFAERELMLIKVSVNTAARREILDIAEIFRAKPVDVSDHTVTLQLTGDFDKMVALQRLLEPYGICEVARTGRVALVRESKVDSKYLRGYSLPL

SEQ ID NO: 10591 - DNA, 1494 bp, Sorghum bicolor
  misc_feature: Ceres ANNOT ID no. 6114150
  misc_feature: Encodes the peptide sequence at SEQ ID NO 10592
atgggtcagtgcttgtcgtgggcgctgggcctgctcctgccgtcgctgtgggaggccgaggtcgccatctccgccacggcgctgctcatcgccgcgctcatcctcttcctcttgacgtcggaccagcacgccaagtccacggcggccgccagcggcaacacgccaccctcgtcgtccgcgcgttcatctgccaccgcagcagccgcgggccgcggccgccggacccgcgcgagcggagaggcggcctctgaaatcacttgcgctcagggtggtcgcggcggcggctacatcatcaagctggagctgctctcggccaagtacctgatcggcgccaacttggacggcagctccgatcctttcgccgtcatctcctgcgccgaccagaagcgtttcagttccatggtgcccagccagagaaaccctctgtggggagaggagttcaatttcctggttgaacaactcccggttgaggtaaccataacaatatatgattgggacactttgtgcaaatgcaaagttattggatctgtaaccatagctgttctcactgaaaatgaatccggggctagttggtatgaactggacagcaaatttggtcagatctgcctgcgtcttcgttcaactaaagcatttccagattctgatagattgttcaccaaagttactcctgtgctctggagagatgttttttgctccatggccgtgattatcccattgcaagacatatacgagataaaaagaagtcagcattctcttatcaatccagcaattactatttttcttaatgctggtgcaggtggacatggaacacctcgtgcatgcagtcaaaatggaaggatcaggtatacctttgcatcattctggagtagaaaccgtacatttagagctctagaggctgcactacaaagttatgaagcaaccttggaagctgaaaaacaggtgagagcacatgtacttctacaaatagaacataacagtgtgttctgcagtaagtcagacaacacaaagataccagaaaaaaacactgaaaaggctataaaattccaacctttcatcaatgaccatgtccttgcagatgtaaccagtctgagcaggtggtgtgcctcagaagagtacggtggcaaggttcgtgaagtgactttcaggtcacaatgccacagtcctttgtgccctccagacaccacagtgacagaatggcagcatgcctctttctcaaaggataaaaggaacttggtctatgagacaaagcaccaggcacatgatgttccttttggttcttactttgaggtggtcgctaagaacaacctccagttcgacatgtcaagtgtaaacatgaagaaatggtgcatattgcaatccagaataaaatctggagcaaccgatgagtaccggagagaagtttgcaagattttggaggctgcttgtgattatttcctcaaatctgagtcaaatagccatgacagtgacgaaattgtgatggcatcttcaccatga

SEQ ID NO: 10592 - protein, 497 aa, Sorghum bicolor
  misc_feature: Ceres ANNOT ID no. 6114150
  misc_feature (98)..(178): Pfam Id: C2 Pfam Desc: C2 domain
  misc_feature (93)..(217): NCBI GI: 140070025 NCBI Desc: c2; gram [medicago truncatula]
  misc_feature (89)..(216): NCBI GI: 50726252 NCBI Desc: c2 domain-containing protein-like [oryza sativa (japonica cultivar-group)]
  misc_feature (97)..(217): NCBI GI: 4193489 NCBI Desc: glut4 vesicle protein [rattus norvegicus]
  misc_feature (97)..(217): NCBI GI: 33859650 NCBI Desc: membrane bound c2 domain containing protein [mus musculus]
  misc_feature (98)..(197): NCBI GI: 51814441 NCBI Desc: no pollen; osnop [oryza sativa (japonica cultivar-group)]
MGQCLSWALGLLLPSLWEAEVAISATALLIAALILFLLTSDQHAKSTAAASGNTPPSSSARSSATAAAAGRGRRTRASGEAASEITCAQGGRGGGYIIKLELLSAKYLIGANLDGSSDPFAVISCADQKRFSSMVPSQRNPLWGEEFNFLVEQLPVEVTITIYDWDTLCKCKVIGSVTIAVLTENESGASWYELDSKFGQICLRLRSTKAFPDSDRLFTKVTPVLWRDVFCSMAVIIPLQDIYEIKRSQHSLINPAITIFLNAGAGGHGTPRACSQNGRIRYTFASFWSRNRTFRALEAALQSYEATLEAEKQVRAHVLLQIEHNSVFCSKSDNTKIPEKNTEKAIKFQPFINDHVLADVTSLSRWCASEEYGGKVREVTFRSQCHSPLCPPDTTVTEWQHASFSKDKRNLVYETKHQAHDVPFGSYFEVVAKNNLQFDMSSVNMKKWCILQSRIKSGATDEYRREVCKILEAACDYFLKSESNSHDSDEIVMASSP

SEQ ID NO: 10593 - DNA, 1056 bp, Sorghum bicolor
  misc_feature: Ceres ANNOT ID no. 6114151
  misc_feature: Encodes the peptide sequence at SEQ ID NO 10594
atgagtgcggtcgaggaagatggccatagttcacggtgtgacctatgcgacaccgatgttgtacatagcatggcagaaatcttgctttgtggattggccacagcttcagtggacagcaccacgggcgatatattcaagagcgcatcttctgtagttgttgctgtgaagaccgagctagaaaatgatctgcttgcgagaactgaatcgcttattcgtgagtttgtggatggagcccaggatcattcagatcaattaatgaaagcgtccaccaggccgaccgagttcctatcagacttgattgatgactttgtggcttccaaaaggaacttgctgagccatgtgtctgggtttttgtctagtgaaagccgcttgaacaaaattaaagattttatgcagaagatggagaaggagaatgtgtggacactggacgtaaggcaggctacctcagagactattcttgaaagcatagacatgaaatgcattttccactgtcccgaaaaatttgatgagcaagacaagctggctgaccatagaagtcagtgcaagtttagagtagtggactgcaaaaatgatggatgctcaatttcactttctgctattcgtatcgaggagcatgactccatctgtccatttaaggccctgccatgtgtgcagctgtgcgagcaacatgttatgcgttgtgagatggaaaaacattgtgcaacagtttgtgctatgaagcttattaactgtcctttctaccatgttggatgtgaaacagcctttccacaaggtaatcttgagaatcactgttcgaagctacttcaaacgcatctgctgtatgttctccaagcaagtacaagacaaaatgctgctgttaatgatatgaatcaacgattacaactccttgagaaggctcagtcacttaacgaaatctctggggctttagatgttaggtccctcactctgataataaaggagcaagaagcaaagatcaagaatctcgagagtggtataaaagcacaagaggcaaaggtgaagaagcttgagaacgagtttaggtcaaggaatgcatga

SEQ ID NO: 10594 - protein, 351 aa, Sorghum bicolor
  misc_feature: Ceres ANNOT ID no. 6114151
  misc_feature (205)..(263): Pfam Id: zf-TRAF Pfam Desc: TRAF-type zinc finger
  misc_feature (4)..(327): NCBI GI: 21741757 NCBI Desc: osjnba0060b20.16 [oryza sativa (japonica cultivar-group)]
  misc_feature (4)..(207): NCBI GI: 38605870 NCBI Desc: osjnba0060b20.8 [oryza sativa (japonica cultivar-group)]
  misc_feature (160)..(304): NCBI GI: 37650544 NCBI Desc: tnf receptor associated factor 5 [sus scrofa]
  misc_feature (164)..(304): NCBI GI: 6755867 NCBI Desc: tnf receptor-associated factor 5 [mus musculus]
  misc_feature (164)..(304): NCBI GI: 2138180 NCBI Desc: tnf receptor associated factor 5 [homo sapiens]
MSAVEEDGHSSRCDLCDTDVVHSMAEILLCGLATASVDSTTGDIFKSASSVVVAVKTELENDLLARTESLIREFVDGAQDHSDQLMKASTRPTEFLSDLIDDFVASKRNLLSHVSGFLSSESRLNKIKDFMQKMEKENVWTLDVRQATSETILESIDMKCIFHCPEKFDEQDKLADHRSQCKFRVVDCKNDGCSISLSAIRIEEHDSICPFKALPCVQLCEQHVMRCEMEKHCATVCAMKLINCPFYHVGCETAFPQGNLENHCSKLLQTHLLYVLQASTRQNAAVNDMNQRLQLLEKAQSLNEISGALDVRSLTLIIKEQEAKIKNLESGIKAQEAKVKKLENEFRSRNA

SEQ ID NO: 10595 - DNA, 813 bp, Sorghum bicolor
  misc_feature: Ceres ANNOT ID no. 6114154
  misc_feature: Encodes the peptide sequence at SEQ ID NO 10596
atggcacagacgacgaagctcgccgtcgccgccgccgtcctggcggcgctcgtcctctcggcgggcgcgcagaactgcgggtgcgcgtcggaccagtgctgcagcaagtacgggtactgcgggacgggcgaggactactgcggcgccgacacgtgccagtcgggcccctgcgacgtgccggcgaccaacaacgtgtccgtggccagcatcgtgacgccggccttcttcgacgcgctcctcgcgcaggccgccgcctcctgcgaggccaacggcttctacacccgcgacgccttcctcgccgccgccggctactacccgtccttcggccgcaccggcaccgtcgacgactccaagcgcgagatcgccgccttcttcggcaacgccaaccacgagaccataaagttctgctacatcaacgagatcgacgggccgagcaagaactactgcgacgcgaacaacacggagtggccgtgccaggcggggaaagggtactacgggcgaggcccgctgcagatctcgtggaactacaactacgggccggcggggcagagcatcggcttcgacgggctgggcgaccccgacgcggtggcgcgcagcgccgtcgtcgcgttccgggcggcgctctggtactggatgaacagcgtgcacggggtcttcgtctccgggcagggcttcggcgccaccatccgggccatcaacggcgcgctcgagtgcgacggcaagaacccggactccgtcaacgaccgcgtcgcctactacaagcagttctgccaggatttcggcgtcgacccaggaagcaacctcacatgctga

SEQ ID NO: 10596 - protein, 270 aa, Sorghum bicolor
  misc_feature: Ceres ANNOT ID no. 6114154
  misc_feature (70)..(270): Pfam Id: Glyco_hydro_19 Pfam Desc: Chitinase class I
  misc_feature (23)..(57): Pfam Id: Chitin_bind_1 Pfam Desc: Chitin recognition protein
  misc_feature (7)..(270): NCBI GI: 121663827 NCBI Desc: class iv chitinase [nicotiana tabacum]
  misc_feature (13)..(270): NCBI GI: 33329392 NCBI Desc: class iv chitinase [vitis vinifera]
  misc_feature (7)..(270): NCBI GI: 38345421 NCBI Desc: osjnbb0091e11.12 [oryza sativa (japonica cultivar-group)]
  misc_feature (7)..(270): NCBI GI: 116634838 NCBI Desc: osigba0103o01.6 [oryza sativa (indica cultivar-group)]
  misc_feature (13)..(270): NCBI GI: 2306811 NCBI Desc: class iv endochitinase [vitis vinifera]
  misc_feature (1)..(270): SWISSPROT Homolog: EC 3.2.1.14 Endochitinase A precursor
  misc_feature: The sequence is a functional homolog of SEQ ID NO 12 in US patent 7087810
MAQTTKLAVAAAVLAALVLSAGAQNCGCASDQCCSKYGYCGTGEDYCGADTCQSGPCDVPATNNVSVASIVTPAFFDALLAQAAASCEANGFYTRDAFLAAAGYYPSFGRTGTVDDSKREIAAFFGNANHETIKFCYINEIDGPSKNYCDANNTEWPCQAGKGYYGRGPLQISWNYNYGPAGQSIGFDGLGDPDAVARSAVVAFRAALWYWMNSVHGVFVSGQGFGATIRAINGALECDGKNPDSVNDRVAYYKQFCQDFGVDPGSNLTC

SEQ ID NO: 10597 - DNA, 792 bp, Sorghum bicolor
  misc_feature: Ceres ANNOT ID no. 6114156
  misc_feature: Encodes the peptide sequence at SEQ ID NO 10598
atgaagatccagtgcgacgcgtgcgagggcgcggcggccacggtggtgtgctgcgccgacgaggccgcgctgtgcgcgcgctgcgacgtcgagatccacgccgccaacaagctcgccagcaagcaccagcgcctcccgctcgaggcgctctccgccaggctcccccgctgcgacgtctgccaggagaaagcggcgttcatcttctgcgtggaggaccgggcactcttctgccgggactgcgacgagcccatccacgtcccgggcacgctctccgggaaccaccagcgctacctggccaccggcatccgcgtggggttcgcctccgcctccgcctgcagcagcgacggcgcctgcgacgcgcacgactccgaccaccacgccccgcccaaggccaccgtcgagacgccgcaggcccaagccgccgtctccgccgccgcggcagcgcagcaggtgccctcgccgccgcagttcctgccgcagggctgggccgtcgacgacctcctgcagttctccgactacgagtccagcgacaagctgcacaaggagtccccgctcgggttcaaggagctggagtggttcgccgacatcgacctcttccacgagcagcaggcgcccaaggccggcaggacgttggcggaggttccggagctcttcggatcccaggcggccaacgacgcggcgtactacaggccggccaaagccgctgcaggcgccggggtgcgccagagcaagaaggcccggatcgaggtcaccgacgacgaggactacctcatcgtccctgatctcggttaa

SEQ ID NO: 10598 - protein, 263 aa, Sorghum bicolor
  misc_feature: Ceres ANNOT ID no. 6114156
  misc_feature (1)..(47): Pfam Id: zf-B_box Pfam Desc: B-box zinc finger
  misc_feature (52)..(99): Pfam Id: zf-B_box Pfam Desc: B-box zinc finger
  misc_feature (1)..(263): NCBI GI: 47497925 NCBI Desc: zinc finger protein [oryza sativa (japonica cultivar-group)]
  misc_feature (1)..(263): NCBI GI: 90265170 NCBI Desc: h0522a01.9 [oryza sativa (indica cultivar-group)]
  misc_feature (1)..(263): NCBI GI: 38346228 NCBI Desc: oj990528_30.8 [oryza sativa (japonica cultivar-group)]
  misc_feature (1)..(179): NCBI GI: 30679541 NCBI Desc: zinc finger (b-box type) family protein / salt-tolerance protein (sto) [arabidopsis thaliana]
  misc_feature (1)..(178): NCBI GI: 76160970 NCBI Desc: fructokinase 2-like protein [solanum tuberosum]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 1961 in the 11/479,226US patent application
  misc_feature: The sequence is a functional homolog of SEQ ID NO 465 in the 11/479,226US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 1961 in the 20070022495 US patent application
  misc_feature: The sequence is a functional homolog of SEQ ID NO 465 in the 20070022495 US patent application
  misc_feature: The sequence is a functional homolog of SEQ ID NO 236 in the 10/666,642 US patent application
  misc_feature: The sequence is a functional homolog of SEQ ID NO 908 in the 10/412,699 US patent application
  misc_feature: The sequence is a functional homolog of SEQ ID NO. 370 in the 11/188,298 US application
MKIQCDACEGAAATVVCCADEAALCARCDVEIHAANKLASKHQRLPLEALSARLPRCDVCQEKAAFIFCVEDRALFCRDCDEPIHVPGTLSGNHQRYLATGIRVGFASASACSSDGACDAHDSDHHAPPKATVETPQAQAAVSAAAAAQQVPSPPQFLPQGWAVDDLLQFSDYESSDKLHKESPLGFKELEWFADIDLFHEQQAPKAGRTLAEVPELFGSQAANDAAYYRPAKAAAGAGVRQSKKARIEVTDDEDYLIVPDLG

SEQ ID NO: 10599 - DNA, 738 bp, Sorghum bicolor
  misc_feature: Ceres ANNOT ID no. 6114159
  misc_feature: Encodes the peptide sequence at SEQ ID NO 10600
atggggacggaggccgacgccgctgccgtggacctgctccggtcgcagatcccgttccagaccgacggggagttcgtcctcccgccgcgcggcgtggggctcgtcctcgtcgacctctgcaatggcttctgcaccgtcggcgccgggaacctcgctcctgttgcgccaaacaagcagatcagtaagatggtggaagagaccaataggctctctaagctgttctgtgatagaaacctgccgatctttgcattcctggatacccattatccagataagccggaaccgccatatccccctcattgtatcattggtactggggaggagaactttgtcccagatctggagtggttggaaaaggagccaaatgtgactataaagaggaaaagttgtattgatgggtacatcagctgcatagagaaggacgggtctagtgtttttgttgactgggttggaaaatatcagatcaaaactgtcttggtgctcgggatatgcacggacatctgtgttttggattttgcaagttcaactctggctgctcgaaatattgaccgagtaccaccattacaggatgtcgtgatttattcagaggggtgtgctacatatgaccttcctgttgagattgctatgaatatcaaaggagctcttgcccatccacaggatctgatgcatcatattggactctatatggccaaaggaaggggtgcaaaggtagttgacagggtggttattgaaccttga

SEQ ID NO: 10600 - protein, 245 aa, Sorghum bicolor
  misc_feature: Ceres ANNOT ID no. 6114159
  misc_feature (10)..(244): NCBI GI: 140071745 NCBI Desc: isochorismatase hydrolase [medicago truncatula]
  misc_feature (13)..(241): NCBI GI: 113476076 NCBI Desc: isochorismatase hydrolase [trichodesmium erythraeum ims101]
  misc_feature (11)..(158): NCBI GI: 42570875 NCBI Desc: isochorismatase hydrolase family protein [arabidopsis thaliana]
  misc_feature (29)..(239): NCBI GI: 76257869 NCBI Desc: isochorismatase hydrolase [chloroflexus aurantiacus j-10-fl]
  misc_feature (29)..(241): NCBI GI: 118046052 NCBI Desc: isochorismatase hydrolase [chloroflexus aggregans dsm 9485]
MGTEADAAAVDLLRSQIPFQTDGEFVLPPRGVGLVLVDLCNGFCTVGAGNLAPVAPNKQISKMVEETNRLSKLFCDRNLPIFAFLDTHYPDKPEPPYPPHCIIGTGEENFVPDLEWLEKEPNVTIKRKSCIDGYISCIEKDGSSVFVDWVGKYQIKTVLVLGICTDICVLDFASSTLAARNIDRVPPLQDVVIYSEGCATYDLPVEIAMNIKGALAHPQDLMHHIGLYMAKGRGAKVVDRVVIEP

SEQ ID NO: 10601 - DNA, 1209 bp, Sorghum bicolor
  misc_feature: Ceres ANNOT ID no. 6114161
  misc_feature: Encodes the peptide sequence at SEQ ID NO 10602
atggcgaccatggctcgcatcctgctcgccgcgttcgtggcgctgcttgtcgtcgttagcccgtgccacgaaagaccagcgccggcgccgcaacaggcagcgaaagagaaggtggtggcggtggacggcatcactgccatctacaacttcggcgactccctgtcggacaccgggaacctgctccgcgaaggcgccacgggcatgctgcagcacaccacgggtcttccctacgggtccgccatcggcggcgccaccggccgatgctccgacgggtacctcatgatagattacctcgcgaaggatctcggcttgcctctgctgaacccgtacctcgacgatggcgccgacttctcgcacggcgtcaacttcgccgtggccggtgccacggcgctcgacgcggcggcgctcgccaggagaggggtcgccgtccctcacaccaacagctctctaggcgtccagctgcagcggttcaaggacttcatgagcgccaacacacagtccccggaggagatccgcgagaagctggctcattccttggtcatggttggggagatcggcggcaacgactacaactacgccttctcggcgaacaagccggtggccggcggcgcgcgcaacatctacaacttcgggcgcatggcgaccggcgtggccgaggcgatggcgctcgtcccggacgtagtgcgttccgtcacgagcgcggccagagagctcctcgacatgggcgcgacgcgggtggtgatcccgggcaacttcccgctcgggtgcgtgccgagctacatggcggcggtgaacgagacggacccggcagcgtacgacgccaacggctgcctggcggcgctgaacctgttcgcccagatgcacaacgtgctgctgcagcagggcatccgagagctgcgccggtcctacccgtcggcgaccatctcgtacgccgactacttctacgcgtacgtgcggatgctgagggacgccggcaagacggggttcgacgagggggcgcggaccacggcgtgctgcggcgctggcggcggcgcctacaacttcgacatggaccggatgtgcggcgcgccaggcgcgtcggtgtgcgcgaggcccgacgagcgcattagctgggacggcgtgcacctgacgcagcgcgccaacagcgtcatgagcgacttgctctaccacaagggattcgcgtccccagcgccggtggaattcccgtga

SEQ ID NO: 10602 - protein, 402 aa, Sorghum bicolor
  misc_feature: Ceres ANNOT ID no. 6114161
  misc_feature (47)..(388): Pfam Id: Lipase_GDSL Pfam Desc: GDSL-like Lipase/Acylhydrolase
  misc_feature (202)..(399): NCBI GI: 77551166 NCBI Desc: gdsl-like lipase/acylhydrolase [oryza sativa (japonica cultivar-group)]
  misc_feature (46)..(194): NCBI GI: 59595625 NCBI Desc: acetylajmalan acetylesterase [rauvolfia serpentina]
  misc_feature (46)..(348): NCBI GI: 10764858 NCBI Desc: f1k23.17 [arabidopsis thaliana]
  misc_feature (202)..(388): NCBI GI: 7406408 NCBI Desc: lipase-like protein [arabidopsis thaliana]
  misc_feature (202)..(396): NCBI GI: 9758938 NCBI Desc: gdsl-motif lipase/hydrolase-like protein [arabidopsis thaliana]
MATMARILLAAFVALLVVVSPCHERPAPAPQQAAKEKVVAVDGITAIYNFGDSLSDTGNLLREGATGMLQHTTGLPYGSAIGGATGRCSDGYLMIDYLAKDLGLPLLNPYLDDGADFSHGVNFAVAGATALDAAALARRGVAVPHTNSSLGVQLQRFKDFMSANTQSPEEIREKLAHSLVMVGEIGGNDYNYAFSANKPVAGGARNIYNFGRMATGVAEAMALVPDVVRSVTSAARELLDMGATRVVIPGNFPLGCVPSYMAAVNETDPAAYDANGCLAALNLFAQMHNVLLQQGIRELRRSYPSATISYADYFYAYVRMLRDAGKTGFDEGARTTACCGAGGGAYNFDMDRMCGAPGASVCARPDERISWDGVHLTQRANSVMSDLLYHKGFASPAPVEFP

SEQ ID NO: 10603 - DNA, 2241 bp, Sorghum bicolor
  misc_feature: Ceres ANNOT ID no. 6114167
  misc_feature: Encodes the peptide sequence at SEQ ID NO 10604
atggccaccggcgtggctccagcatctctcccacatgtcagagtgcgcgatggtggcgtcgggttcaccaggagcgttgacttcgcgaaggtcttgtctactcccagcgctggcactatgaggacaagctcctccagaggcagggcactcgtggcgaagagctcaagtactggttcggagaccgtggagctcgagccatcttcagaaggaagcccacttttagtacccaggcaaaagtactgtgaatcaatacaccagacaaggaggaggaaaactcgaactgtgatggtggggaatgtgccacttggcagtgatcatcccataaggattcaaaccatgacgacttcagataccaaggatgttgcaaaaacagtagaggaggtgatgaggatagcagataaaggagctgatattgttagaataaccgttcagggtaggaaggaagctgatgcctgctttgagatcaaggacactctggttcagaagaattacaacattccactagtggccgatattcattttgctcctacagtagctctaagggtggcagaatgctttgacaaaattcgtgtgaacccaggaaattttgctgatcgtcgtgctcaattcgaaaagctggaatatactgacgatgactaccaaaaagagcttgagcatattgagaaggtgttttctccattagttgagaaatgcaagcagtatggaagagcaatgcgtataggaacaaatcatggtagtctttctgaccgcataatgagctactatggtgattctccgcggggaatggttgagtctgctttggaatttgctaggatatgtcggaagttggactaccacaactttgtattttctatgaaagctagtaaccctgttgtcatggtccaagcatatcgcctgcttgtggcagaaatgtataacctaggatgggattatcccttgcacttgggtgttacagaagctggagagggtgaagatggaaggatgaagtctgctattggcattgggacactgctaatggatggtttgggtgatacaatccgtgtctccctcacagaaccaccagaagaagagattgatccttgccaaaggttggcaaatcttggggcacaggctgcaaaccttcaaattggggtggccccatttgaagaaaagcataggcgttattttgattttcagcgtaggagtggtcaattgcctttgcagaaggagggtgaggaagttgactacagaaatgtcctgcatcgtgatggttctgtactgatgtcagtttccctggatcaattaaaggctcctgagctcctttataggtctcttgcagcaaagcttgtggttggcatgcctttcaaggatctggctactgtagattccattcttttgagggagctcccccctgtagaagatgctgaagctaggcttgcactcaaaagattagttgacatcggcatgggcgtgctgacccccttgtcggagcagttgacaaagccactgccacatgcaattgtacttgtcaacctcgacgaattgtcaagtggtgcacacaaacttttgccagaaggcactagactagctgtcactcttcgtggtgatgaatcatatgagcagctagatattcttaaggatgttgatgatataacaatgttgttacataatgttccatatggtgaggagaagacaggcagggtgcatgctgctaggaggttatttgaatacttgcaggccagtggtttgaacttccctgtaattcatcacatagatttccctaaagccattgacagagatggtcttgtcattggtgctggggccaacgttggtgctctcctagtcgatggtcttggtgatggtgtacttcttgaagctgctgaccaggaatttgagttcctgagggacacatctttcaacttgctccagggttgcaggatgcgcaacacaaaaactgaatatgtgtcttgtccttcatgtggccgaacactctttgaccttcaggaaatcagcgctgagattagagaaaagacctctcatctgccaggtgtctcgatcgctatcatgggttgcattgtcaatgggccaggagagatggccgatgccgatttcgggtacgttggaggcgctcctggaaagatcgatctttacgttggcaagaccgttgtgcagcgcggcattgccatggaaggtgccactgacgccttgatccagctgatcaaggacaatggccgatgggttgatcctcctgccgaggagtag

SEQ ID NO: 10604 - protein, 746 aa, Sorghum bicolor
  misc_feature: Ceres ANNOT ID no. 6114167
  misc_feature (89)..(443): Pfam Id: GcpE Pfam Desc: GcpE protein
  misc_feature (1)..(746): NCBI GI: 50082771 NCBI Desc: hydroxymethylbutenyl 4-diphosphate synthase [zea mays]
  misc_feature (1)..(746): NCBI GI: 27903511 NCBI Desc: gcpe protein [catharanthus roseus]
  misc_feature (1)..(746): NCBI GI: 112258871 NCBI Desc: (e)-4-hydroxy-3-methylbut-2-enyl diphosphate synthase [stevia rebaudiana]
  misc_feature (1)..(746): NCBI GI: 27462474 NCBI Desc: gcpe [lycopersicon esculentum]
  misc_feature (1)..(746): NCBI GI: 20453201 NCBI Desc: at5g60600/mup24_10 [arabidopsis thaliana]
  misc_feature (77)..(581): SWISSPROT Homolog: EC 1.17.4.3 4-hydroxy-3-methylbut-2-en-1-yl diphosphate synthase
MATGVAPASLPHVRVRDGGVGFTRSVDFAKVLSTPSAGTMRTSSSRGRALVAKSSSTGSETVELEPSSEGSPLLVPRQKYCESIHQTRRRKTRTVMVGNVPLGSDHPIRIQTMTTSDTKDVAKTVEEVMRIADKGADIVRITVQGRKEADACFEIKDTLVQKNYNIPLVADIHFAPTVALRVAECFDKIRVNPGNFADRRAQFEKLEYTDDDYQKELEHIEKVFSPLVEKCKQYGRAMRIGTNHGSLSDRIMSYYGDSPRGMVESALEFARICRKLDYHNFVFSMKASNPVVMVQAYRLLVAEMYNLGWDYPLHLGVTEAGEGEDGRMKSAIGIGTLLMDGLGDTIRVSLTEPPEEEIDPCQRLANLGAQAANLQIGVAPFEEKHRRYFDFQRRSGQLPLQKEGEEVDYRNVLHRDGSVLMSVSLDQLKAPELLYRSLAAKLVVGMPFKDLATVDSILLRELPPVEDAEARLALKRLVDIGMGVLTPLSEQLTKPLPHAIVLVNLDELSSGAHKLLPEGTRLAVTLRGDESYEQLDILKDVDDITMLLHNVPYGEEKTGRVHAARRLFEYLQASGLNFPVIHHIDFPKAIDRDGLVIGAGANVGALLVDGLGDGVLLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRGIAMEGATDALIQLIKDNGRWVDPPAEE

SEQ ID NO: 10605 - DNA, 408 bp, Sorghum bicolor
  misc_feature: Ceres ANNOT ID no. 6114175
  misc_feature: Encodes the peptide sequence at SEQ ID NO 10606
atggcctacgagattagcgaaatcaaaaagattggcataggtctcgtggggtttggcatcctattctcattccttggtgttatccttttcttcgataggggcttgttggctctgggtaatattttctttttgactggagtgggtctgttactcggttggcaatctatgtggcagcttttcacaaagaaggcaaaccttaagggatcagtacctttcttctttggtttgtttcttctgtttgtccgttggcctgttgctggtatcatcatggaactatatggatcttttgtgctcttcagtggttatgggcctcctatccaggccttcctgtatcaaataccaatcattggttggattctgcagtacccattccagctgtttggtcagttgaggcgtaagcgtacgtga

SEQ ID NO: 10606 - protein, 135 aa, Sorghum bicolor
  misc_feature: Ceres ANNOT ID no. 6114175
  misc_feature (29)..(127): Pfam Id: Got1 Pfam Desc: Got1-like family
  misc_feature (1)..(134): NCBI GI: 47497305 NCBI Desc: nfkb activating protein-like [oryza sativa (japonica cultivar-group)]
  misc_feature (1)..(122): NCBI GI: 124360690 NCBI Desc: got1-like protein [medicago truncatula]
  misc_feature (4)..(134): NCBI GI: 38603916 NCBI Desc: at3g03180 [arabidopsis thaliana]
  misc_feature (10)..(123): NCBI GI: 33146513 NCBI Desc: nfkb activating protein-like [oryza sativa (japonica cultivar-group)]
  misc_feature (10)..(124): NCBI GI: 56207276 NCBI Desc: novel protein similar to human and mouse cgi-141 protein (cgi-141) [danio rerio]
MAYEISEIKKIGIGLVGFGILFSFLGVILFFDRGLLALGNIFFLTGVGLLLGWQSMWQLFTKKANLKGSVPFFFGLFLLFVRWPVAGIIMELYGSFVLFSGYGPPIQAFLYQIPIIGWILQYPFQLFGQLRRKRT

SEQ ID NO: 10607 - DNA, 525 bp, Sorghum bicolor
  misc_feature: Ceres ANNOT ID no. 6114176
  misc_feature: Encodes the peptide sequence at SEQ ID NO 10608
atgtcaagggacccacttgtagtaggcaacgtagttggagatatcttggatccatttatcaaatcagcatcactcagagtcctatacaacaatagggaactgactaatggatctgagctcaagccatcgcaagtagccaatgaaccaaggattgagattgctggacatgacatgaggaccctttacactttggtgatggtggatcccgactcaccaagtccaagcaatccaacgaaaagagagtaccttcactggttggtgacagatattccagaatcaacaaatgtgagctatggaaatgaggtagtaagctatgaaagtccaaagccaagtgctggaatacatcgcttcgtctttgtgctcttccgccaatctgtccggcaaactatttatgcgccaggatggaggcaaaatttcaacacaagagacttctcagcattctacaatctaggaccacctgtggcctcagtgttcttcaactgccaaagggagaatgggtgtggtggcagacgatatattagatga

SEQ ID NO: 10608 - protein, 174 aa, Sorghum bicolor
  misc_feature: Ceres ANNOT ID no. 6114176
  misc_feature (17)..(162): Pfam Id: PBP Pfam Desc: Phosphatidylethanolamine-binding protein
  misc_feature (1)..(174): NCBI GI: 38344240 NCBI Desc: oj991113_30.17 [oryza sativa (japonica cultivar-group)]
  misc_feature (3)..(171): NCBI GI: 38304185 NCBI Desc: flowering locus t [populus nigra]
  misc_feature (3)..(171): NCBI GI: 115503902 NCBI Desc: ft-like protein [vitis vinifera]
  misc_feature (3)..(171): NCBI GI: 88770800 NCBI Desc: flowering locus t-like protein ft1 [populus tremula]
  misc_feature (3)..(171): NCBI GI: 48474219 NCBI Desc: flowering locus t [populus nigra]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7196246
  misc_feature: The sequence is a functional homolog of SEQ ID NO 2 in US patent 7208653
MSRDPLVVGNVVGDILDPFIKSASLRVLYNNRELTNGSELKPSQVANEPRIEIAGHDMRTLYTLVMVDPDSPSPSNPTKREYLHWLVTDIPESTNVSYGNEVVSYESPKPSAGIHRFVFVLFRQSVRQTIYAPGWRQNFNTRDFSAFYNLGPPVASVFFNCQRENGCGGRRYIR

SEQ ID NO: 10609 - DNA, 1002 bp, Sorghum bicolor
  misc_feature: Ceres ANNOT ID no. 6114183
  misc_feature: Encodes the peptide sequence at SEQ ID NO 10610
atgaggagatcgtctcaggggatgatgagcctaagctacgatgcgggcagcgggagggggctgctggcctgctacgtcaagccggcgaagccgaggccgtccaagtgggacgacgcgcagcggtggctagtgtcctcatcccgtgcgaacgacgacgaccggcgccggagctcttgcgcggacgaccgcctcctgctgccgtcggcgtcgcagaaggggcggcactcgtggagcgccacggacggcgccgccctgcccgcggcgctaaggctcgccgcgcgggacgacgacggggatgcagaggcggaggccgaggccgaggccgagtccgagaccaagagggtggactccgttctggcgtacgggcagccgccgcggtgcctctcgctgcgggacatcggcacggagatgacgccggtcgggagcaaggagccgtccagggccaacaccccacgcgctaccctaccggcaccggcgccgtccacgccggggcgcgcgatccgcgcaccgcggcgccgacccgattcttcgaagcacggcggatcgccaccgggcctagcggcagcagaccgcggcgcaggcttcgagtgcgccgacgcacaggagcgcaaggaatcgacgcccggtgcgcggacgacgccggtcgtgtcgcccgcggcggcgtgggacgccgccgagcgcgccaagcacatggctaggtaccggcgcgaggagatgaaaatacaggtctgggaaaaccggcgacggcaaaaggcggagctgcagatgaagacgacggaggccaaggcggagaggatgaagcggcgggcgcaggagaagacggcgagcaagctggcctcggcgcaggcggcggccagggagaagcgcgcgcaggccgaggccaagctgagccggcgcgccgcgcgggtcggcgacagggcggacgtgctgaggcggaccgggcacctgccgtcgtcgtcgtcctccgtgttctcgctcaagctgccgctgatgtgcagctga

SEQ ID NO: 10610 - protein, 333 aa, Sorghum bicolor
  misc_feature: Ceres ANNOT ID no. 6114183
  misc_feature (212)..(321): Pfam Id: Remorin_C Pfam Desc: Remorin, C-terminal region
  misc_feature (1)..(332): NCBI GI: 47848302 NCBI Desc: remorin-like protein [oryza sativa (japonica cultivar-group)]
  misc_feature (30)..(262): NCBI GI: 79320867 NCBI Desc: dna binding [arabidopsis thaliana]
  misc_feature (219)..(319): NCBI GI: 115460610 NCBI Desc: os04g0620200 [oryza sativa (japonica cultivar-group)]
  misc_feature (219)..(319): NCBI GI: 38344336 NCBI Desc: osjnba0058k23.18 [oryza sativa (japonica cultivar-group)]
  misc_feature (219)..(319): NCBI GI: 116309948 NCBI Desc: h0714h04.6 [oryza sativa (indica cultivar-group)]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
MRRSSQGMMSLSYDAGSGRGLLACYVKPAKPRPSKWDDAQRWLVSSSRANDDDRRRSSCADDRLLLPSASQKGRHSWSATDGAALPAALRLAARDDDGDAEAEAEAEAESETKRVDSVLAYGQPPRCLSLRDIGTEMTPVGSKEPSRANTPRATLPAPAPSTPGRAIRAPRRRPDSSKHGGSPPGLAAADRGAGFECADAQERKESTPGARTTPVVSPAAAWDAAERAKHMARYRREEMKIQVWENRRRQKAELQMKTTEAKAERMKRRAQEKTASKLASAQAAAREKRAQAEAKLSRRAARVGDRADVLRRTGHLPSSSSSVFSLKLPLMCS

SEQ ID NO: 10611 - DNA, 2136 bp, Sorghum bicolor
  misc_feature: Ceres ANNOT ID no. 6114184
  misc_feature: Encodes the peptide sequence at SEQ ID NO 10612
atgacaccgacggtcttaatggagtttgggcagcacaggccaataaaacgggggtatgaggaaatggctttcaggggcgtggcggcagccacatcccgtggttacacagagactgttggcgagtcggaagtcgcagctggtagtcctgttcgtgtcgattcggaggactcttgggcaccaaagcgcaagtgcatcagcctgaacagcgatggctttgatgtgaagcgggagatctttgtgccgtctaagatgtcgtcatctgaacggcggtatcttcggaagagattccgggcagagcttgattctgtgcgggatctcctcaagaaaccagagtttgcagcccccgttcctctcagtcgggcacctgccttgtcatcctcagctgcccctcgagccaagaagccacagaagtctcagcgtggtgtgaccaatgttatccgtggtgcaaagggacgtttcttgcctacaaaacctcgacctgaacctactacggtgttatctgaagctgcagtgtttaagcagtgtgaagctattttgaagaagcttatgactcagaaatatagtcatatattcaatgttccagttgatgtagacaagctgcaaattcctgattattttgatattgtcaagaccccaatggatcttggaactgtccagaagaagcttgaatctggctcatacacaagtccatcagattttgctgctgatgtcaggctgacctttaacaatgctatggcttataatcccaaggggcatgctgtgcatgacatggccatccagctgaacaagatgtttgagagtcgatggaggccaattgagaagaagctggcttctgctgccactgagaaacatgttgaggttgacagggctgactcgaagaggaggaagacacctcctgtggaccgcagtgatgtgtcaacggaaggtgtacggcagacagagcctgaaaaaccaaagatgacagctgaagagagagaagcctttgggaactccttggcttctatatctgatgagttacctccccacatctttgaactgctgcaacaatgcatcgacagcaatacagatatgcctggtgatggagagatagagattgacatccaagctgtcagtgatgacatgctatttgagctgaagaaacatgtcgacaagtatttgcaagagagagagcagagccagcaggtgaaatctgagccttctgagaatgaagctgtgaatgtatctggccttagccactcatctacaaatccttgcaaaggtggtgagcctatcgaggaggatgtggatatctgtggcaatgcctcccctatcatgttagacaaagatgcacaaatcaggagtagcaagtgcggtagtccaagtagttccagcagcgactctgaatcatcttctagcgattccgactctggcagtgactctgaaagtgaatcagaaaaagttggcagccctggaaagcttgcgaaggggactaagaaacctgaccagctggtggagcaagaaaagagtgatgttattagcccagccgatgccaaccgtcctgctgatattgtgggactccatggggaggacagtgagtcaaaacctgcaccagggggggaaaactcaaaacccgattcacaagtctcaccggacaggctattgcgtgccgcccttttgaggagccgttatgctgatgtgattgtcaaagctcgcggcattcttagtcagggtggagacaaacaggaggaactggaaaagctccagaaggaagagaaagcacgtttgttggctgagggtaatgcagccatggaggctcgtagagccgaagctgaagcggaagctaagcgtaaacgggattttgagagggagaaggctcgtcaggccctacaagagatggagagaactgtagaaattaatgataacctccatatcaaggatttggaaatgcttgggacagccacaacagaacatattgtaagctctgttgatgagactagtccagagcgctctcaagatggcatggccggctatcatccaggatctgtcaatcctttggagcaacttggactgttcataaaggccgatgatgaggaagatgatgaagaaccgagcagtgttcccagcattaaagaaccagaggaaggagagatcaactga

SEQ ID NO: 10612 - protein, 711 aa, Sorghum bicolor
  misc_feature: Ceres ANNOT ID no. 6114184
  misc_feature (171)..(260): Pfam Id: Bromodomain Pfam Desc: Bromodomain
  misc_feature (1)..(697): NCBI GI: 29569106 NCBI Desc: global transcription factor group e [zea mays]
  misc_feature (1)..(711): NCBI GI: 13699186 NCBI Desc: kinase-like protein [oryza sativa]
  misc_feature (10)..(707): NCBI GI: 15232127 NCBI Desc: dna-binding bromodomain-containing protein [arabidopsis thaliana]
  misc_feature (40)..(631): NCBI GI: 7573452 NCBI Desc: kinase-like protein [arabidopsis thaliana]
  misc_feature (172)..(273): NCBI GI: 92874651 NCBI Desc: bromodomain [medicago truncatula]
MTPTVLMEFGQHRPIKRGYEEMAFRGVAAATSRGYTETVGESEVAAGSPVRVDSEDSWAPKRKCISLNSDGFDVKREIFVPSKMSSSERRYLRKRFRAELDSVRDLLKKPEFAAPVPLSRAPALSSSAAPRAKKPQKSQRGVTNVIRGAKGRFLPTKPRPEPTTVLSEAAVFKQCEAILKKLMTQKYSHIFNVPVDVDKLQIPDYFDIVKTPMDLGTVQKKLESGSYTSPSDFAADVRLTFNNAMAYNPKGHAVHDMAIQLNKMFESRWRPIEKKLASAATEKHVEVDRADSKRRKTPPVDRSDVSTEGVRQTEPEKPKMTAEEREAFGNSLASISDELPPHIFELLQQCIDSNTDMPGDGEIEIDIQAVSDDMLFELKKHVDKYLQEREQSQQVKSEPSENEAVNVSGLSHSSTNPCKGGEPIEEDVDICGNASPIMLDKDAQIRSSKCGSPSSSSSDSESSSSDSDSGSDSESESEKVGSPGKLAKGTKKPDQLVEQEKSDVISPADANRPADIVGLHGEDSESKPAPGGENSKPDSQVSPDRLLRAALLRSRYADVIVKARGILSQGGDKQEELEKLQKEEKARLLAEGNAAMEARRAEAEAEAKRKRDFEREKARQALQEMERTVEINDNLHIKDLEMLGTATTEHIVSSVDETSPERSQDGMAGYHPGSVNPLEQLGLFIKADDEEDDEEPSSVPSIKEPEEGEIN

SEQ ID NO: 10613 - DNA, 1047 bp, Sorghum bicolor
  misc_feature: Ceres ANNOT ID no. 6114188
  misc_feature: Encodes the peptide sequence at SEQ ID NO 10614
atggagaacggcggcggcaaaggcgacgtccccgacgatgcgaacgagcattgccctggaacgcagtcggaggaggcggggaaggcggatgcctgcgctgggtgccccaaccagcagatttgtgccaccgcccccaagggccccgaccccgatgtggttgctattgtcgagaggttggctactgtgaagcacaaattgttagttttgtctggaaagggaggtgttggaaagagtacattctcagcccaactctcgtttgctctagctgaaatggaccatcaggttggccttcttgacatagatatatgtggccctagcatccctaaaatgttaggccttgagggacaagatattcatcaaagcaaccttggctggtcacctgtgtatgttgagtccaaccttggtgtgatgtcgattggtttcatgctgcctaatccagatgatgctgtcatatggaggggtccccgcaagaatggactgatcaagcagttcttaaaggacgttgattggggggagattgactatcttgttgtggacgctcctccaggaacatctgatgagcacatctcgatagtgcaataccttcaagccacaggaatcgatggtgcaataatcgtcacgactccgcagcaggtctcactgattgacgtgaggaaggagataaccttctgcaagaaggtcggtgttcctgtcctaggtgttgtggagaacatgagtggcctgaggcagccactttcagatcttagattcatcaagtcagatgaggcgggtgagacagatgcgacagagtgggccctgaactacatcaaggagaaagcccctgagcttctgtcggtcatggcatgcagcgaggtatttgatagcagcaagggaggagctgagaagatgtgccatgaaatgggggttcctttccttggtaaggtgcccatggatccacagctatgcaaggcggctgaggaagggaggtcatgctttgctgatcagaaatgcagtgccagtgcaccggctcttcagaacattgtgaagaagctgatcaagactgagtga

SEQ ID NO: 10614 - protein, 348 aa, Sorghum bicolor
  misc_feature: Ceres ANNOT ID no. 6114188
  misc_feature (66)..(281): Pfam Id: CbiA Pfam Desc: CobQ/CobB/MinD/ParA nucleotide binding domain
  misc_feature (1)..(348): NCBI GI: 38346055 NCBI Desc: oj000223_09.9 [oryza sativa (japonica cultivar-group)]
  misc_feature (1)..(348): NCBI GI: 90265123 NCBI Desc: h0811e11.6 [oryza sativa (indica cultivar-group)]
  misc_feature (1)..(345): NCBI GI: 23297101 NCBI Desc: nucleotide-binding protein [arabidopsis thaliana]
  misc_feature (1)..(345): NCBI GI: 27371964 NCBI Desc: nucleotide binding protein [cypripedium parviflorum var. pubescens]
  misc_feature (1)..(248): NCBI GI: 9758243 NCBI Desc: nucleotide-binding protein [arabidopsis thaliana]
MENGGGKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEITFCKKVGVPVLGVVENMSGLRQPLSDLRFIKSDEAGETDATEWALNYIKEKAPELLSVMACSEVFDSSKGGAEKMCHEMGVPFLGKVPMDPQLCKAAEEGRSCFADQKCSASAPALQNIVKKLIKTE

SEQ ID NO: 10615 - DNA, 1170 bp, Sorghum bicolor
  misc_feature: Ceres ANNOT ID no. 6114189
  misc_feature: Encodes the peptide sequence at SEQ ID NO 10616
  misc_feature: Down-regulated in root tissues in response to salicylic acid treatment
atggacggcggcgccggcgaggaggggaagcaggagcggcacctggtgctggcccacaagctcttccttctgtcccaccccgccgtcgacgacctctccaaggtcgccctccgcgccgaagtcctcgacaccgtgaaatccgatgatatggcgacgctgtttgagtcgctggtcaccgcgggtgttctggaggcggacgccgcgctgctggccgagatgcgtgggaggatcgacgaggagatccgcaagctcgatgagaaaatcgctgatgccgaggagaacttgggcgagagtgaagtccgtgaagcacatcttgccaaatccttgtacttcataagggtcggtgagaaggaaaaggccctggaacagcttaaagttactgaaggaaaaactgtagccgttggccaaaagatggatctggtgtttcacactttgcagattgggtttttctacatggattttgatctgatctcaaaatccattgagaaggcaaagaacttgtttgaggaaggaggtgattgggagaggaagaacaggttgaaagtatatgaaggcttgtactgcatggcaaccagaaacttcaagaaagctgccagcttatttttagactctatttcgactttcacaacttatgagttattcccatatgatacgttcatcttctatacagtcctcacaagtatcatcaccttggatcgtgtatctctgaaacaaaaggtggtagatgcaccagaaatcctggctgtgattggcaaagtacctcacctctctgagtttctcaactccctgtacaactgccagtacaagtcattttttgttgcattttctggtttgacggagcaaatcaagttagaccgttatcttcagcctcatttccgctactacatgagggaagtccgcactgttgtctactcacaattcttggagtcatacaagagtgtgacaatggaagcaatggccactgcattcggtgtatctgttgatttcattgaccaggaactgtcacggttcattgcagctgggaagcttcactgcaagattgataaggttgctggtgtcctggagacaaaccgacctgatgagaggaatgctttctatcaggcaaccatcaaacaaggggacttcttgctgaaccgcatacagaagctttcacgggtcattgacctgtaa

SEQ ID NO: 10616 - protein, 389 aa, Sorghum bicolor
  misc_feature: Ceres ANNOT ID no. 6114189
  misc_feature (254)..(358): Pfam Id: PCI Pfam Desc: PCI domain
  misc_feature (1)..(389): NCBI GI: 90265119 NCBI Desc: h0811e11.2 [oryza sativa (indica cultivar-group)]
  misc_feature (1)..(389): NCBI GI: 20978545 NCBI Desc: 26s proteasome non-atpase regulatory subunit 6 (26s proteasome regulatory particle non-atpase subunit 7) (osrpn7)
  misc_feature (7)..(389): NCBI GI: 117607065 NCBI Desc: 26s proteasome subunit rpn7 [capsicum annuum]
  misc_feature (158)..(389): NCBI GI: 2982297 NCBI Desc: kiaa0107-like protein [picea mariana]
  misc_feature (7)..(389): NCBI GI: 38454206 NCBI Desc: proteasome, 26s, non-atpase regulatory subunit 6 [rattus norvegicus]
  misc_feature: Down-regulated in root tissues in response to salicylic acid treatment
MDGGAGEEGKQERHLVLAHKLFLLSHPAVDDLSKVALRAEVLDTVKSDDMATLFESLVTAGVLEADAALLAEMRGRIDEEIRKLDEKIADAEENLGESEVREAHLAKSLYFIRVGEKEKALEQLKVTEGKTVAVGQKMDLVFHTLQIGFFYMDFDLISKSIEKAKNLFEEGGDWERKNRLKVYEGLYCMATRNFKKAASLFLDSISTFTTYELFPYDTFIFYTVLTSIITLDRVSLKQKVVDAPEILAVIGKVPHLSEFLNSLYNCQYKSFFVAFSGLTEQIKLDRYLQPHFRYYMREVRTVVYSQFLESYKSVTMEAMATAFGVSVDFIDQELSRFIAAGKLHCKIDKVAGVLETNRPDERNAFYQATIKQGDFLLNRIQKLSRVIDL

SEQ ID NO: 10617 - DNA, 486 bp, Sorghum bicolor
  misc_feature: Ceres ANNOT ID no. 6114204
  misc_feature: Encodes the peptide sequence at SEQ ID NO 10618
atgatcaagctggggtactccaagaggctgttcaagagaagcacctcctcgtccaagcagcagcagcagcaggcggccgcttgtggcggcggcgacaatggcgtcggtggcggcgccggggagattgagtgggaggtgaggcccggagggatgctggtgcagaagaggaacgggaggggcggccaggagatggtcactgtcagggtgtccaccggcttctcctggcatgatgtgtccattgcagccacctccacttttggggagctgaaggtgatgttatccatgataacaggactggagcctcgggagcagaggttgctgttcaggggcaaagagagagatgacactgatcacctccacatggttggggtgagggacaaggacaaggtcctcctcctagaggacccggccctcaaggacatgaagctccgagctctctcggcccaagttacgcggagctcgtgccagccttttatccaagtgtaa

SEQ ID NO: 10618 - protein, 161 aa, Sorghum bicolor
  misc_feature: Ceres ANNOT ID no. 6114204
  misc_feature (68)..(137): Pfam Id: ubiquitin Pfam Desc: Ubiquitin family
  misc_feature (1)..(161): NCBI GI: 47847633 NCBI Desc: ubiquitin-like protein [oryza sativa (japonica cultivar-group)]
  misc_feature (1)..(161): NCBI GI: 116309941 NCBI Desc: h0525d09.13 [oryza sativa (indica cultivar-group)]
  misc_feature (41)..(161): NCBI GI: 56785103 NCBI Desc: ubiquitin-like [oryza sativa (japonica cultivar-group)]
  misc_feature (29)..(145): NCBI GI: 56785178 NCBI Desc: bag domain containing protein-like [oryza sativa (japonica cultivar-group)]
  misc_feature (29)..(161): NCBI GI: 56797970 NCBI Desc: bcl-2 binding anthanogene-1 [hordeum vulgare subsp. vulgare]
MIKLGYSKRLFKRSTSSSKQQQQQAAACGGGDNGVGGGAGEIEWEVRPGGMLVQKRNGRGGQEMVTVRVSTGFSWHDVSIAATSTFGELKVMLSMITGLEPREQRLLFRGKERDDTDHLHMVGVRDKDKVLLLEDPALKDMKLRALSAQVTRSSCQPFIQV

SEQ ID NO: 10619 - DNA, 1596 bp, Sorghum bicolor
  misc_feature: Ceres ANNOT ID no. 6114206
  misc_feature: Encodes the peptide sequence at SEQ ID NO 10620
atgcagtgccccatggacactgctgctagtggaacctcaccagtgctgcagttccatagcaatgctgatgagtcgacctcccattcatctccattgccaacattaatagaacgttcacagcgccattgctgtggggatggaatcccaggtgaatttccccttgctgtgagcccctccattgtcctccatgtgctctcagcttgtgatctagacccgaaagatctcgccaatctggaggctacatgcacatttttcagtaaacctgcaaattttgcaccaaactttgcattgtcacttccagagcttgcggcatttgatatgtgccagaaaaggaccatgtttaagctgatgaagcaagaagatcaggagtgtctgaaacagcggtgtggaggatcttggaagcatgttcttaagtatattttggttagggagaagaatggttctcgggtgattgccgggccaggccatagtatagttatcagctcaaatggagatgtatattcatttggggcaaactgctccggacagcttggccttggggattcagaagaccggttcaggccatgtattattaggtctctacaaggcatcagaatcacacaagctgcagttgggtctagatggacaatgcttgtgagtgacacaggaagcgtctatgcatttgggaaggataatttcaggggtgcagaagtagttgatgatgctcatattcagattacaactcctaagatcgtggagtcattgaagggtgtttttgtagttcaagcagccatagggggttacttctctgcagttctgtctagagagggtcgagtttacactttctcatggggcaaagaggagaggcttggccacagttcggatccttcagatgttgaacctcgtcttctctctggacttgaggatgttcctgttgcatatatctctgcaggaaattgctaccttcttatgttggcctaccagtctgtgtattctgtgggttgtggcttaggaggcaagcttgggcatggatgcaaaactaacaaggggatgcccaagttgattgaacagtttcagtccttgagctttaaaccagtttcaatagcagctggcacttggcatgccgcagcccttggtgctgacgggcgtgtgtgcacctggggttggggtcacactggttgtctggggcatggtgatgaggaatacaaggctgttcccacattggttgaaggattacgcgacgtgaaggccgttcatctctccactggtgaatacacaacatttgtcgtcgctgagaatggggatgtatactcctttggatccggtgaatccttagttttccaggaggacgatgaagcagaggagggtccggatttctcgacaccgagcatagtcagctcgctcaaggctctgaacaagaaggtcgtgcagatcagccccacaaacgcctcgtactggctgaactcggaaatgggtcacccgcacacatttgcggtgatggactccggtgacttgtgtgcctttggaggagggatcagaggccagctcggcgtgaagctccttgagggcgtagaaaaagtgagcgtgccgatgcatgttccgattgttctcaactga

SEQ ID NO: 10620 - protein, 531 aa, Sorghum bicolor
  misc_feature: Ceres ANNOT ID no. 6114206
  misc_feature (374)..(423): Pfam Id: RCC1 Pfam Desc: Regulator of chromosome condensation (RCC1)
  misc_feature (1)..(530): NCBI GI: 47847831 NCBI Desc: rjs-like protein [oryza sativa (japonica cultivar-group)]
  misc_feature (149)..(488): NCBI GI: 93003290 NCBI Desc: tpa: zinc finger protein [ciona intestinalis]
  misc_feature (149)..(472): NCBI GI: 119578073 NCBI Desc: hcg2006901, isoform cra_f [homo sapiens]
  misc_feature (150)..(481): NCBI GI: 23308399 NCBI Desc: at5g63860/mgi19_6 [arabidopsis thaliana]
  misc_feature (149)..(472): NCBI GI: 27882442 NCBI Desc: herc2 protein [mus musculus]
MQCPMDTAASGTSPVLQFHSNADESTSHSSPLPTLIERSQRHCCGDGIPGEFPLAVSPSIVLHVLSACDLDPKDLANLEATCTFFSKPANFAPNFALSLPELAAFDMCQKRTMFKLMKQEDQECLKQRCGGSWKHVLKYILVREKNGSRVIAGPGHSIVISSNGDVYSFGANCSGQLGLGDSEDRFRPCIIRSLQGIRITQAAVGSRWTMLVSDTGSVYAFGKDNFRGAEVVDDAHIQITTPKIVESLKGVFVVQAAIGGYFSAVLSREGRVYTFSWGKEERLGHSSDPSDVEPRLLSGLEDVPVAYISAGNCYLLMLAYQSVYSVGCGLGGKLGHGCKTNKGMPKLIEQFQSLSFKPVSIAAGTWHAAALGADGRVCTWGWGHTGCLGHGDEEYKAVPTLVEGLRDVKAVHLSTGEYTTFVVAENGDVYSFGSGESLVFQEDDEAEEGPDFSTPSIVSSLKALNKKVVQISPTNASYWLNSEMGHPHTFAVMDSGDLCAFGGGIRGQLGVKLLEGVEKVSVPMHVPIVLN

SEQ ID NO: 10621 - DNA, 1713 bp, Sorghum bicolor
  misc_feature: Ceres ANNOT ID no. 6114213
  misc_feature: Encodes the peptide sequence at SEQ ID NO 10622
atgtggctggtgtcgtccaccctccgcgccggtctgtgccttttgctcgccgtcgtcctcgccgggcacggcgagcccgcggcggccgtgacgctgtcgacgtcgtcgcggtggatcgtggacccggccgggcaccgggtgaagctggcctgcgtgaactggccgtcgcacctggaccccgtggtgaccgagggtctcggcaggcagcccgtgggcgccatcaccgggatgatcgtctccatggggttcaactgcgtccgcctcacgtacccgatcgcgctggccaccaacgcctcgctgtcggcgctcaccgtgcggcagtccctcctcgcccacggcctctccgagacggtcggcggcgtcgaggtcaacaaccccagcttcctcgacctcacgctcatcgactcgctcaaggctgtggtgaacgccctgggggagaagaacgtgatggtgatcctggacaaccatatcagcacgccggggtggtgctgcagcaacgacgacggcaatgggttcttcggcgacagggacttcgacccaaacgtgtgggtggacgggctgggcagcatggccaccaccttcgccgacgtgcccaacgtcgtcggcatgagcctgcggaacgagctccgtggccccaggcagaactccgaagattggtacacgtacatgcagaggggcgcggaggcggttcacgcggcgaaccctcgggcgctggtgatcatgggcggcctgagctacgactacgacctctcgttcctggccgcgcggcaggttggggtcagcttcgcggcggagaacaagctggtgttcgaggtgcactggtacagcttctcggacgcgcgcgcgtgggaggcggagggcgccaacgaggtgtgcggccgcgcggcgcgcgacttcgcgcgccgcggcgcgttcctgctcgccgggggattcccgctcttcctcagcgagttcggcgccgactcccgcggcggcgaccgcaaggacaaccgctacttcccgtgcgccgccgccgtcgccgcggagcacgacgtggactgggcctactgggcgctgcagggcagctacgcgctgcggcagggcgtcgtcgggatggacgaggtgtacggcgtcctcgactggtcatggagcaagccccgcaaccagaccgtgctcccgaggatccaggcgctgcagcggccgctccaggggcctggctacggcgaggcgctgccgtacaccgtgctgttccacccgctcacgggtctctgcgcggtgcggcgcgcgtcggcggcggcggcgacgacgctggagctaggcccgtgcaacgagacggacgcgtgggcgtacgcgccgccgtcgtcgacgcttgttctgagggacgccgcggccgcggcggggggactccccacgtgcctgcgggccgaggggcgtggccagcccgcgcggctcggcaccaacgcctgcggcgaccccctgtcgacatggcgcctggcgacggactccgcgatgcacgtcgccgtcgacgccgctgctcttgggctgggcggcggcgaggacggcggcggcggaagtgggatgctgtgcctggacgtgggcacagacggcaggagcatcgtgacgaacccgtgcgcgtgccagcgcggggacggggcgtgcgacccggaggggcagtggttcaaactggtcaccagcacgaggcgcgtcgcgcgcaggccggccatgctcgcctag

SEQ ID NO: 10622 - protein, 570 aa, Sorghum bicolor
  misc_feature: Ceres ANNOT ID no. 6114213
  misc_feature (56)..(357): Pfam Id: Cellulase Pfam Desc: Cellulase (glycosyl hydrolase family 5)
  misc_feature (127)..(570): NCBI GI: 38345246 NCBI Desc: osjnbb0011n17.7 [oryza sativa (japonica cultivar-group)]
  misc_feature (127)..(570): NCBI GI: 90265052 NCBI Desc: h0510a06.2 [oryza sativa (indica cultivar-group)]
  misc_feature (13)..(500): NCBI GI: 51536480 NCBI Desc: at1g13130 [arabidopsis thaliana]
  misc_feature (32)..(500): NCBI GI: 4850396 NCBI Desc: f3f19.15 [arabidopsis thaliana]
  misc_feature (12)..(507): NCBI GI: 90265051 NCBI Desc: h0510a06.1 [oryza sativa (indica cultivar-group)]
MWLVSSTLRAGLCLLLAVVLAGHGEPAAAVTLSTSSRWIVDPAGHRVKLACVNWPSHLDPVVTEGLGRQPVGAITGMIVSMGFNCVRLTYPIALATNASLSALTVRQSLLAHGLSETVGGVEVNNPSFLDLTLIDSLKAVVNALGEKNVMVILDNHISTPGWCCSNDDGNGFFGDRDFDPNVWVDGLGSMATTFADVPNVVGMSLRNELRGPRQNSEDWYTYMQRGAEAVHAANPRALVIMGGLSYDYDLSFLAARQVGVSFAAENKLVFEVHWYSFSDARAWEAEGANEVCGRAARDFARRGAFLLAGGFPLFLSEFGADSRGGDRKDNRYFPCAAAVAAEHDVDWAYWALQGSYALRQGVVGMDEVYGVLDWSWSKPRNQTVLPRIQALQRPLQGPGYGEALPYTVLFHPLTGLCAVRRASAAAATTLELGPCNETDAWAYAPPSSTLVLRDAAAAAGGLPTCLRAEGRGQPARLGTNACGDPLSTWRLATDSAMHVAVDAAALGLGGGEDGGGGSGMLCLDVGTDGRSIVTNPCACQRGDGACDPEGQWFKLVTSTRRVARRPAMLA

SEQ ID NO: 10623 - DNA, 870 bp, Sorghum bicolor
  misc_feature: Ceres ANNOT ID no. 6114216
  misc_feature: Encodes the peptide sequence at SEQ ID NO 10624
atggcagcgccacctctcggcctcgcctgcagggtcgccggggccttcaccacaccggcggtggcgcattccggtttccgcccccgacgtctcggccctggtctcctcccttcaaagagatggagcggggtggtgaggatgggggcggtggtcggaggagggcaggagggtgaggaggacgaggagctgaggcagaccaaggagcaggctgccgccaggaggcggtgggagaccctgattagggagcagaagattaaaacccttacaccaagggaagctggctatacgttcaaactgacggacaaggctcttctggatgttagaccctcaaacgagcgtcaaaaggcttgggtgaaaggctctacctggattcctatatttgatgtggatacttcagttgatctgggcggacttagcaaaaaagtcagcaactttgtaatgggtggctggtggagtggcagctcaacattgtcatttaataagaactttgtacagcaggttgaggagaagttttcaaaagatacagatataatactagtgtgccagaaaggacttagatcacttgccgcctgtgaacagctgtacaatgctggttttgaaaatttgttctgggtacaaggaggcctcgaagctgccgaagaggaggattttgagagggaaggttcccagcctttcaagctcgccgctattggaggggtttctgaattctttggatggacggaccagcaacgcaggcaggccgccaaggaaggactcggataccggcttgtcttcactggtcgcttggtcggagcactggtgctacttgacgctttgtttctaggcgctcaaaggatcggtcctctgcttcaagaaatgcaacctcattga

SEQ ID NO: 10624 - protein, 289 aa, Sorghum bicolor
  misc_feature: Ceres ANNOT ID no. 6114216
  misc_feature (1)..(287): NCBI GI: 46805304 NCBI Desc: rhodanese-like domain-containing protein -like [oryza sativa (japonica cultivar-group)]
  misc_feature (32)..(289): NCBI GI: 63003764 NCBI Desc: at4g24750 [arabidopsis thaliana]
  misc_feature (79)..(234): NCBI GI: 21592651 NCBI Desc: rhodanese-like family protein [arabidopsis thaliana]
  misc_feature (73)..(233): NCBI GI: 15010630 NCBI Desc: at2g42220/t24p15.13 [arabidopsis thaliana]
  misc_feature (73)..(233): NCBI GI: 2673913 NCBI Desc: rhodanese-like family protein [arabidopsis thaliana]
MAAPPLGLACRVAGAFTTPAVAHSGFRPRRLGPGLLPSKRWSGVVRMGAVVGGGQEGEEDEELRQTKEQAAARRRWETLIREQKIKTLTPREAGYTFKLTDKALLDVRPSNERQKAWVKGSTWIPIFDVDTSVDLGGLSKKVSNFVMGGWWSGSSTLSFNKNFVQQVEEKFSKDTDIILVCQKGLRSLAACEQLYNAGFENLFWVQGGLEAAEEEDFEREGSQPFKLAAIGGVSEFFGWTDQQRRQAAKEGLGYRLVFTGRLVGALVLLDALFLGAQRIGPLLQEMQPH

SEQ ID NO: 10625 - DNA, 1401 bp, Sorghum bicolor
  misc_feature: Ceres ANNOT ID no. 6114221
  misc_feature: Encodes the peptide sequence at SEQ ID NO 10626
atggcctccctcgcctcggcctcaacctcactcctcttcccgcaggccacctcatccaggagccgcgtccggctctccacctccctgggcttctccgcgcagccggcgcggctgcggagccgggcggcggcggcgggcgggcagcggcgcgggcgcctgctggtggtgcgcgcggcgaggggcaagttcgagcgcaccaagccgcacgtcaacatcggcaccatcggccacgtcgaccacggcaagaccaccctcaccgccgcgctcaccatggtgctcgcctccgtcggcggcagcgcgcccaagaagtacgacgagatcgacgccgcgcccgaggagcgcgcccgcggcatcaccatcaacaccgccaccgtcgagtacgagaccgagacccgccactacgcgcacgtcgactgcccaggccacgccgactacgtcaagaacatgatcaccggcgccgcgcagatggacggcgccatcctcgtcgtctccggcgccgacgggcccatgccgcagaccaaggagcacatcctcctcgccaagcaggtcggcgtccccaagatcgtcgtcttcctcaacaagaaggacatggtcgacgacgaggagctgctcgagctcgtcgagctcgaggtccgcgagctgctcagcaactacgagtacgacggcgacgacgtgcccatcatcgctggctccgccctcaaggcgctcgaggccctcatggccaaccctgccctcaagcgcggcgacaatgagtgggtggactacatcttcaacctggttgatgaagtggataactatattccagtcccacagcggcagaccgacctcccgttcttgctcgctgttgaggatgtcttctccatcaccggtcgtggtacagttgccactggccgtatcgagcgtggcaccgtcaaggttggtgacacagtcgatatcgttggaatccgggacacccggacctgcaccgtcactggtgttgagatgttccagaagaccatggatgatgccatggctggggacaatgtcgggctgctactccgtggtatgcagaaggacgacattgagagaggcatggtgctggcaaagcccggctctatcacaccgcacaccaagtttgaggctgttgtgtatgtgcttaagaaggaagagggtggccggcactcacctttcttccctggttaccgcccacagttctacatgcggacaaccgatgtgacggggagtgtgactacgattatgaatgacaaggatgaggaggcgaagatgtgcatgcctggtgaccgtatcaagatgattgttcagctcatccagcctgttgcttgtgagcagggtatgaggtttgctatccgtgagggtggtaagaccgttggtgctggtgtcatcaacaaaatcattgagtaa

SEQ ID NO: 10626 - protein, 466 aa, Sorghum bicolor
  misc_feature: Ceres ANNOT ID no. 6114221
  misc_feature (67)..(269): Pfam Id: GTP_EFTU Pfam Desc: Elongation factor Tu GTP binding domain
  misc_feature (366)..(465): Pfam Id: GTP_EFTU_D3 Pfam Desc: Elongation factor Tu C-terminal domain
  misc_feature (292)..(361): Pfam Id: GTP_EFTU_D2 Pfam Desc: Elongation factor Tu domain 2
  misc_feature (1)..(466): NCBI GI: 17225494 NCBI Desc: translational elongation factor tu [oryza sativa]
  misc_feature (1)..(466): NCBI GI: 6525065 NCBI Desc: chloroplast translational elongation factor tu [oryza sativa]
  misc_feature (3)..(466): NCBI GI: 12830555 NCBI Desc: chloroplast translational elongation factor tu [pelargonium graveolens]
  misc_feature (5)..(466): NCBI GI: 18776 NCBI Desc: ef-tu [glycine max]
  misc_feature (6)..(466): NCBI GI: 949873 NCBI Desc: ef-tu protein [glycine max]
  misc_feature: Useful for making plants with modulated oxidative stress sensitivity
  misc_feature: Functional homolog of the protein sequence given in SEQ ID NO 13085
MASLASASTSLLFPQATSSRSRVRLSTSLGFSAQPARLRSRAAAAGGQRRGRLLVVRAARGKFERTKPHVNIGTIGHVDHGKTTLTAALTMVLASVGGSAPKKYDEIDAAPEERARGITINTATVEYETETRHYAHVDCPGHADYVKNMITGAAQMDGAILVVSGADGPMPQTKEHILLAKQVGVPKIVVFLNKKDMVDDEELLELVELEVRELLSNYEYDGDDVPIIAGSALKALEALMANPALKRGDNEWVDYIFNLVDEVDNYIPVPQRQTDLPFLLAVEDVFSITGRGTVATGRIERGTVKVGDTVDIVGIRDTRTCTVTGVEMFQKTMDDAMAGDNVGLLLRGMQKDDIERGMVLAKPGSITPHTKFEAVVYVLKKEEGGRHSPFFPGYRPQFYMRTTDVTGSVTTIMNDKDEEAKMCMPGDRIKMIVQLIQPVACEQGMRFAIREGGKTVGAGVINKIIE

SEQ ID NO: 10627 - DNA, 1200 bp, Sorghum bicolor
  misc_feature: Ceres ANNOT ID no. 6114237
  misc_feature: Encodes the peptide sequence at SEQ ID NO 10628
atggcaaggtcatggctgataactggtaggggaattgctaagaaaataagatatgcagctcctagtgctaaccgccagataagagaactgattgcagaagcacggagggaatgcccaaactgcagttatgttattgataacagtgatgttgccatgcagtggcctgggctgcctgctggagtcaagtttgatccttctgaattggagttgcttcaacatttagaacaaaaggttggcctgggaggttcaaggccacatgtgctcattgatgaattcattccaactatagacaatgatgagggaatctgctattcacatcctgaaaatcttcctggtatcaaaacagatggtagcaatgcccatttcttccatagagtttcaaatgcgtatggttgtggcctgcgcaaacgtcgaaggatcatcaactgcaacaaccacactgttcctgatgagcatgtgagatggcacaagacagggagatccaaagccatatgtgacaatggtgttataaaaggttggaggaagataatggtgctgtacaaagcttcgcaaagaggtggaaagcctgatagggctaattgggtaatgcatcagtatcaccttggagaagaggaagacgaaaaggacggggagcttgtagtatctaaagtcttctgccagttgccaaataagagtatggaaatttgtgaaacagaaactgcttatgaagaacctgatgcacctgcttcagtgattggtcccaaaactccaaagacaaacgcaccgcagccacggcaccctaaaaatagtccatgtgaaactgagcagaatattcccatcctgcaggatcagctactactggacagcaaaggcgagcctaccatgcctattattagcctggaggatgatgctacgaaccctgtgtggtgtgctatagctgaagaacagcaggttgttggagaggcgtctcgggctcagttgaactcagatgaacctcttctttgtcatgaagacccaaattccttaaacgacaaagcattgcttcccttggactatccgattctgtcccaatgcaggaatgagatgcttgattggaacctgaatggacatgggttgcctgatctccataatgtggatcttggaacacctccagattttcagcttgctgactttcagtttggttctcaggaaagcctcggcagctggctggatcgcatctag

SEQ ID NO: 10628 - protein, 399 aa, Sorghum bicolor
  misc_feature: Ceres ANNOT ID no. 6114237
  misc_feature (57)..(202): Pfam Id: NAM Pfam Desc: No apical meristem (NAM) protein
  misc_feature (1)..(399): NCBI GI: 46805288 NCBI Desc: no apical meristem (nam)-like protein [oryza sativa (japonica cultivar-group)]
  misc_feature (24)..(237): NCBI GI: 124360744 NCBI Desc: no apical meristem (nam) protein [medicago truncatula]
  misc_feature (26)..(220): NCBI GI: 115435024 NCBI Desc: os01g0191300 [oryza sativa (japonica cultivar-group)]
  misc_feature (36)..(259): NCBI GI: 56202085 NCBI Desc: no apical meristem (nam) protein-like [oryza sativa (japonica cultivar-group)]
  misc_feature (32)..(230): NCBI GI: 115462515 NCBI Desc: os05g0194500 [oryza sativa (japonica cultivar-group)]
  misc_feature: The sequence is a functional homolog of SEQ ID NO 1710 in the 10/374,780US patent application
  misc_feature: The sequence is a functional homolog of SEQ ID NO 1711 in the 10/374,780US patent application
  misc_feature: The sequence is a functional homolog of SEQ ID NO 1712 in the 10/374,780US patent application
  misc_feature: The sequence is a functional homolog of SEQ ID NO 1713 in the 10/374,780US patent application
  misc_feature: Useful for making plants with modulated growth and phenotype characteristics
  misc_feature: The sequence is a functional homolog of SEQ ID NO 1710 in the 20060162006 US patent application
  misc_feature: The sequence is a functional homolog of SEQ ID NO 1711 in the 20060162006 US patent application
  misc_feature: The sequence is a functional homolog of SEQ ID NO 1713 in the 20060162006 US patent application
  misc_feature: The sequence is a functional homolog of SEQ ID NO. 335 in the 11/188,298 US application
  misc_feature: The sequence is a functional homolog of SEQ ID NO. 362 in the 11/188,298 US application
  misc_feature: The sequence is a functional homolog of SEQ ID NO. 466 in the 11/188,298 US application
MARSWLITGRGIAKKIRYAAPSANRQIRELIAEARRECPNCSYVIDNSDVAMQWPGLPAGVKFDPSELELLQHLEQKVGLGGSRPHVLIDEFIPTIDNDEGICYSHPENLPGIKTDGSNAHFFHRVSNAYGCGLRKRRRIINCNNHTVPDEHVRWHKTGRSKAICDNGVIKGWRKIMVLYKASQRGGKPDRANWVMHQYHLGEEEDEKDGELVVSKVFCQLPNKSMEICETETAYEEPDAPASVIGPKTPKTNAPQPRHPKNSPCETEQNIPILQDQLLLDSKGEPTMPIISLEDDATNPVWCAIAEEQQVVGEASRAQLNSDEPLLCHEDPNSLNDKALLPLDYPILSQCRNEMLDWNLNGHGLPDLHNVDLGTPPDFQLADFQFGSQESLGSWLDRI

SEQ ID NO: 10629 - DNA, 684 bp, Sorghum bicolor
  misc_feature: Ceres ANNOT ID no. 6114273
  misc_feature: Encodes the peptide sequence at SEQ ID NO 10630
atgggtctcaacgccgcggcggctgccttctacgcctttccagtactcatctctgtgctcacagtccgcttcttctatgtgctgtggcacagtggccaaccagtgtcgaggccgcgtgccactggattgcgttgtctcatagtccttggctccggagggcataccgcagaaatgatgaatattttaacaacacttcagaaggataggttcacaccaagatactatgtggctgcacttactgacaacatgagtcttcaaaaggcacaggtctatgaacagtcacttattcaggtggagagcgatggagcgaagactgccgagaatgctcatttcatgcagatataccgtagtcgtgaagtaggccaatcttatattacatccatcgcaactacattgctagccacattgcatgctatgtggctagtaataagaatcagaccacaagtgatattttgcaatggtccagggacatgctttcctctatgcgtctcagctttccttctgaaggtgcttggtttgggatggtcctccattttctacattgaaagcattgcaagagtgaagaagctatcactgagcggtttactgttgtacaagctacggatagctgaccagttctttgtgcagtggccccagctgcagcataagtatcctcgagcatgctatgcaggtcgtttgatgtaa

SEQ ID NO: 10630 - protein, 227 aa, Sorghum bicolor
  misc_feature: Ceres ANNOT ID no. 6114273
  misc_feature (45)..(226): Pfam Id: Alg14 Pfam Desc: Oligosaccharide biosynthesis protein Alg14 like
  misc_feature (15)..(227): NCBI GI: 53734614 NCBI Desc: zgc:101623 [danio rerio]
  misc_feature (12)..(227): NCBI GI: 74635505 NCBI Desc: udp-n-acetylglucosamine transferase subunit alg14 (asparagine linked glycosylation protein 14)
  misc_feature (1)..(227): NCBI GI: 74586002 NCBI Desc: udp-n-acetylglucosamine transferase subunit alg14 (asparagine linked glycosylation protein 14)
  misc_feature (38)..(213): NCBI GI: 116129926 NCBI Desc: ensangp00000014213 [anopheles gambiae str. pest]
  misc_feature (30)..(227): NCBI GI: 146449901 NCBI Desc: udp-n-acetylglucosamine transferase subunit alg14 [lodderomyces elongisporus nrrl yb-4239]
MGLNAAAAAFYAFPVLISVLTVRFFYVLWHSGQPVSRPRATGLRCLIVLGSGGHTAEMMNILTTLQKDRFTPRYYVAALTDNMSLQKAQVYEQSLIQVESDGAKTAENAHFMQIYRSREVGQSYITSIATTLLATLHAMWLVIRIRPQVIFCNGPGTCFPLCVSAFLLKVLGLGWSSIFYIESIARVKKLSLSGLLLYKLRIADQFFVQWPQLQHKYPRACYAGRLM

SEQ ID NO: 10631 - DNA, 570 bp, Sorghum bicolor
  misc_feature: Ceres ANNOT ID no. 6114275
  misc_feature: Encodes the peptide sequence at SEQ ID NO 10632
atggcagtcatcaccgtgatgctcctcctcgtcctcgccgccgccgccgccgccgtcgtcgcggcgccggcggcatctgcggctgctggcggaggcgacaaggagacgcacatcaagctgtactggcacgacgtggtaagcggcgcgagcccgacggtggtggaggtggcgcgcgccgccatgaccaacacctccaagagcttgttcggcgccgtgatggtgatcgacgacccgctcaccgagggccccgacctcctcaactcctcctccgccgcggccggcggcggcggactcctcgggcgcgcgcagggcacgtacatcagcgccggcaaggacgaggtgtcgctcatgatgaacatgaacttcgtgttccaggcgggaaagtacaacggcagcaccgtggccatcatgggccggaacgccgtgttcgacgccgtccgggagatggccgtcgtcggcggcaccggcgtgttcaggatggcgcgcgggtacgcgcaggcacggacgcacaccttcgacctcaacaccggcgacgccaccgtcgagtacaacctctacatcaggcattga

SEQ ID NO: 10632 - protein, 189 aa, Sorghum bicolor
  misc_feature: Ceres ANNOT ID no. 6114275
  misc_feature (9)..(189): Pfam Id: Dirigent Pfam Desc: Dirigent-like protein
  misc_feature (2)..(189): NCBI GI: 88771129 NCBI Desc: dirigent-like protein pdir3 [picea engelmannii x picea glauca]
  misc_feature (2)..(189): NCBI GI: 88771137 NCBI Desc: dirigent-like protein pdir7 [picea glauca]
  misc_feature (4)..(189): NCBI GI: 88771125 NCBI Desc: dirigent-like protein pdir1 [picea glauca]
  misc_feature (4)..(189): NCBI GI: 88771141 NCBI Desc: dirigent-like protein pdir9 [picea engelmannii x picea glauca]
  misc_feature (10)..(189): NCBI GI: 88771131 NCBI Desc: dirigent-like protein pdir4 [picea engelmannii x picea glauca]
MAVITVMLLLVLAAAAAAVVAAPAASAAAGGGDKETHIKLYWHDVVSGASPTVVEVARAAMTNTSKSLFGAVMVIDDPLTEGPDLLNSSSAAAGGGGLLGRAQGTYISAGKDEVSLMMNMNFVFQAGKYNGSTVAIMGRNAVFDAVREMAVVGGTGVFRMARGYAQARTHTFDLNTGDATVEYNLYIRH

SEQ ID NO: 10633 - DNA, 537 bp, Sorghum bicolor
  misc_feature: Ceres ANNOT ID no. 6114277
  misc_feature: Encodes the peptide sequence at SEQ ID NO 10634
atggccgccgccgccgccgtgctcctcgtcgtcctactgccaatcctggtggccgccgcacctgccgcgtcggcggcgtcgtccggcgagaagagcacgcacatcaagctgtactggcacgacgtggtgagcgggccgagccccacggcggtgccggtggcgcgtgcggcggtgaccaacacctccaagacggccttcggcgccgtggtggtgatcgacgacccgctcaccgaggggcccgacctcaagtcctccaagcccctcggccgcgcgcagggcacctacatcggcgccggcaaggacgaggtgtcgctcatgatgaacatgaacttcgtgttccaggccgggaagtacaacggcagcaccgtcgccatcatgggtcggaacgccgtgttcaacgccgtccgggagatggccgtcgtcggcggcaccggcgtgttcaggatggcgcgcgggtacgcgcaggcacggacgcacaccctcgacctcaagaccggcgacgccaccgtcgagtacaacctctacatcaagcactga

SEQ ID NO: 10634 - protein, 178 aa, Sorghum bicolor
  misc_feature: Ceres ANNOT ID no. 6114277
  misc_feature (8)..(178): Pfam Id: Dirigent Pfam Desc: Dirigent-like protein
  misc_feature (6)..(178): NCBI GI: 88771137 NCBI Desc: dirigent-like protein pdir7 [picea glauca]
  misc_feature (6)..(178): NCBI GI: 88771129 NCBI Desc: dirigent-like protein pdir3 [picea engelmannii x picea glauca]
  misc_feature (3)..(178): NCBI GI: 88771151 NCBI Desc: dirigent-like protein pdir14 [picea engelmannii x picea glauca]
  misc_feature (2)..(178): NCBI GI: 88771143 NCBI Desc: dirigent-like protein pdir10 [picea glauca]
  misc_feature (1)..(178): NCBI GI: 88771147 NCBI Desc: dirigent-like protein pdir12 [picea glauca]
MAAAAAVLLVVLLPILVAAAPAASAASSGEKSTHIKLYWHDVVSGPSPTAVPVARAAVTNTSKTAFGAVVVIDDPLTEGPDLKSSKPLGRAQGTYIGAGKDEVSLMMNMNFVFQAGKYNGSTVAIMGRNAVFNAVREMAVVGGTGVFRMARGYAQARTHTLDLKTGDATVEYNLYIKH

SEQ ID NO: 10635 - DNA, 1698 bp, Sorghum bicolor
  misc_feature: Ceres ANNOT ID no. 6114285
  misc_feature: Encodes the peptide sequence at SEQ ID NO 10636
atggcgggggcgcccggggtggggccgggcgcgggtgccggtgcgggtgcgggagggggtggcggcgccgcggcggggctcaagacctacttcaagacgcccgaggggaggtacaagctgcagtacgagaagacgcactccgcggtgctgcactacagccacggcggcaagaccgtatcccagttgacagtggcatacctcaaggagaagcctgctagccagggctcccagccatcaacgccaagctccagcagtgggatgcggtctgcggcagcaaggctgctgggcagtgggaatgggagcaaggcgcttagctttggcggcagcaatggcgctggccgggctgttgctggaagcagccgtataggaggaggaggaggccttggtacatctacaggccttggtggatcacaaggtgccacaaattatgatggcaagggtacatatattgtattcaatgctgctgatacgctattcatcagcgatctcaattctcaggagaaggatccactaaagtccatccatttcagcaactcaaacccactgtgccatgcattcgacccagaggccaaagaggggcatgacctgatcattaggatgggatcaggggatgtctattcaatgtcgctgaggcaacagttacaagatcctggaagaaaaccagtggcagctctacattacaataagggtgataaagatgtctcgcccaatggaagtcggtgcacttctgtcgcatgggtgccagagcgtgaaggcattttcgtcattagccattctgatggaaatttgtacgtgtatgataaaaacaaggatgggaacacagactgtacgtttccagctgtgaaggatcaatcccagtttatggttgcacatgcaaagtcgagtaagagcaacccagttgctagatggcatatatgtcaaggttcgatcaatgcgatttccttttcaccagatggcgcatacttggcgactgttgggagagatggttatttgagagtttttgatttttcaaaggaacaactaatatttggtggaagaagttattatggtgcactgttgtgttgcacttggagctcggatggaaaatatctattaacaggtggtgaagatgatcttgtgcaggtatggggcatggatgatagaaagatagttgcttggggtgaaggacataattcatgggttagtggagttgcttttgattcatattggtccccaccaagttctgatggaaatggagaaaatgtctatcgttttggttctgttggtcaggacacccaactacttctgtgggacctggcactggacgagattgttgtcccactacggcatccttcaagtgcctcaccgacatttagcagtgggagcccttccgcgcactgggacaatgcatgccctccgacaggtgttctgcaaccttctcctagaatgcgagacgtccccaaactctcgccccttgttgcccaccgagtacatgctgatcccctatctggcgtggtgttcaccaatgaatcaatcctcaccatctgccgtgagggcctcgtcaaaatctgggttcgaccagaccagagtgaaaacaatcaacaatcaaatccttcagagtttgttttaggccctgtctcaaaggatagggcgatcacatcttcgaataaagcaagtagctccagcttcaagaagccatcgtctgttcttgttgcatga

SEQ ID NO: 10636 - protein, 565 aa, Sorghum bicolor
  misc_feature: Ceres ANNOT ID no. 6114285
  misc_feature (297)..(335): Pfam Id: WD40 Pfam Desc: WD domain, G-beta repeat
  misc_feature (2)..(563): NCBI GI: 115487588 NCBI Desc: os12g0172500 [oryza sativa (japonica cultivar-group)]
  misc_feature (26)..(558): NCBI GI: 42565893 NCBI Desc: transducin family protein / wd-40 repeat family protein [arabidopsis thaliana]
  misc_feature (8)..(553): NCBI GI: 42569691 NCBI Desc: transducin family protein / wd-40 repeat family protein [arabidopsis thaliana]
  misc_feature (240)..(558): NCBI GI: 124359426 NCBI Desc: wd40-like [medicago truncatula]
  misc_feature (240)..(558): NCBI GI: 140042781 NCBI Desc: wd40-like [medicago truncatula]
  misc_feature: The sequence is a functional homolog of SEQ ID NO. 502 in the 11/188,298 US application
MAGAPGVGPGAGAGAGAGGGGGAAAGLKTYFKTPEGRYKLQYEKTHSAVLHYSHGGKTVSQLTVAYLKEKPASQGSQPSTPSSSSGMRSAAARLLGSGNGSKALSFGGSNGAGRAVAGSSRIGGGGGLGTSTGLGGSQGATNYDGKGTYIVFNAADTLFISDLNSQEKDPLKSIHFSNSNPLCHAFDPEAKEGHDLIIRMGSGDVYSMSLRQQLQDPGRKPVAALHYNKGDKDVSPNGSRCTSVAWVPEREGIFVISHSDGNLYVYDKNKDGNTDCTFPAVKDQSQFMVAHAKSSKSNPVARWHICQGSINAISFSPDGAYLATVGRDGYLRVFDFSKEQLIFGGRSYYGALLCCTWSSDGKYLLTGGEDDLVQVWGMDDRKIVAWGEGHNSWVSGVAFDSYWSPPSSDGNGENVYRFGSVGQDTQLLLWDLALDEIVVPLRHPSSASPTFSSGSPSAHWDNACPPTGVLQPSPRMRDVPKLSPLVAHRVHADPLSGVVFTNESILTICREGLVKIWVRPDQSENNQQSNPSEFVLGPVSKDRAITSSNKASSSSFKKPSSVLVA

SEQ ID NO: 10637 - DNA, 720 bp, Sorghum bicolor
  misc_feature: Ceres ANNOT ID no. 6114294
  misc_feature: Encodes the peptide sequence at SEQ ID NO 10638
atggcttctcatgctgtcgtcgtcctccccctcccttggcttgccagctgtgtttgtgtctgcatggttgcagtagtagccttgttggcgtcgtctccggcgccggcggccgcgtcgcgtgccgcaagggcccctgtccacggtggcaacccgacggtggggttcacggaggtgaggctgactgagagcaacttcgagctgcagcgtccctacgacgagccgagcggcgaccggtacagcttccacggcggcgtccggcagctgtgggtgctgtcctccgacaagccccacgctcgcaacagccacaccagccccagaacggagatcaggatgacgggctacgactactcttctggggtgtggcagttcgagggctacggctacgtgcccgccggcacgacgggggtgtccatcatgcaggtgttcggcgccggcgagacagcgacgacgctgatgctgcacgtctacgacggcgcgctgcggtactacgaccggcaggtggtggaggacggcatctacgaccggtggttccggctcaacgtggtgcacgacgtcggcgcgtcgatgctcaccgtctacatcgacggcgtccagaagctgcaggcgccgggacgcggcggcgactcgcactacttcaagttcggcgtgtacgcgcagaggcacgcctccagctgcatggagtcgcgctggaagaacatcaagatctttaggaaacattag

SEQ ID NO: 10638 - protein, 239 aa, Sorghum bicolor
  misc_feature: Ceres ANNOT ID no. 6114294
  misc_feature (58)..(237): Pfam Id: Alginate_lyase2 Pfam Desc: Alginate lyase
  misc_feature (14)..(238): NCBI GI: 77553101 NCBI Desc: kda extracellular calmodulin-binding protein [oryza sativa (japonica cultivar-group)]
  misc_feature (50)..(238): NCBI GI: 24745940 NCBI Desc: citrate binding protein [solanum tuberosum]
  misc_feature (42)..(238): NCBI GI: 92873114 NCBI Desc: 24 kda protein sc24 [medicago truncatula]
  misc_feature (50)..(239): NCBI GI: 15072335 NCBI Desc: 21 kda extracellular calmodulin-binding protein [angelica dahurica]
  misc_feature (46)..(238): NCBI GI: 45384963 NCBI Desc: 24 kda seed coat protein [glycine max]
MASHAVVVLPLPWLASCVCVCMVAVVALLASSPAPAAASRAARAPVHGGNPTVGFTEVRLTESNFELQRPYDEPSGDRYSFHGGVRQLWVLSSDKPHARNSHTSPRTEIRMTGYDYSSGVWQFEGYGYVPAGTTGVSIMQVFGAGETATTLMLHVYDGALRYYDRQVVEDGIYDRWFRLNVVHDVGASMLTVYIDGVQKLQAPGRGGDSHYFKFGVYAQRHASSCMESRWKNIKIFRKH

SEQ ID NO: 10639 - DNA, 1323 bp, Sorghum bicolor
  misc_feature: Ceres ANNOT ID no. 6114299
  misc_feature: Encodes the peptide sequence at SEQ ID NO 10640
atgctcttccggaagcgcatcaactacgtggccccgatgctcgcctccgccttcatcctgctcctcctcctctcgggctacttcgagctcccgtccatctcctccacctcgctctccacgccatcgccgctcctcgccgcggcgcgcttccccaccgcgctcgactccgtcggctcccgcgaccgcgaccccttcacctccctcctcgaggccttcgcctcctgggacgccgccgtcggctgcccccgcatccgcgccaagctcgccgccaccgcgggagtggagcggggcctgacaccgccgggcgccggcgctaacgacaccgcggcggaggaccctgcggcggcggcggcggcggcggccgtcaccggcggcgccgcgtggcggggcgccgcgaggtgcgaggacctcgcggcgcgccatgtcaacgtgctcgtcaaggggtggacgtgggtccccgacgcgctcgacggcgtctacacgtgccggtgcggagttagctgcgtctggagcaagtctgttgccgccgtcgaccgccccgacgcgctgctctttgagggcgccacgccgccgccgcagagaatgaaaggtctgcctctgcgtgtttatctggatctggaggctagtaggaagccaactggttttgaggacatttttattggttaccatgccaatgatgacttgcaagtaacatatgctggaaaatcatttcacaccagccgtagttaccatatatcaactgaaaagagaaatgatgcacttatttactggtcatcttcaaggtgccttcctcatagagataagcttgcaaaagacttcctctcattggtgcctcaccattcgtttggaagatgtttgaataatgttggtggtcctgacatggccttatccatgtatccagtttgctccaccaatgacaatggcactccacactggtgggatcacctccattgtgcaatgtcacattacaagtttgttcttgcaattgagaacaccaagactgaaagttatgtgactgagaagttgttctatgctttggaggctgggtcagtgccaatatactttggggcacccaatgtttgggattttgttcctcctaattctatcatagatgcctccaaattcagctcactcaaagaactggcttcatatgtgaaaatgctggcaaatgaccctgtagcctatgctgaataccatgcatggaggcgttgtggtgtattgggtaactttggcagggcacgtgagatgagcctcgacacactgccttgccgactctgtgaagtagttagcaagagaggtggtaagagtgcagatgcattgtga

SEQ ID NO: 10640 - protein, 440 aa, Sorghum bicolor
  misc_feature: Ceres ANNOT ID no. 6114299
  misc_feature (89)..(441): Pfam Id: Glyco_transf_10 Pfam Desc: Glycosyltransferase family 10 (fucosyltransferase)
  misc_feature (1)..(440): NCBI GI: 82775236 NCBI Desc: 4-alpha-l-fucosyltransferase [zea mays]
  misc_feature (14)..(440): NCBI GI: 82775238 NCBI Desc: 4-alpha-l-fucosyltransferase [oryza sativa]
  misc_feature (14)..(440): NCBI GI: 77553762 NCBI Desc: gdp-fuc:gal-beta-1,3glcnac-r alpha1,4-fucosyltransferase [oryza sativa (japonica cultivar-group)]
  misc_feature (154)..(440): NCBI GI: 115487570 NCBI Desc: os12g0170600 [oryza sativa (japonica cultivar-group)]
  misc_feature (130)..(439): NCBI GI: 18477220 NCBI Desc: alpha-1,4-fucosyltransferase [lycopersicon esculentum]
MLFRKRINYVAPMLASAFILLLLLSGYFELPSISSTSLSTPSPLLAAARFPTALDSVGSRDRDPFTSLLEAFASWDAAVGCPRIRAKLAATAGVERGLTPPGAGANDTAAEDPAAAAAAAAVTGGAAWRGAARCEDLAARHVNVLVKGWTWVPDALDGVYTCRCGVSCVWSKSVAAVDRPDALLFEGATPPPQRMKGLPLRVYLDLEASRKPTGFEDIFIGYHANDDLQVTYAGKSFHTSRSYHISTEKRNDALIYWSSSRCLPHRDKLAKDFLSLVPHHSFGRCLNNVGGPDMALSMYPVCSTNDNGTPHWWDHLHCAMSHYKFVLAIENTKTESYVTEKLFYALEAGSVPIYFGAPNVWDFVPPNSIIDASKFSSLKELASYVKMLANDPVAYAEYHAWRRCGVLGNFGRAREMSLDTLPCRLCEVVSKRGGKSADAL

SEQ ID NO: 10641 - DNA, 1170 bp, Sorghum bicolor
  misc_feature: Ceres ANNOT ID no. 6114304
  misc_feature: Encodes the peptide sequence at SEQ ID NO 10642
atggtcgctgctagccttctcaagtcctccttccttcccaagaagtccgaatggggcgccacccggcaagccgccgcctccccccggccggccaccgtctccgtcgtcgtccgcgcctccgcctacgccgatgagctcgtcaagaccgccaaaacgatcgcgtcgccggggcgaggcatcctggcgatggacgagtcgaacgcgacgtgcgggaagaggctggcgtcgatcgggctggagaacacggaggcgaacaggcaggcgtaccggacgctgctggtgacggcgccggggctgggccagtacatctccggcgccatcctgttcgaggagacgctgtaccagtccgccgtcgacggccggaagatcgtcgacatcctggtggagcaagggatcgtgcccgggatcaaggtcgacaagggcctcgtcccgctcgccggctccaacaacgagtcctggtgccagggcctcgacggcctcgcctctcgcgaggccgcctactaccagcagggcgcccggttcgccaagtggcgcaccgtcgtcagcatccctaatggcccctctgagctcgccgtcaaggaggccgcctggcgcctcgctcgctacgccgccatctcacaggacaatgggctggtgccgatcgtggagccggagatcctcctcgacggcgagcacgggatcgagcggacgttcgaggtggcgcagaaggtgtgggcggagacgttctacgcgatggcggagaacaacgtgatgttcgagggcatcctactgaagccatccatggtgacgccgggggcggaggccaaggacagggcgacgccggagcaggtggcggagtacacgctgaagctcctgcaccgccggatcccgccgtccgtgccggggatcatgttcctctcgggaggccagtcggaggtggaggcgacgcagaacctcaacgccatgaaccagggcaccaacccgtggcacgtgtccttctcctacgcccgcgcgctgcagaacacctgcctcaagacctggggcggccagccggagaaggtgacggcggcgcaggacgcgctgctgctccgcgccaaggctaactccctggcgcagctcggcaagtacacctccgacggcgaggccgccgaggccaaggagggcatgttcgtcaagaactacagctactaa

SEQ ID NO: 10642 - protein, 389 aa, Sorghum bicolor
  misc_feature: Ceres ANNOT ID no. 6114304
  misc_feature (45)..(389): Pfam Id: Glycolytic Pfam Desc: Fructose-bisphosphate aldolase class-I
  misc_feature (1)..(389): NCBI GI: 78099750 NCBI Desc: fructose-bisphosphate aldolase, chloroplast precursor (aldp)
  misc_feature (1)..(389): NCBI GI: 218155 NCBI Desc: chloroplastic aldolase [oryza sativa]
  misc_feature (1)..(389): NCBI GI: 8272480 NCBI Desc: fructose 1,6-bisphosphate aldolase precursor [avena sativa]
  misc_feature (1)..(389): NCBI GI: 4827253 NCBI Desc: plastidic aldolase [nicotiana paniculata]
  misc_feature (1)..(389): NCBI GI: 4827251 NCBI Desc: plastidic aldolase npaldp1 [nicotiana paniculata]
  misc_feature (1)..(389): SWISSPROT Homolog: EC 4.1.2.13 Fructose-bisphosphate aldolase, chloroplast precursor
  misc_feature: Useful for making plants with modulated biomass
  misc_feature: Functional homolog of the protein sequence given in SEQ ID NO 13636
  misc_feature: Useful for making plants with modulated phosphate use efficiency
  misc_feature: Functional homolog of the protein sequence given in SEQ ID NO 12920
MVAASLLKSSFLPKKSEWGATRQAAASPRPATVSVVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWRLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 10643 - DNA, 2772 bp, Sorghum bicolor
  misc_feature: Ceres ANNOT ID no. 6114320
  misc_feature: Encodes the peptide sequence at SEQ ID NO 10644
atggccgcatcgccctacccgacgccgacggggccaccgcctctcatgggactcctgggtatccttctcctcctcctcatcatcctcgtctccctctccccatcgattccactagcggaggcgggcgcggaggcggcaggggttctgaggcaagtggttggtggggacgacgacgacggcgggaacttcttcgagccgttcaacgtgacctacgaccaccgcgcgctcatccttggcgggaagcgcaggatgctcgtctccgcggggctccactacccgcgcgccacgcccgagatgtggccgagtttgattgcaaaggctaaggagggcggcgtggatgtaattgagacctatatcttttggaatgggcatgagcctgccaaaggccagtactactttgaaggaagatttgatattgtcaggtttgctaagctggttgctgcagaaggcctttttctgttccttcgtatcggcccatatgcttgtgctgaatggaatttcggtggtttcccagtttggctgcgtgacatccctgggatagaattccgtactgacaatgaaccctacaaggctgaaatgcagaattttgtgacaaaaatcgtagatatcatgaaagaggagaaactttattcttggcaaggtggtcccattatactacagcagattgaaaatgaatatggtaacattcaaggcaagtatggtcaagcagggaagagatacatgcaatgggcagctcagatggcacttgcacttgatactggtgttccttgggtcatgtgcaggcaaacagatgctccagaacaaattctcgatacgtgcaatgccttttattgcgatggtttcaaaccaaattcctacaacaagccaacaatatggactgaggattgggatggatggtatgccgactggggtgaagcgttgccacataggcctgctcaagatagtgcttttgctgttgctcgtttttatcaacgtggtggaagctttcaaaactattacatgtattttggtggaacaaattttgagcggacagctggtggtccacttcagataactagctatgattatgatgcaccaatcgatgaatacggtatcttaaggcaacctaagtgggggcatttgaaagacctacatgcagctattaaactgtgtgaaccagctcttactgcagtagatggctcacctcgttatataaaattagggcccatgcaagaggcacatgtatattcaagtgaaaatgtccacacaaatggaagcatttcaggaaatgcacagttttgctcagcttttcttgccaacattgatgaacataaatatgcttcagtttggatttttggaaaatcttatagtctaccaccatggtctgtgagcatactaccagactgtgaaactgtggcttttaatacagcgagggttggtacacaaacgtcgttttttaatgtcgaatctgggtcccccagttattcaagtagacataagcctagaattctatcccttggtggcccctatctctcaagtacttggtgggcttctaaagaacctgttggcatatggagtgaagacatctttgctgctcaggggatattagagcacttaaacgtgacaaaagacatatctgactacctttcatatactaccagggtgaacatttctgatgaggatgttttatattggaattcagaaggtttacttccatcactaaccatagatcaaattcgtgatgtagtgcgcatatttgtaaatgggaagcttgcaggtagtcaagttggtcactgggtctcactgaatcaaccacttcaattggttcaaggacttaatgagttgacattgttatcagagattgttggcttgcagaactatggtgctttcttggagaaggatggtgctggatttaggggtcaagtaaaactcactggcttgtcaaatggggatatcgaccttactaattctctttggacgtatcagattggtttgaaaggtgagttttcaaggatctattctcctgagaagcaaggatctgctgggtggagtagcatgcaaaatgatgacacactttcacccttcacatggttcaagactacgtttgatgctccagaaggtaatggccctgttgccattgatcttgggagcatgggaaagggccaggcttgggtgaatgggcatctcattgggcgctattggtcactagttgcaccagagtctgggtgtccgtcctcatgcaactatgcaggaaattacggtgatagcaagtgccgatcaaactgtggaattgctacacaaagctggtaccacataccacgcgaatggttgcaagagtcagacaatctattggtactcttcgaggaaacagggggagacccttctcagatatcgctggaggttcattacaccaaaacaatctgctcaaaaatatctgagacttactatcctcccctttctgcctggtctcgtgctgccaacggtcgtccctcagtaaatacagtagcaccagaacttcgcttgcagtgcgatgaggggcatgtgatctcgaagattacatttgcgagttatgggacccctacaggagattgccagaacttctctgtagggaattgtcatgcatcgactactctagacttggtggcagaggcctgcgaaggcaagaacagatgtgcgatcagtgttaccaatgatgtattcggcgacccatgccgaaaagtcgtcaaggatttggcagttgtggccgagtgctccccgccgtcagctaacaaagaacctcgagatgatatgtga

SEQ ID NO: 10644 - protein, 923 aa, Sorghum bicolor
  misc_feature: Ceres ANNOT ID no. 6114320
  misc_feature (75)..(381): Pfam Id: Glyco_hydro_35 Pfam Desc: Glycosyl hydrolases family 35
  misc_feature (834)..(910): Pfam Id: Gal_Lectin Pfam Desc: Galactose binding lectin domain
  misc_feature (13)..(923): NCBI GI: 115488372 NCBI Desc: os12g0429200 [oryza sativa (japonica cultivar-group)]
  misc_feature (63)..(910): NCBI GI: 114217393 NCBI Desc: beta-d-galactosidase [persea americana]
  misc_feature (63)..(914): NCBI GI: 61162194 NCBI Desc: beta-d-galactosidase [pyrus pyrifolia]
  misc_feature (63)..(914): NCBI GI: 84579373 NCBI Desc: pear beta-galactosidase3 [pyrus communis]
  misc_feature (61)..(913): NCBI GI: 7939617 NCBI Desc: beta-galactosidase [lycopersicon esculentum]
  misc_feature (68)..(486): SWISSPROT Homolog: EC 3.2.1.23 Beta-galactosidase precursor
  misc_feature: Useful for making plants with altered cell wall content and/or composition
  misc_feature: Useful for making plants with modulated biomass
  misc_feature: Useful for making plants with modulated drought sensitivity
  misc_feature: Useful for making plants with modulated heat sensitivity
  misc_feature: Useful for making plants with modulated nitrogen use efficiency
  misc_feature: Functional homolog of the protein sequence given in SEQ ID NO 13434
  misc_feature: Functional homolog of the protein sequence given in SEQ ID NO 13476
  misc_feature: Functional homolog of the protein sequence given in SEQ ID NO 13480
  misc_feature: GREAT-hit functional homolog of the protein sequence encoded by LOCUS at2g32810
  misc_feature: Useful for making plants with altered carbohydrate content
  misc_feature: Functional homolog of the protein sequence given in SEQ ID NO 13634
  misc_feature: Useful for making plants with altered cell wall content and/or composition
  misc_feature: Functional homolog of the protein sequence given in SEQ ID NO 13635
MAASPYPTPTGPPPLMGLLGILLLLLIILVSLSPSIPLAEAGAEAAGVLRQVVGGDDDDGGNFFEPFNVTYDHRALILGGKRRMLVSAGLHYPRATPEMWPSLIAKAKEGGVDVIETYIFWNGHEPAKGQYYFEGRFDIVRFAKLVAAEGLFLFLRIGPYACAEWNFGGFPVWLRDIPGIEFRTDNEPYKAEMQNFVTKIVDIMKEEKLYSWQGGPIILQQIENEYGNIQGKYGQAGKRYMQWAAQMALALDTGVPWVMCRQTDAPEQILDTCNAFYCDGFKPNSYNKPTIWTEDWDGWYADWGEALPHRPAQDSAFAVARFYQRGGSFQNYYMYFGGTNFERTAGGPLQITSYDYDAPIDEYGILRQPKWGHLKDLHAAIKLCEPALTAVDGSPRYIKLGPMQEAHVYSSENVHTNGSISGNAQFCSAFLANIDEHKYASVWIFGKSYSLPPWSVSILPDCETVAFNTARVGTQTSFFNVESGSPSYSSRHKPRILSLGGPYLSSTWWASKEPVGIWSEDIFAAQGILEHLNVTKDISDYLSYTTRVNISDEDVLYWNSEGLLPSLTIDQIRDVVRIFVNGKLAGSQVGHWVSLNQPLQLVQGLNELTLLSEIVGLQNYGAFLEKDGAGFRGQVKLTGLSNGDIDLTNSLWTYQIGLKGEFSRIYSPEKQGSAGWSSMQNDDTLSPFTWFKTTFDAPEGNGPVAIDLGSMGKGQAWVNGHLIGRYWSLVAPESGCPSSCNYAGNYGDSKCRSNCGIATQSWYHIPREWLQESDNLLVLFEETGGDPSQISLEVHYTKTICSKISETYYPPLSAWSRAANGRPSVNTVAPELRLQCDEGHVISKITFASYGTPTGDCQNFSVGNCHASTTLDLVAEACEGKNRCAISVTNDVFGDPCRKVVKDLAVVAECSPPSANKEPRDDM

SEQ ID NO: 10645 - DNA, 2097 bp, Sorghum bicolor
  misc_feature: Ceres ANNOT ID no. 6114354
  misc_feature: Encodes the peptide sequence at SEQ ID NO 10646
atgaatccttactttgttgggattcttgtccctgtcgcggtctcccttttgctccgcaagaggagaaaggccgaaaggaagaggggagtgccagtcgaggttggtggggagcctggatatgcagtccgtaactatcgatttgagcagcccgttgagacacactgggagggggtctccacacttgctgagctgtttgagcaatcttgcaaagagtatgtcaacatgccactccttggcaccaggaagctcatctcgagggaaactgaagcagcacctggcgggagatcgtttgagaagttgcatctgggcgagtatgagtggaagtgttatgcagagtgcttcaagagcgtttgcagcttttcatctggactaattcgagtaggtcacgagaagaatgaacgtgttgctatttttgctgagacacgggctgagtggcagattgcgttgcaggcgtgcttcagacaaaacattacagttgtcaccatctatgcctcattgggggaggaagcattgtgtcactcactaaatgagactgaggtcactactgtagtttgtggtcagaaagaactaaagaagttgattgatataagtgggcaacttgacactgtcaagcatgttgtctatatcaacgaggaaggcatatcagctgaagtttctttagctcaaaactgcactagctggaaggttgaatcatttgaggaagtaattaggttaggatctgaatcacctgttgaagccaacatgcctctcccttctgatgttgcggtgataatgtacacaagtggtagcaccggattgcccaagggagttatgatgacccaccgcaacgtcctggctacactctcagcagttatgaccattgtgcctgcacttggcagtaaagatatatacttggcctacctcccacttgcacacattcttgagttggcagcagaggcactaatggctgctgttggggcctccataggatatggatcacctttgaccctgactgatacatccaacaaaataaaaaaaggaactctaggtgatgcttctgcactaaagccaacattgatgactgctgtacctgctatacttgaccgtgtgcgtgatggtgtgaggaaaaaggtggatgcaaagggtggtatagcaaagcaattgtttgacattgcctataaccgtcggcttgctgcaatcaatggaagttggcttggtgcctggggtttggagaaacacttgtgggatacgcttgtgtttggaaaggttcgtgctattttgggaggaaagattcggtttgtactttcaggtggagcacctctatctggtgatactcagagatttatcaatatatgccttggggctccaatagggcaaggttatggtctgactgaaacttgtgctggagggacattttcagagtatgatgacacatctgttggccgtgttggtgctccactaccttgttcgtttattaagttgatcgactggcctgagggtggatacttgactactgatttaccaatgcctcggggagaaatagtcattgggggtccaaatgttactaaaggctatttcaagaatgaagctaaaacaaatgaagtgtacaaggatgacgaaaaaggtatgcgatggttctattctggtgacatcggacgattccatccagatggctgccttgaaatcattgaccgtaagaaagatattgtgaagcttcaacatggcgaatatgtatcgctcgggaaggtggaggctgctttgattgtgagcccatatgtggagaacattatgatccatgctgatcctttccacaattactgtgttgcgcttgtggtagctgcacacattgagctggaaagctgggcttcacagcaaggaattaaatacagtgatttctcagatttgtgccagaagcaagaggctgttaaagaagtgcttggatctttagcgaaggctgcaaagcaagcacgacttgagaaatttgagataccagccaaaatcaagttgataccagagccatggacccccgagtcaggactcgtcactgctgccctcaagctcaagagggaggtgatcaggaagacgtatgagaatgatctggctcagctgtacgcatga

SEQ ID NO: 10646 - protein, 698 aa, Sorghum bicolor
  misc_feature: Ceres ANNOT ID no. 6114354
  misc_feature (109)..(591): Pfam Id: AMP-binding Pfam Desc: AMP-binding enzyme
  misc_feature (1)..(698): NCBI GI: 62701932 NCBI Desc: probable acyl-coa synthetase, 62297-59022 [imported] - arabidopsis thaliana [oryza sativa (japonica cultivar-group)]
  misc_feature (1)..(698): NCBI GI: 12049721 NCBI Desc: long chain acyl-coa synthetase [brassica napus]
  misc_feature (6)..(698): NCBI GI: 15450593 NCBI Desc: t23o15.3/t23o15.3 [arabidopsis thaliana]
  misc_feature (162)..(698): NCBI GI: 140052256 NCBI Desc: amp-dependent synthetase and ligase; lipocalin [medicago truncatula]
  misc_feature (336)..(698): NCBI GI: 115484385 NCBI Desc: os11g0169800 [oryza sativa (japonica cultivar-group)]
MNPYFVGILVPVAVSLLLRKRRKAERKRGVPVEVGGEPGYAVRNYRFEQPVETHWEGVSTLAELFEQSCKEYVNMPLLGTRKLISRETEAAPGGRSFEKLHLGEYEWKCYAECFKSVCSFSSGLIRVGHEKNERVAIFAETRAEWQIALQACFRQNITVVTIYASLGEEALCHSLNETEVTTVVCGQKELKKLIDISGQLDTVKHVVYINEEGISAEVSLAQNCTSWKVESFEEVIRLGSESPVEANMPLPSDVAVIMYTSGSTGLPKGVMMTHRNVLATLSAVMTIVPALGSKDIYLAYLPLAHILELAAEALMAAVGASIGYGSPLTLTDTSNKIKKGTLGDASALKPTLMTAVPAILDRVRDGVRKKVDAKGGIAKQLFDIAYNRRLAAINGSWLGAWGLEKHLWDTLVFGKVRAILGGKIRFVLSGGAPLSGDTQRFINICLGAPIGQGYGLTETCAGGTFSEYDDTSVGRVGAPLPCSFIKLIDWPEGGYLTTDLPMPRGEIVIGGPNVTKGYFKNEAKTNEVYKDDEKGMRWFYSGDIGRFHPDGCLEIIDRKKDIVKLQHGEYVSLGKVEAALIVSPYVENIMIHADPFHNYCVALVVAAHIELESWASQQGIKYSDFSDLCQKQEAVKEVLGSLAKAAKQARLEKFEIPAKIKLIPEPWTPESGLVTAALKLKREVIRKTYENDLAQLYA

SEQ ID NO: 10647 - DNA, 1269 bp, Sorghum bicolor
  misc_feature: Ceres ANNOT ID no. 6114358
  misc_feature: Encodes the peptide sequence at SEQ ID NO 10648
atgccccttcctcctctcctccccgccatggcttccaccttctcccccacttccgccgcgagggccctcctcccggcctccacctcccgcccactcttcctcgccgcagcttcctcaggtcgcattcaaccatccaggaaggggctggacttccgccgcggccggttcaccgtctgcaatgtcgccgcccccaccgccgccgagcaggaggcgacggcgtcgtcggccgcgaaggagagccagcggcccgtgtacccgttcgcggccatcgtggggcaggacgagatgaagctctgcctgctgctcaacgtcatcgaccccaagatcggcggcgtgatgatcatgggcgacaggggcacgggcaagtccaccaccgtgcgctccctcgtcgacctgctcccggacatccgcgtcgtcgtcggcgaccccttcaactccgacccggacgacccagaggtgatggggcctgaggtccgcgagcgggtgctgcgtggggacgccggcctccctgtcaccaccgccaagatcaccatggtcgacctgcccctcggcgccaccgaggaccgcgtctgtggcaccatcgacatcgagaaggcgctcaccgagggcgttaaggcgttcgagcccggcttgctcgccaaggccaacaggggcatactgtacgtcgacgaggtcaacctgctggatgaccatctcgtcgatgtgctgctggattccgctgcgtcggggtggaacacggtggagagggagggtatctccatatcccaccctgctcgcttcatcctcatcggctctggtaacccggaggaaggggagctcaggccacagctgctggaccggttcgggatgcacgcacaggttggtaccgtcagggatgccgagctcagggtgaagatcgtggaggagagagctcgtttcgacagggatccaaagacgttccgtgagtcgtacaatgaggagcaggagaagctccagcagcagatatcatctgcacggagtaaccttggcgctgtgcagattgaccatgacctccgtgtcaagatatccaaggtgtgctctgagctgaatgttgatggactcagaggcgacattgtgactaacagggctgccaaggctctggctgcgttgaaaggaagggacagcgtcactgtggaggatattgctactgtcattccaaactgcttgaggcatcggctccggaaggatccgcttgaatccattgactcgggtttgcttgtcattgagaagttttatgaagtctttagctag

SEQ ID NO: 10648 - protein, 422 aa, Sorghum bicolor
  misc_feature: Ceres ANNOT ID no. 6114358
  misc_feature (87)..(295): Pfam Id: Mg_chelatase Pfam Desc: Magnesium chelatase, subunit ChlI
  misc_feature (10)..(422): NCBI GI: 70905055 NCBI Desc: magnesium chelatase subunit i precursor [zea mays]
  misc_feature (9)..(421): NCBI GI: 104345511 NCBI Desc: magnesium chelatase 40-kda subunit [hordeum vulgare subsp. vulgare]
  misc_feature (10)..(422): NCBI GI: 3334150 NCBI Desc: magnesium-chelatase subunit chli, chloroplast precursor (mg-protoporphyrin ix chelatase)
  misc_feature (10)..(422): NCBI GI: 11493393 NCBI Desc: sulfur [nicotiana tabacum]
  misc_feature (10)..(422): NCBI GI: 3334149 NCBI Desc: magnesium-chelatase subunit chli, chloroplast precursor (mg-protoporphyrin ix chelatase)
  misc_feature (10)..(422): SWISSPROT Homolog: EC 6.6.1.1 Magnesium-chelatase subunit chlI, chloroplast precursor
MPLPPLLPAMASTFSPTSAARALLPASTSRPLFLAAASSGRIQPSRKGLDFRRGRFTVCNVAAPTAAEQEATASSAAKESQRPVYPFAAIVGQDEMKLCLLLNVIDPKIGGVMIMGDRGTGKSTTVRSLVDLLPDIRVVVGDPFNSDPDDPEVMGPEVRERVLRGDAGLPVTTAKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRESYNEEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 10649 - DNA, 1047 bp, Sorghum bicolor
  misc_feature: Ceres ANNOT ID no. 6114399
  misc_feature: Encodes the peptide sequence at SEQ ID NO 10650
atggtggagcaggggagaaaggaggaagaagaagaagggtcgtcgaggtggagggtattccgggcggctgatgatgcctgctcgcctgtgcgcaccctggtggcactgtcgctgtggctgggagccatccacttcaacctcgttcttgtcatcgcctgcatcttcgtcttcccagctcgtgtcgccgcggtgttatgcacgcagttcttctttatgttccttccggtcagtgccacagacaaatggggccgctccatcgcgaggttcatatgcaaacatgggctcagctacttccccgttactctgcatgtggagcattaccaagcctttgatcctaaaacagcttacgtatttggttacgagccgcactcaataatgccactcggtgcatggacattgatggacctcgtttcatttatgcctctaccaaagatgaagatcataacgggtagcacggcactctacgtcccgttcatgagacaaatatggacgtggcttggctcagttcctgcaacgagagagaaatttttctcccaccttgccgatggctacagctgtgttgtttgtccgggcgggctacgggagacacaccatatgaattctggctcggaggttgctttcattaagtcaagaaaaggttttgtgaggatggctatacaaaatggttcccctttagtgcccgttttctgctttggacagagcgatacatacaggtggtggaatccacatatcaaatcactatcacggattgcaacagcattgaaattcattcctgtgatctattgggggaagtttgggatgccaataccattcccttcccacatgcatgtttttgttggaaaaccaatccttgttgagaaaaatggtcaacctacgactgatgagtccaaaattgtatatatcatgcatatatgcaataatgcaatgcagtgctgctggctgcaggtaaatgaagtccatcgacaatttgtcatcgcactgcaagagctattcgagaaaaacaaagctaaagcaggataccctagcctccatctgcaaatcatgtga

SEQ ID NO: 10650 - protein, 348 aa, Sorghum bicolor
  misc_feature: Ceres ANNOT ID no. 6114399
  misc_feature (54)..(346): Pfam Id: DAGAT Pfam Desc: Diacylglycerol acyltransferase
  misc_feature (8)..(295): NCBI GI: 62825813 NCBI Desc: diacylglycerol acyltransferase [ricinus communis]
  misc_feature (72)..(214): NCBI GI: 140066983 NCBI Desc: diacylglycerol acyltransferase [medicago truncatula]
  misc_feature (31)..(295): NCBI GI: 86279638 NCBI Desc: type 2 diacylglycerol acyltransferase [vernicia fordii]
  misc_feature (9)..(306): NCBI GI: 37183394 NCBI Desc: mono- or diacylglycerol acyltransferase [spirodela polyrrhiza]
  misc_feature (118)..(295): NCBI GI: 140066981 NCBI Desc: diacylglycerol acyltransferase [medicago truncatula]
MVEQGRKEEEEEGSSRWRVFRAADDACSPVRTLVALSLWLGAIHFNLVLVIACIFVFPARVAAVLCTQFFFMFLPVSATDKWGRSIARFICKHGLSYFPVTLHVEHYQAFDPKTAYVFGYEPHSIMPLGAWTLMDLVSFMPLPKMKIITGSTALYVPFMRQIWTWLGSVPATREKFFSHLADGYSCVVCPGGLRETHHMNSGSEVAFIKSRKGFVRMAIQNGSPLVPVFCFGQSDTYRWWNPHIKSLSRIATALKFIPVIYWGKFGMPIPFPSHMHVFVGKPILVEKNGQPTTDESKIVYIMHICNNAMQCCWLQVNEVHRQFVIALQELFEKNKAKAGYPSLHLQIM

SEQ ID NO: 10651 - DNA, 678 bp, Sorghum bicolor
  misc_feature: Ceres ANNOT ID no. 6114404
  misc_feature: Encodes the peptide sequence at SEQ ID NO 10652
atggcttctctcacaggtccatggcttcatctcctagtgcttcttattgtagccataggcacgttcctgctgcatgcccccgcggcggccggcggtggctggaacgacgatcccaccgccgggttcgagaaggtggagctctccgacggcgacttcgaggtgcagagcccctacaacgtgccggagagccagcggttccagtaccggaacggcatccggacgttctgggtgtacaagaacgacaagcccttcaacaccgccacccacactaacccccgttccgaagtgaaggtcaagtcgtcaggggtgtggcagttcgagggctacgggtacgtgccgtcggggacctccggcgtgtcggtgatgcagatccacgacgggaaaggccaggcgcactccacggtgctcatgctgcacgtctacgacggcgtcctgcgctactacagcggcgcggccatagaggccggcatctacgaccggtggttccgcctcaacgtggtgcacgacgtcggcgcgtcgacggtcaccgtgtacgtcgacggcagccgcaagttcggcgccagcgtgattcccagcgaatccttctacttcaagttcggagtgtacatgcagcaccacgaccagtctagctgcatggagtcgcgatggaccaacgtcacgctctatactaagcactaa

SEQ ID NO: 10652 - protein, 225 aa, Sorghum bicolor
  misc_feature: Ceres ANNOT ID no. 6114404
  misc_feature (45)..(223): Pfam Id: Alginate_lyase2 Pfam Desc: Alginate lyase
  misc_feature (26)..(224): NCBI GI: 77553101 NCBI Desc: kda extracellular calmodulin-binding protein [oryza sativa (japonica cultivar-group)]
  misc_feature (7)..(224): NCBI GI: 92873114 NCBI Desc: 24 kda protein sc24 [medicago truncatula]
  misc_feature (37)..(224): NCBI GI: 24745940 NCBI Desc: citrate binding protein [solanum tuberosum]
  misc_feature (37)..(225): NCBI GI: 15072335 NCBI Desc: 21 kda extracellular calmodulin-binding protein [angelica dahurica]
  misc_feature (37)..(222): NCBI GI: 1177405 NCBI Desc: citrate binding protein [hevea brasiliensis]
MASLTGPWLHLLVLLIVAIGTFLLHAPAAAGGGWNDDPTAGFEKVELSDGDFEVQSPYNVPESQRFQYRNGIRTFWVYKNDKPFNTATHTNPRSEVKVKSSGVWQFEGYGYVPSGTSGVSVMQIHDGKGQAHSTVLMLHVYDGVLRYYSGAAIEAGIYDRWFRLNVVHDVGASTVTVYVDGSRKFGASVIPSESFYFKFGVYMQHHDQSSCMESRWTNVTLYTKH

SEQ ID NO: 10653 - DNA, 588 bp, Sorghum bicolor
  misc_feature: Ceres ANNOT ID no. 6114422
  misc_feature: Encodes the peptide sequence at SEQ ID NO 10654
atggctcctgcttcctcctcccagccatggcctttactcctcctgttcatcgtcttggtctcgtgctgcagccagatctccgccggcgttgacccaaccctcggcttcatcgccgtcaacctcaccgaggaccggttcaagctggaccacccgtacgacctgccgccggagcagcgctacgagttcctcgccggcgtgcggcggatgtgggtgtactccaccgacaagcccttgagctccggcagccccaccaggccacgctccgagatcttcctaaacgtgttcggcgcgtcggggaggaacacgacgctgatgctgcacgtctacggcggccggctcatgtactaccacgacgaggcgcgcgtcgtggacgccgacatctacgaccgctggttcaggctcaacgtggtgcacgacgtcggcgcggaggtgctcaccgtgttcgtcgacggcgaggagcggctcgccgtcgccggacacggcgggtaccgccactacttcaagttcggggtgtacacgcagacgaacgcctcgtactatatggagtcccggtggagggacgtcaaggtctacaccaagctcggttga

SEQ ID NO: 10654 - protein, 195 aa, Sorghum bicolor
  misc_feature: Ceres ANNOT ID no. 6114422
  misc_feature (39)..(192): Pfam Id: Alginate_lyase2 Pfam Desc: Alginate lyase
  misc_feature (92)..(193): NCBI GI: 24745940 NCBI Desc: citrate binding protein [solanum tuberosum]
  misc_feature (92)..(191): NCBI GI: 1177405 NCBI Desc: citrate binding protein [hevea brasiliensis]
  misc_feature (94)..(193): NCBI GI: 45384963 NCBI Desc: 24 kda seed coat protein [glycine max]
  misc_feature (60)..(193): NCBI GI: 92873114 NCBI Desc: 24 kda protein sc24 [medicago truncatula]
  misc_feature (60)..(193): NCBI GI: 15072335 NCBI Desc: 21 kda extracellular calmodulin-binding protein [angelica dahurica]
MAPASSSQPWPLLLLFIVLVSCCSQISAGVDPTLGFIAVNLTEDRFKLDHPYDLPPEQRYEFLAGVRRMWVYSTDKPLSSGSPTRPRSEIFLNVFGASGRNTTLMLHVYGGRLMYYHDEARVVDADIYDRWFRLNVVHDVGAEVLTVFVDGEERLAVAGHGGYRHYFKFGVYTQTNASYYMESRWRDVKVYTKLG

SEQ ID NO: 10655 - DNA, 2262 bp, Sorghum bicolor
  misc_feature: Ceres ANNOT ID no. 6114427
  misc_feature: Encodes the peptide sequence at SEQ ID NO 10656
atgcatcgtgttgggagtgctggtaacacagctggctcgactcgaccgagaaaggagaagcggttcacatatgtgctcaatgatgctgatgataaaaagcattgtgcagggatcaattgcttggcttatctaaatggttccacatttagtacaagtgactatctttttagcgggagtcgtgatggtaccttgaaaagatgggaattaaataatggggatgcaagcttctcagcaacttttgagtctcatgttgattgggttaatgatgccattatagttggagaaaagcttgtttcctgttcctcagacaccacaataaaggtctggaattgcttctctgacggtgcctgtaccaggactctccgccagcattctgattacgtgatttgtcttgctgctgctgagaagaatagcaatattgtagcctctggtggccttggtggtgaggttttcgtttgggaccttgatgctgctcttgctcctgtagcaaaatctgtggatgcaaaagaggatgaggttcctaatggaaactctgggcctgctttgtcaacaatgtgcagcgcaaattctagtagcaatattgcttcctctaatggtcaatcacatgggtacaatccaattgccgccaaaggacacaaagactcagtttatgcactggctatgaatgatacgggaacacttcttctctctggtggcactgaaaaggttgtccgagtgtgggatccgagaacaggttcaaaaaacatgaaattgagagggcacactgacaatatcagagccttacttgttgattctacagggaggtattgcctatcaggatcatctgattccatgataagactatgggacctaggacagcaacgttgtgttcattcttatgctgtgcatactgattcagtttgggcgcttgcaagcactccttcatttggtcatgtctacagtggtggaagagaccaatctgtatatttaacagatttgtccacaagagagagtgttttactgtgcacaaatgaataccctattctacagttgtctctgcaagatgacacaatatgggtggcaacaactgattcttctgtttatggatggccagctgaagggcgcacaccccaaaaggtcttccaaaagggtggctcattcttagctgggaatttgtcattctcaagggcaagagcatctttagaaggatcagcacctgttcctgtatacaaagaaccatcatttgttatcccaggagttccagcaataattcaacatgagataatgaataataggaggcatgtactgacaaaggacaccactggttcagtcaaattgtgggagatcacccgcggtgctgttattgaagactttggcaaggtttctttcgaagataagaaaaaggagttatttgagatggtaagcatacctgcttggttcaccatggatgctcgattaggatgcttgtctgtccacctggatactccacaatgcttttctgcagaaatatatgcggttgatctaaatgttgctggagcacaagaagatctcaagattaatttggctcaagagacccttcggggtttgctagttcattggagtaaaaggaagcagaaatctagttcgcacagcttgcctaatggtgatagttcaatagggaaagatgttccgtcaaaagactcaccccggtcaagatctgaggtggatgatgccactgaaaatcatgcaactcatgtgcttccatcatttgagttttctacagtttcacctccctcaattatcacggaaggttctagtggagggccttggagaaagagaattaccgatttggatggaactgagggtgatcttccatggtggtgtgtggactgtgttactcacaatcgatatccaaaggagaatacaaaatgtggcttttatttacatcctgctgaaggctcgcctgcgccaaacataactcaagggaagcttagtgctccacggatattgcgaattcataaggtagctaactatgtggttgagaaacttgtgcttgacaaaccggatggaggctctgatagcgcgtttgttatgggattgagttctgctcaatcgcagctctcagcgctagatagttcttcgcggcttggactaaagtcatggcaaaaaacaaagccatgtattgagatattgtgcaataaccaggttctatcaccagagatgagtttggctacagtgcgaacatatatatggaagaagccagaagatttgattcttcattatagagtggtccagtcgagatga

SEQ ID NO: 10656 - protein, 753 aa, Sorghum bicolor
  misc_feature: Ceres ANNOT ID no. 6114427
  misc_feature (74)..(110): Pfam Id: WD40 Pfam Desc: WD domain, G-beta repeat
  misc_feature (115)..(154): Pfam Id: WD40 Pfam Desc: WD domain, G-beta repeat
  misc_feature (203)..(241): Pfam Id: WD40 Pfam Desc: WD domain, G-beta repeat
  misc_feature (245)..(283): Pfam Id: WD40 Pfam Desc: WD domain, G-beta repeat
  misc_feature (287)..(325): Pfam Id: WD40 Pfam Desc: WD domain, G-beta repeat
  misc_feature (454)..(753): NCBI GI: 140043359 NCBI Desc: aldehyde dehydrogenase [medicago truncatula]
  misc_feature (96)..(528): NCBI GI: 13879396 NCBI Desc: 8430408h12rik protein [mus musculus]
  misc_feature (96)..(528): NCBI GI: 20521920 NCBI Desc: kiaa1449 protein [homo sapiens]
  misc_feature (96)..(528): NCBI GI: 119584954 NCBI Desc: wd repeat domain 48, isoform cra_c [homo sapiens]
  misc_feature (96)..(528): NCBI GI: 39104513 NCBI Desc: mkiaa1449 protein [mus musculus]
  misc_feature: The sequence is a functional homolog of SEQ ID NO. 502 in the 11/188,298 US application
MHRVGSAGNTAGSTRPRKEKRFTYVLNDADDKKHCAGINCLAYLNGSTFSTSDYLFSGSRDGTLKRWELNNGDASFSATFESHVDWVNDAIIVGEKLVSCSSDTTIKVWNCFSDGACTRTLRQHSDYVICLAAAEKNSNIVASGGLGGEVFVWDLDAALAPVAKSVDAKEDEVPNGNSGPALSTMCSANSSSNIASSNGQSHGYNPIAAKGHKDSVYALAMNDTGTLLLSGGTEKVVRVWDPRTGSKNMKLRGHTDNIRALLVDSTGRYCLSGSSDSMIRLWDLGQQRCVHSYAVHTDSVWALASTPSFGHVYSGGRDQSVYLTDLSTRESVLLCTNEYPILQLSLQDDTIWVATTDSSVYGWPAEGRTPQKVFQKGGSFLAGNLSFSRARASLEGSAPVPVYKEPSFVIPGVPAIIQHEIMNNRRHVLTKDTTGSVKLWEITRGAVIEDFGKVSFEDKKKELFEMVSIPAWFTMDARLGCLSVHLDTPQCFSAEIYAVDLNVAGAQEDLKINLAQETLRGLLVHWSKRKQKSSSHSLPNGDSSIGKDVPSKDSPRSRSEVDDATENHATHVLPSFEFSTVSPPSIITEGSSGGPWRKRITDLDGTEGDLPWWCVDCVTHNRYPKENTKCGFYLHPAEGSPAPNITQGKLSAPRILRIHKVANYVVEKLVLDKPDGGSDSAFVMGLSSAQSQLSALDSSSRLGLKSWQKTKPCIEILCNNQVLSPEMSLATVRTYIWKKPEDLILHYRVVQSR

SEQ ID NO: 10657 - DNA, 1314 bp, Sorghum bicolor
  misc_feature: Ceres ANNOT ID no. 6114433
  misc_feature: Encodes the peptide sequence at SEQ ID NO 10658
atgtctttccgcagcattgtgcgtgatgtaagggatggctttgggagcttgtctcgaagagggtttgaggtgaagattctgggccaccgcagagggagatctcatggtgctgtccatgagctgcatgatccagccccagtgatccagagcagctgttgggctaatttgcccccggaattgcttcgggatgtgattgagaggttggaagccagtgaagccacttggcctaacaggaagaatgtagtttcttgtgcagctgtttgtcgaacctggagagagatctgcaaagagattgttaagaatccagagttttctggaaaaatcacttttcctgtgtccttaaagcagcctgggcctcgagatgtaaccatccagtgcttcatcaaaagggataaatctactcaaacttactacttgtatctgtgccttagcaccgctgtgcttgttgaaagtggcaagttcctcctatgtgcgaaacgaacctcccgtccaacttgtacagaatatacaatatttatgaattctgaaaatttatctaggtcaagcaaaatgtacattggaaagctgaggtcaaatctcctcggcacaaagtttgcaatatatgatacccagcctccatgcaatacatcacaaccagggaaaacaagccgtaggttctactccaggaaggtgtcgccaaaggtctcttccagaacctacaacatagcacaggtttcatatgagctgaatgtcttgggtactaggggccctaggcggatgaactgtgttatgcactccatccctgcctcatgccttgaggctggtggcaccgttccatgccagccggacagcatccttgctcgctccattgatgagtcattcggcagcatttctttctccaagtcatctgttgtggaccattctatgcgtttcagcagcacaagattctctgaaatctcaatgagcagccacacgattggagacgcggcattgggagacaatgacgagtgcaaggacaggccattgattctccgaaacaaggccccaaggtggcatgagcagctgcagtgctggtgcctcaattttaagggcagagtgacagtcgcatctgtcaagaacttccagcttgttgccgctacgcagccctctgctggagcaccaaccctatcatcacaggctaccccagtgccaccgcctgagcatgaaaaggtgatcctgcaatttgggaaggtggccaaggatatgttcacaatggactaccgttacccactgtcagccttccaggcctttgcaatctgcttgagcagctttgacaccaagctggcctgtgaataa

SEQ ID NO: 10658 - protein, 437 aa, Sorghum bicolor
  misc_feature: Ceres ANNOT ID no. 6114433
  misc_feature (117)..(431): Pfam Id: Tub Pfam Desc: Tub family
  misc_feature (51)..(106): Pfam Id: F-box Pfam Desc: F-box domain
  misc_feature (28)..(437): NCBI GI: 32480039 NCBI Desc: osjnba0039k24.2 [oryza sativa (japonica cultivar-group)]
  misc_feature (28)..(437): NCBI GI: 90399022 NCBI Desc: h0701f11.8 [oryza sativa (indica cultivar-group)]
  misc_feature (28)..(437): NCBI GI: 5777631 NCBI Desc: caa303719.1 protein [oryza sativa]
  misc_feature (1)..(376): NCBI GI: 7635492 NCBI Desc: tubby-like protein [cicer arietinum]
  misc_feature (116)..(437): NCBI GI: 115484341 NCBI Desc: os11g0163600 [oryza sativa (japonica cultivar-group)]
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSRRGFEVKILGHRRGRSHGAVHELHDPAPVIQSSCWANLPPELLRDVIERLEASEATWPNRKNVVSCAAVCRTWREICKEIVKNPEFSGKITFPVSLKQPGPRDVTIQCFIKRDKSTQTYYLYLCLSTAVLVESGKFLLCAKRTSRPTCTEYTIFMNSENLSRSSKMYIGKLRSNLLGTKFAIYDTQPPCNTSQPGKTSRRFYSRKVSPKVSSRTYNIAQVSYELNVLGTRGPRRMNCVMHSIPASCLEAGGTVPCQPDSILARSIDESFGSISFSKSSVVDHSMRFSSTRFSEISMSSHTIGDAALGDNDECKDRPLILRNKAPRWHEQLQCWCLNFKGRVTVASVKNFQLVAATQPSAGAPTLSSQATPVPPPEHEKVILQFGKVAKDMFTMDYRYPLSAFQAFAICLSSFDTKLACE

SEQ ID NO: 10659 - DNA, 639 bp, Sorghum bicolor
  misc_feature: Ceres ANNOT ID no. 6114495
  misc_feature: Encodes the peptide sequence at SEQ ID NO 10660
atgccgcaaggcaggagcgcgcgagggccgtgctgcgcaggattcagtgtgctcctcaccgccggcgtcgtgttgctcatctattgggccatcttccagccccaccacatccgcgccaccgttgactccgccgtcctctccaacctcaccgtctccaacgcctcctcatccgcggcggcggtctcctacgacttcaccgtcagcctccggctctacaaccccagcgtccgcgtcgacatctactacgacgccatcgacgcccagctccgcttccgcgacgccgtcgtcggcccggccgccaacgacacctccccgtccgtgttctaccagcgcaggaagaccagcgaggtcgtcaagatggagttcgactactggaggagccccggcagcggcggcggcggcggcgtcaccgtcggcagcgacgtcgccggggagctggtgaaggagaccaggagcggggggccggtgagcttggagctggacgtggacgtgcgcgtgaggtacgtgttcaagatgttcaagctgcgccagaagccgaggattcggtgctcgctcagcattccggtcaagacggagggccggcaccatggcttcggtggcgctgctgcctccggcgaccggtgcagtgtcaagtactga

SEQ ID NO: 10660 - protein, 212 aa, Sorghum bicolor
  misc_feature: Ceres ANNOT ID no. 6114495
  misc_feature (29)..(183): Pfam Id: Hin1 Pfam Desc: Harpin-induced protein 1 (Hin1)
  misc_feature (15)..(194): NCBI GI: 47971182 NCBI Desc: harpin inducing protein 1-like 9 [nicotiana tabacum]
  misc_feature (15)..(194): NCBI GI: 47971184 NCBI Desc: harpin inducing protein 1-like 18 [nicotiana tabacum]
  misc_feature (15)..(194): NCBI GI: 42557351 NCBI Desc: hin1 like protein [capsicum chinense]
  misc_feature (11)..(172): NCBI GI: 2801538 NCBI Desc: harpin induced gene 1 homolog [oryza sativa]
  misc_feature (15)..(194): NCBI GI: 7417006 NCBI Desc: harpin inducing protein [nicotiana tabacum]
MPQGRSARGPCCAGFSVLLTAGVVLLIYWAIFQPHHIRATVDSAVLSNLTVSNASSSAAAVSYDFTVSLRLYNPSVRVDIYYDAIDAQLRFRDAVVGPAANDTSPSVFYQRRKTSEVVKMEFDYWRSPGSGGGGGVTVGSDVAGELVKETRSGGPVSLELDVDVRVRYVFKMFKLRQKPRIRCSLSIPVKTEGRHHGFGGAAASGDRCSVKY

SEQ ID NO: 10661 - DNA, 1278 bp, Sorghum bicolor
  misc_feature: Ceres ANNOT ID no. 6114516
  misc_feature: Encodes the peptide sequence at SEQ ID NO 10662
atgggcaactcgcaggcttcgccggcgtccgcctccagctcccgcttcgtcatggcctcgagggccttctcgaagcaggagctggacggcctccgcggcctattcacctccctcgcggcgcagtcgcagaccagcggccgcgccatctcacgctccgtcttcctcgagtactatggggtgcgggggccattaggcgacaggctgttccagttggtggcgaaggagagtggcggcagcgatggggtcacgttcgaggatttgatcatctccaaagcaacatatggaaggggaactcgagatgaggttgatgaattcatttatcaactatgtgatgtcacaggagatggtgccttaacaaggtctgatttggaatctgtcttggcatccgttcatgaaactgtatttgcagtgaagaaggaagtcgtggaaggttccaacaacagaccatttgaagcattcctcaactcggcagtactttcagaggatgctgaagcggtctcagagaagtctatgtcattatcagactttaggaacctgtgcattctcttgccatcattgaggaagttccttggaaatttgttgatgccccctgattcaggtagaccagggtttgaagtaccactgcttcattatcctgaaaacatctccactgatttgctgcttctaaataaagagtatgcctggcatattggaggaggcttttcccaaaatgaggtgcaagagtggaagcttttatatcacagttctcttcatggacaaagcttcaacacttttttaggcaaagtaacgaatggagatgcccagactgttctgattgttaaagatagagaaggatcaatttatggtggatatgcatcacagccttgggaaaggcacagtgatttttatggtgacatgaagacattcctcttcaaattatatcctcaagcatccattttccgccctactggagcaaacaggaatttgcaatggtgtgctataaacttcagctctgagaacatacccaatggtattggatttggagggcagccacatcatttcggactctttttatctgcaaatttcgatcaagggcactcatttacttgtagcacgtttaccagccctcccctttcaaagacaaataggttcaggccagaagtcattgaatgttggggtatacaaatgagaggagcacaagatgaaaaactggagctagtcaaggggacagtcctcgagagattcaaggaggaccggaacatgctgaagatggttggtttggcaaatgcgagtgattga

SEQ ID NO: 10662 - protein, 425 aa, Sorghum bicolor
  misc_feature: Ceres ANNOT ID no. 6114516
  misc_feature (244)..(388): Pfam Id: TLD Pfam Desc: TLD
  misc_feature (1)..(419): NCBI GI: 94732173 NCBI Desc: novel protein [danio rerio]
  misc_feature (238)..(425): NCBI GI: 50416200 NCBI Desc: mgc81149 protein [xenopus laevis]
  misc_feature (229)..(425): NCBI GI: 38174536 NCBI Desc: kiaa1609 protein [homo sapiens]
  misc_feature (229)..(425): NCBI GI: 23270886 NCBI Desc: kiaa1609 protein [homo sapiens]
  misc_feature (229)..(425): NCBI GI: 10047293 NCBI Desc: kiaa1609 protein [homo sapiens]
MGNSQASPASASSSRFVMASRAFSKQELDGLRGLFTSLAAQSQTSGRAISRSVFLEYYGVRGPLGDRLFQLVAKESGGSDGVTFEDLIISKATYGRGTRDEVDEFIYQLCDVTGDGALTRSDLESVLASVHETVFAVKKEVVEGSNNRPFEAFLNSAVLSEDAEAVSEKSMSLSDFRNLCILLPSLRKFLGNLLMPPDSGRPGFEVPLLHYPENISTDLLLLNKEYAWHIGGGFSQNEVQEWKLLYHSSLHGQSFNTFLGKVTNGDAQTVLIVKDREGSIYGGYASQPWERHSDFYGDMKTFLFKLYPQASIFRPTGANRNLQWCAINFSSENIPNGIGFGGQPHHFGLFLSANFDQGHSFTCSTFTSPPLSKTNRFRPEVIECWGIQMRGAQDEKLELVKGTVLERFKEDRNMLKMVGLANASD

SEQ ID NO: 10663 - DNA, 813 bp, Sorghum bicolor
  misc_feature: Ceres ANNOT ID no. 6114531
  misc_feature: Encodes the peptide sequence at SEQ ID NO 10664
atggctatgcaccatctcgcccaggggcacccccaggcgtggccgtgggggatggccatgtacaccaacctgcactaccaccagcaccaccaccagtacgagagggagcacctgttcgagaagccgctcacgcccagcgacgtgggaaagctcaaccgccttgtgatccccaagcagcacgcggagaggtacttcccgctcggcggcaacggggccggagacggcagcgacaagggcctgctgctggccttcgaggacgaggccggcaagccgtggcggttccggtactcgtactggaccagcagccagagctacgtgctcaccaaggggtggagccgctacgtcaaggagaagcgcctcgacgccggcgacgtcgtgcgcttcgagcgcgtgcgcggtggcctcggcaccggtgaccgcctcttcatctgctgcaggcgtcggggcgagagcgcggcacccacaccgacaccgccactgcccgtgcgcgctccggcacccgcgctgaacgccgccggcgagcagcagccgtggagccccatgtgctacagcacgtcgggatcgtcgtacccgaccagccccgccagcccctacgcctaccacaacgatacgccacacgcaggtgaggcagacgccaagagcagcggcacccctacagcaccgtcgaggaagctccggctgttcggcgtcaacctcgattgcggcccggagccggagccggagccggagacgccgacggcaatgtacagctacatgcaccagagtccctacgcagcagtgtccgccgttcccagttactggggcagttcataa

SEQ ID NO: 10664 - protein, 270 aa, Sorghum bicolor
  misc_feature: Ceres ANNOT ID no. 6114531
  misc_feature (38)..(147): Pfam Id: B3 Pfam Desc: B3 DNA binding domain
  misc_feature (1)..(266): NCBI GI: 62701878 NCBI Desc: similar to probable rav2-like dna binding protein [imported] - arabidopsis thaliana [oryza sativa (japonica cultivar-group)]
  misc_feature (34)..(229): NCBI GI: 50251902 NCBI Desc: rav-like b3 domain dna binding protein-like [oryza sativa (japonica cultivar-group)]
  misc_feature (31)..(153): NCBI GI: 145357701 NCBI Desc: transcription factor [arabidopsis thaliana]
  misc_feature (34)..(196): NCBI GI: 32492293 NCBI Desc: osjnba0088a01.1 [oryza sativa (japonica cultivar-group)]
  misc_feature (34)..(235): NCBI GI: 21618252 NCBI Desc: rav-like protein [arabidopsis thaliana]
  misc_feature: The plant flowers significantly late compared to wild-type.
  misc_feature: The sequence is a functional homolog of SEQ ID NO 1176 in the 10/374,780US patent application
  misc_feature: The sequence is a functional homolog of SEQ ID NO 1177 in the 10/374,780US patent application
  misc_feature: The sequence is a functional homolog of SEQ ID NO 1178 in the 10/374,780US patent application
  misc_feature: The sequence is a functional homolog of SEQ ID NO 1179 in the 10/374,780US patent application
  misc_feature: The sequence is a functional homolog of SEQ ID NO 118 in the 10/666,642US patent application
  misc_feature: The sequence is a functional homolog of SEQ ID NO 1180 in the 10/374,780US patent application
  misc_feature: The sequence is a functional homolog of SEQ ID NO 1181 in the 10/374,780US patent application
  misc_feature: The sequence is a functional homolog of SEQ ID NO 1372 in the 10/412,699US patent application
  misc_feature: The sequence is a functional homolog of SEQ ID NO 1373 in the 10/412,699US patent application
  misc_feature: The sequence is a functional homolog of SEQ ID NO 1374 in the 10/412,699US patent application
  misc_feature: The sequence is a functional homolog of SEQ ID NO 1404 in the 10/666,642US patent application
  misc_feature: The sequence is a functional homolog of SEQ ID NO 20 in the 10/838,616US patent application
  misc_feature: The sequence is a functional homolog of SEQ ID NO 30 in the 10/838,616US patent application
  misc_feature: The sequence is a functional homolog of SEQ ID NO 32 in the 10/838,616US patent application
  misc_feature: The sequence is a functional homolog of SEQ ID NO 34 in the 10/838,616US patent application
  misc_feature: The sequence is a functional homolog of SEQ ID NO 36 in the 10/838,616US patent application
  misc_feature: The sequence is a functional homolog of SEQ ID NO 396 in the 10/666,642US patent application
  misc_feature: The sequence is a functional homolog of SEQ ID NO 42 in the 10/838,616US patent application
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: The sequence is a functional homolog of SEQ ID NO 52 in the 10/838,616US patent application
  misc_feature: The sequence is a functional homolog of SEQ ID NO 53 in the 10/838,616US patent application
  misc_feature: The sequence is a functional homolog of SEQ ID NO 732 in the 11/435,388US patent application
  misc_feature: The sequence is a functional homolog of SEQ ID NO 734 in the 11/435,388US patent application
  misc_feature: The sequence is a functional homolog of SEQ ID NO 736 in the 11/435,388US patent application
  misc_feature: The sequence is a functional homolog of SEQ ID NO 738 in the 11/435,388US patent application
  misc_feature: Useful for making plants with altered Lignin content
  misc_feature: Useful for making plants with altered terpenoid content
  misc_feature: Useful for making plants with modulated flowering time
  misc_feature: Useful for making plants with modulated growth and phenotype characteristics
  misc_feature: Functional homolog of the protein sequence given in SEQ ID NO 13233
  misc_feature: The sequence is a functional homolog of SEQ ID NO 1372 in the 20040045049 US patent application
  misc_feature: The sequence is a functional homolog of SEQ ID NO 1373 in the 20040045049 US patent application
  misc_feature: The sequence is a functional homolog of SEQ ID NO 1374 in the 20040045049 US patent application
  misc_feature: The sequence is a functional homolog of SEQ ID NO 20 in the 20060008874 US patent application
  misc_feature: The sequence is a functional homolog of SEQ ID NO 34 in the 20060008874 US patent application
  misc_feature: The sequence is a functional homolog of SEQ ID NO 36 in the 20060008874 US patent application
  misc_feature: The sequence is a functional homolog of SEQ ID NO 42 in the 20060008874 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
  misc_feature: The sequence is a functional homolog of SEQ ID NO 1180 in the 20060162006 US patent application
  misc_feature: The sequence is a functional homolog of SEQ ID NO 1181 in the 20060162006 US patent application
  misc_feature: The sequence is a functional homolog of SEQ ID NO 118 in the 20070033671 US patent application
  misc_feature: The sequence is a functional homolog of SEQ ID NO 396 in the 20070033671 US patent application
MAMHHLAQGHPQAWPWGMAMYTNLHYHQHHHQYEREHLFEKPLTPSDVGKLNRLVIPKQHAERYFPLGGNGAGDGSDKGLLLAFEDEAGKPWRFRYSYWTSSQSYVLTKGWSRYVKEKRLDAGDVVRFERVRGGLGTGDRLFICCRRRGESAAPTPTPPLPVRAPAPALNAAGEQQPWSPMCYSTSGSSYPTSPASPYAYHNDTPHAGEADAKSSGTPTAPSRKLRLFGVNLDCGPEPEPEPETPTAMYSYMHQSPYAAVSAVPSYWGSS

SEQ ID NO: 10665 - DNA, 1848 bp, Sorghum bicolor
  misc_feature: Ceres ANNOT ID no. 6114535
  misc_feature: Encodes the peptide sequence at SEQ ID NO 10666
atggacaataagtgcttggcgctggcgtcctccgatgccgtccaccaccacccggcaggggtcacagcgaacgccgccatcggcggcacgggtacctcctcctcctcctcctcctcgttcgcgagctggcgcgcgtacgggcgcgcgctagcgcagacgccacgccggctgtcgcgccgcgcgttcgccgcgacggcggccggggaggagatgagccgggtgcgggcgcggtcgggcgccgacatggcgcgcgcgctgcggtggtgggacctcgtcgggctgggcctgggcggcatggtgggcgcgggcgtcttcgtcaccacgggccgcgccgcgcggctgcacgcggggcctggcgtcgtggtgtcctacgccattgccgggctctgcgcgctgctctccgccttctgctacaccgagttcgccgtcgacttgcccgtcgccggcggcgccttcagctacctccgcgtcaccttcggggagctggcggcgttcctgacgggggcgaacctgatcatggagtacgtcttctccaacgccgccgtggcgcgcagcttcacggcgtacctgggcacggcggtgggcgtggacgcgcccagccagtggcggatcaccgtgcacgccctgcccgacggcttcaaccaggtggacctcctcgccgtcgccgtcatcctcctcatcaccgtctgcatctgctacagcaccaaggagagctcggtggtgaacatggtgctgacggcggtgcacgtggcgttcatcctgttcatcatcggcatggggttccggcacggcgacgcgcgcaacctgacgcgccccgcggacccgtcgcgcagccccggcgggttcttcccgcacggcgccgtgggcgtcttcaacggcgccgccatggtgtacctgagctacatcggctacgacgccgtgtccaccatggccgaggaggtgcagcggcccgcgcgcgacatccccgtcggcgtctccggatccgtcgtcgtcgtcaccgtgctctactgcctcatggccgcctccatgtccatgctcctcccctacgacgcgattgacccggaggcgccgttctcgggggcgttcaaggggcgggagcggtgcgcctgggtgtccaacgtcatcggcgccggcgccagcctcggcatcctcacctcgctcatggtggccatgctgggccaggcgcggtacctgtgcgtcatcggccgctccggcgtcatgccggcgtggctcgcccgggtcaacccgcgcaccgccacccccgtcaacgcatccgccttcctcggcgtcttcacggcggcgctggcgctgttcacggagctggacatcctgctcaacctcgtctgcatcggcacgctcttcgtcttctacatggtggccaacgccgtcgtgtaccgccgctacgtcggcggcggcggcgcgagatggccgacgctcgcgttcctcctcgtcttctccctgtccgcgctcgccttcacgctggcgtggaagctggcgccacccgagcggcggggcgtgcgcgcgggcctgctggcggcgtgcgcggcgctggcggtgaccgcggtcgccgcgttccaggcgctggtgccgcaggcgcgcgtccccgagctgtggggcgtccccgggatgccctgggtgcccgccgcgtccgtcttcctcaacgtcttcctgctcgggtcgctcgaccgcccctcgtacgtccgcttcgccatcttttcggccgccgcgctcctcgtgtacgtgctctacagcgtgcacgccagctacgacgccgaggagagcggccggctcgacgtcgacggcggcggcggcggcaaggtgcaggacgaagcgtgcacggtggtgtag

SEQ ID NO: 10666 - protein, 615 aa, Sorghum bicolor
  misc_feature: Ceres ANNOT ID no. 6114535
  misc_feature (90)..(536): Pfam Id: AA_permease Pfam Desc: Amino acid permease
  misc_feature (21)..(611): NCBI GI: 115484255 NCBI Desc: os11g0155500 [oryza sativa (japonica cultivar-group)]
  misc_feature (82)..(614): NCBI GI: 77553705 NCBI Desc: al162972 amino acid transport-like protein [oryza sativa (japonica cultivar-group)]
  misc_feature (82)..(611): NCBI GI: 62701650 NCBI Desc: amino acid transporter-like protein [oryza sativa (japonica cultivar-group)]
  misc_feature (49)..(594): NCBI GI: 38345950 NCBI Desc: osjnbb0038f03.3 [oryza sativa (japonica cultivar-group)]
  misc_feature (39)..(613): NCBI GI: 30102670 NCBI Desc: at4g21120 [arabidopsis thaliana]
MDNKCLALASSDAVHHHPAGVTANAAIGGTGTSSSSSSSFASWRAYGRALAQTPRRLSRRAFAATAAGEEMSRVRARSGADMARALRWWDLVGLGLGGMVGAGVFVTTGRAARLHAGPGVVVSYAIAGLCALLSAFCYTEFAVDLPVAGGAFSYLRVTFGELAAFLTGANLIMEYVFSNAAVARSFTAYLGTAVGVDAPSQWRITVHALPDGFNQVDLLAVAVILLITVCICYSTKESSVVNMVLTAVHVAFILFIIGMGFRHGDARNLTRPADPSRSPGGFFPHGAVGVFNGAAMVYLSYIGYDAVSTMAEEVQRPARDIPVGVSGSVVVVTVLYCLMAASMSMLLPYDAIDPEAPFSGAFKGRERCAWVSNVIGAGASLGILTSLMVAMLGQARYLCVIGRSGVMPAWLARVNPRTATPVNASAFLGVFTAALALFTELDILLNLVCIGTLFVFYMVANAVVYRRYVGGGGARWPTLAFLLVFSLSALAFTLAWKLAPPERRGVRAGLLAACAALAVTAVAAFQALVPQARVPELWGVPGMPWVPAASVFLNVFLLGSLDRPSYVRFAIFSAAALLVYVLYSVHASYDAEESGRLDVDGGGGGKVQDEACTVV

SEQ ID NO: 10667 - DNA, 1113 bp, Sorghum bicolor
  misc_feature: Ceres ANNOT ID no. 6114539
  misc_feature: Encodes the peptide sequence at SEQ ID NO 10668
atgccgccgccgccgccgccgcaggggaacggggggaaggtgaccccgaacctggcgatggacgccgaggccacgcgcatgctcaacctcacagtcctccagcgcctggacccggccgtcgaggacatcctcatcaccgccgcgcacgtcacgctctacgacttcaacatcgacctcaaccagtggagtcgcaaggacgtggaggggtcgctgttcgtcgtcaagaggaactcccagccgaggttccagttcattgtcatgaacaggcgcaacactgataatctggtggaggatctattaagtgattttgaatacgaacttcagccaccatatttgttgtatcgaaatgctgcccaagaagtaaatggtatttggttttataatcaacatgattgtgaagctgtcgcaagcctttttggaagaatactgaatgcttatgcaaaggtgcctccaaaaccaaaagtgcctaccacaaaaagtgagtttgaagaactggaggctgttccgacatctgctgctatagatggcccccttgaacctcagctgtcatcccctgctctagtttcggatgcacctgaagaatcactggttaattacttcaacgctgctgctagcattgcgagtgtatcaagtgcacaaatggctgccagagcacatccatcgactgaggctgtcgcatcttcccatgtgccgctgattgttccatctgctactccaacacatcaaatacctcatcctttagggggttcatcagctccaccacttcccctccatgacacaaatccgcatgccagccattctgcaaatcttctaacaccagctttctttgcatctccatcaccctcttcaacatctgtggcaccaccagcttcatccgtgatgcctacagcaccacctcttcatccaactccaacagctgctcaacgtcctccatatggcactcccttactccaaccttttcccccaccgtctccacctccttccctgacccctgcacacaacaatggacctgttatttcaagggatgaagttaaggacgccctccagagacttgttctgaatgacgagttcatcgatttgatatatcgtgagttgcaaaatgcgcacatgtag

SEQ ID NO: 10668 - protein, 370 aa, Sorghum bicolor
  misc_feature: Ceres ANNOT ID no. 6114539
  misc_feature (21)..(143): Pfam Id: DCP1 Pfam Desc: Dcp1-like decapping family
  misc_feature (12)..(368): NCBI GI: 18390886 NCBI Desc: hydroxyproline-rich glycoprotein family protein [arabidopsis thaliana]
  misc_feature (12)..(368): NCBI GI: 3169719 NCBI Desc: similar to yeast dcp1 [arabidopsis thaliana]
  misc_feature (29)..(368): NCBI GI: 6664305 NCBI Desc: t27g7.7 [arabidopsis thaliana]
  misc_feature (77)..(286): NCBI GI: 115456457 NCBI Desc: os03g0837000 [oryza sativa (japonica cultivar-group)]
  misc_feature (23)..(143): NCBI GI: 47271431 NCBI Desc: mad homolog 4 interacting transcription coactivator 1 [danio rerio]
MPPPPPPQGNGGKVTPNLAMDAEATRMLNLTVLQRLDPAVEDILITAAHVTLYDFNIDLNQWSRKDVEGSLFVVKRNSQPRFQFIVMNRRNTDNLVEDLLSDFEYELQPPYLLYRNAAQEVNGIWFYNQHDCEAVASLFGRILNAYAKVPPKPKVPTTKSEFEELEAVPTSAAIDGPLEPQLSSPALVSDAPEESLVNYFNAAASIASVSSAQMAARAHPSTEAVASSHVPLIVPSATPTHQIPHPLGGSSAPPLPLHDTNPHASHSANLLTPAFFASPSPSSTSVAPPASSVMPTAPPLHPTPTAAQRPPYGTPLLQPFPPPSPPPSLTPAHNNGPVISRDEVKDALQRLVLNDEFIDLIYRELQNAHM

SEQ ID NO: 10669 - DNA, 894 bp, Sorghum bicolor
  misc_feature: Ceres ANNOT ID no. 6114544
  misc_feature: Encodes the peptide sequence at SEQ ID NO 10670
atggcggcaccggtgccggagtgggctaccaaggagccctgcctcatggggatcgacgaggctggccgtggccctgtccttggtcctatggtgtatggatgtatgtactgcgcgcgctcttacaataacactctctccactctcaaattcgcagattcaaagaccttgaaggaggaacaaagagaggagctatttgaaagtttaaaggtcaatagctctattgggtgggaagtggatgttatatgcccaaaggatctatctgctaaaatgttaaagaagtcaaaagttaatctgaatgaaatatcacataactctgccatgggccttgttagaaaagttcttgacatgggaattctactggcagaagtatatatagatacagtgggagatcctgaaaagtatagaatcaagctgacagaaaagtttccaggaatcaaatttgtggttgccaaaaaagctgatagcctttaccctgttgttagtggagcaagtatagttgcaaaggtcactagggacagagccttgcgaaactgggtgtttgatgaaacagctctaagtctgcacatgaaaactggatcaggatatccaggagacccagatactaagcaatggttagaagatcacaagcatccagtatttggcttcccaactttggttcgttttagttggggaacttgtaagcccttcttcaaggatgcagttgaggttacatgggagtctgatgaagtcgatgaagatgggactgacaatggaagcaccaagcgacaagtcaagctttcaagcctaggctttactggtttcaaaaggaagactgaggagattgaatcaagcggaaaaggccgttgcaaattcttccaggctcgcaaacttgagttggtcaggaagttccagtga

SEQ ID NO: 10670 - protein, 297 aa, Sorghum bicolor
  misc_feature: Ceres ANNOT ID no. 6114544
  misc_feature (16)..(226): Pfam Id: RNase_HII Pfam Desc: Ribonuclease HII
  misc_feature (109)..(296): NCBI GI: 145329613 NCBI Desc: ribonuclease hii family protein [arabidopsis thaliana]
  misc_feature (1)..(293): NCBI GI: 37362282 NCBI Desc: ribonuclease h2, large subunit [danio rerio]
  misc_feature (1)..(246): NCBI GI: 119604719 NCBI Desc: ribonuclease h2, large subunit [homo sapiens]
  misc_feature (1)..(246): NCBI GI: 3334761 NCBI Desc: ribonuclease hi large subunit [homo sapiens]
  misc_feature (5)..(296): NCBI GI: 24580635 NCBI Desc: cg13690-pa [drosophila melanogaster]
  misc_feature (6)..(296): SWISSPROT Homolog: EC 3.1.26.4 Ribonuclease H2 subunit A
MAAPVPEWATKEPCLMGIDEAGRGPVLGPMVYGCMYCARSYNNTLSTLKFADSKTLKEEQREELFESLKVNSSIGWEVDVICPKDLSAKMLKKSKVNLNEISHNSAMGLVRKVLDMGILLAEVYIDTVGDPEKYRIKLTEKFPGIKFVVAKKADSLYPVVSGASIVAKVTRDRALRNWVFDETALSLHMKTGSGYPGDPDTKQWLEDHKHPVFGFPTLVRFSWGTCKPFFKDAVEVTWESDEVDEDGTDNGSTKRQVKLSSLGFTGFKRKTEEIESSGKGRCKFFQARKLELVRKFQ

SEQ ID NO: 10671 - DNA, 1341 bp, Sorghum bicolor
  misc_feature: Ceres ANNOT ID no. 6114547
  misc_feature: Encodes the peptide sequence at SEQ ID NO 10672
atggatctcctctccgctgcatatggcgctacctctgacgacgaggatgctgctgacccaccctcctccgtaccggttgccactgggtctgcctccttcgctccacctcccctgaagcggccgcggtgggaatctcaccaatacctccctccaacccactgcttcccgcaacagcccctgctcaacacagtgacgccgctagcatctccatccagcggcaggtatgtttccaagagggagcgtgctctcctagcttcatcgcaggtgcatgtagaatctggatcacccctgtctccggtgacgagagcggaggtttattgtgcagttggctctatcaacaatacaaatctacgagctgacattttgcattccttgcaatgccaaccaaagcctggaccaagcacaagtttccctttgaagctctcagtttgtttgaagggtcacactaaggcaatcaactgtgtagattggtcaccgagtcatgggcatcttcttgcttctgctggaatggatcacaaggttcatgtatggaacgtatgggacaaagggaatactacagctcgtgttttgaaacatcacactgctgctgtaaaggatgtaaggtggtcccttcataggccctttttactttctggagggcttgattgttccttacagctagttgatgttgttgagggaaaagtaatgaaagtattcaaggatgatcaagctgtggaggttatcaagttcaatccaagcaaccctgatctcttcctatctggtgggtccaagggttcccttagactttgggatattcgatgtggtctggtaacaaaagaatttcaaagaagccttggaaccatccttgacattgacttcagtgctgatgggagacaatttatctcttcaactgacacaaccagaagcaatattagtgagaacactatagttgtttgggatgtctcgcgacaagttcctttatctaaccaggtttatactgaagcattcacatgcccgtgtgtaagataccacccacgtgaagcatcttttgttgcacaatccaatgggaactacattgctattttttcagcaaggccacccttcaagctgaacaagtacatgcggtttgaaggacatggagtgtggggtttccctgtgaagtgcaacttttccctgagcggaagagaacttgcatctggttcatctgatggatgtatctacttttatgattacaagtcggcaaggcttttaaggaaaatagaagccttcaaagaagcatgcactgatgttgtgtaccacccagtcatgcctaatgtgattgcttcttgtagctggtctggtgaaatatctgtctttgagtga

SEQ ID NO: 10672 - protein, 446 aa, Sorghum bicolor
  misc_feature: Ceres ANNOT ID no. 6114547
  misc_feature (139)..(178): Pfam Id: WD40 Pfam Desc: WD domain, G-beta repeat
  misc_feature (184)..(222): Pfam Id: WD40 Pfam Desc: WD domain, G-beta repeat
  misc_feature (226)..(264): Pfam Id: WD40 Pfam Desc: WD domain, G-beta repeat
  misc_feature (1)..(446): NCBI GI: 42568531 NCBI Desc: wd-40 repeat family protein [arabidopsis thaliana]
  misc_feature (135)..(445): NCBI GI: 119602110 NCBI Desc: wd repeat domain 25, isoform cra_a [homo sapiens]
  misc_feature (135)..(445): NCBI GI: 126302614 NCBI Desc: wd repeat protein 25
  misc_feature (135)..(445): NCBI GI: 34224019 NCBI Desc: pre-mrna splicing factor-like protein [homo sapiens]
  misc_feature (176)..(445): NCBI GI: 13177730 NCBI Desc: mgc4645 protein [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MDLLSAAYGATSDDEDAADPPSSVPVATGSASFAPPPLKRPRWESHQYLPPTHCFPQQPLLNTVTPLASPSSGRYVSKRERALLASSQVHVESGSPLSPVTRAEVYCAVGSINNTNLRADILHSLQCQPKPGPSTSFPLKLSVCLKGHTKAINCVDWSPSHGHLLASAGMDHKVHVWNVWDKGNTTARVLKHHTAAVKDVRWSLHRPFLLSGGLDCSLQLVDVVEGKVMKVFKDDQAVEVIKFNPSNPDLFLSGGSKGSLRLWDIRCGLVTKEFQRSLGTILDIDFSADGRQFISSTDTTRSNISENTIVVWDVSRQVPLSNQVYTEAFTCPCVRYHPREASFVAQSNGNYIAIFSARPPFKLNKYMRFEGHGVWGFPVKCNFSLSGRELASGSSDGCIYFYDYKSARLLRKIEAFKEACTDVVYHPVMPNVIASCSWSGEISVFE

SEQ ID NO: 10673 - DNA, 3129 bp, Sorghum bicolor
  misc_feature: Ceres ANNOT ID no. 6114549
  misc_feature: Encodes the peptide sequence at SEQ ID NO 10674
  misc_feature: Up-regulated in shoot tissues in response to methyl jasmonate treatment
atggagcgcgcacgccgccacgccagccgcgcgctgctgcgccgcctgctcgcggcggccaccaccaccaccaccaccgcgtcccctgccacgtcatcgtcccgcggcatctccaccctgtcgccggcggctcccgcggcggggaggcagcagcagcagcgccgccggcctcctccccaccagcacgcgcagggccggccggtgtcggtgtcggcgctacagccgagcgacacgttcccgcggcggcacaactcggcgacgcccgcggagcaggcggcgatggcaacaacctgcgggttcgacggcggcctcgacgcgctgatcgacgcgacggtgccagccgccatccgcgccccgccgatgcgcttctccgggaggttcgacgccgggctcaccgagtcgcagatgctggaccacatgcagcgcctggcgtccatgaacaaagcctacaagtccttcatcgggatggggtactacggcacgcacgtcccgggcgtcgtgctgcgcaacctcatggagaacccggcgtggtacacgcagtacaccccgtaccaggcggagatcgcgcagggccgcctcgagtcgctgctcaactaccagaccatggtcgccgatctcaccggtctccccatgtccaacgcgtccctcctcgacgaggccaccgccgccgctgaggccatggccatgtgcaacggcatcgttagggggaagaagaagacgttcctcatcgcgtccaactgccacccgcagaccatcgatgtctgccggacgcgcgccgacggattcgacatcagtgtcgtcgtcgctgacgccaaggactttgactacagcggcggcgacgtctgcggcgtgctcgtgcagtacccggggacggagggcgaggtgctcgactacgcgcagttcgtcagggacgcgcacgcgcacggcgtcaaggtcgtcatggccaccgacctgctcgcgctcaccacgctgcgcccgccgggcgagatcggcgccgacatcgccgtcggatccgcgcagcggttcggcgtgcccatgggctacggtggcccgcacgccgcgttcctcgccacgtcgcaggagtacaagcgtctcatgcccggccggatcatcggggttagcgtcgattccaccggcaagcccgcgctccgcatggcgatgcagacccgggagcagcacatccgcagggacaaggccaccagcaacatctgcactgcccaggccttgctcgccaacatggctgccatgtacgctgtctaccacggtccggcggggctgaaggcgatcgctgaccgggttcatggcctggctggcaccttcgcccacggcctcaagaagctcgggacagtgacggttcaggatctgcccttcttcgacacggtcaaggtcacgtgctctgatgcacgtgcaatcgccaaggaagctgtcaaaaacgagatgaaccttagggttgtcgacgccaacacgataaccgtagcatttgatgagacctccaccctggaggatgttgacaagctgttcaaggtgttcaacaatggcaaatcagcaagcttcacagctgaatccctcgccccagaggtctcaagctcaattcctagcagccttgctcgcgagagcccctacctaacgcatccaatcttcaacatgtaccacacagagcatgagcttcttcgttacctgcataagttgcagtccaaggatctctcactgtgccacagtatgatccctcttggttcttgcacaatgaagctaaacgctactgttgagatgatgcctgttacgtatcccaacttcgcgaacctccacccatttgccccaactgatcaggctgcagggtaccatgaaatgtttgacgacttgggcaacctgttatgcacgatcacaggttttgattctttctctttgcaaccaaatgctggtgctgcaggagagtatgctggattgatggttatccgtgcttacctcaactcaagaggagaacaccaccgcgatgtctgcatcattcctgtctcagcacacggcacaaatcctgcaagtgctgctatggttggaatgaagattgttgccgttggaaccgattccaagggtaacataaacatcgaggaattgaggaaagctgcagaagcaaacaaggacaacttggctgctctgatggttacctacccttcaactcacggagtctatgaagaaggcattgatgagatctgcaggatcattcatgaaaatggcggacaggtctacatggacggggctaacatgaatgctcaggttgggttaacaagccctggttttattggagctgatgtttgtcaccttaaccttcacaagacattttgcattccacatggtggaggtggtcctggcatgggtcctattggggttaagaagcatttggcaccgtttttaccctctcacccagtgattcccactggtggctttcctctccctgagaaaaccgaccctctcggtaccatttctgctgctccatggggatctgccttgattctgccaatttcctatgcatatatagccatgatgggttcacaaggactcactgatgcttcaaagatcgcgatcttgaatgcaaactacatggcaaaacgtctagagaaacactacccagttttgttccgtggagtcaatggaactgttgcccatgaattcatcattgatttaagaggatttaagacgactgctggtatagaaccagaggacgtggcaaagcgcctgatggactacggatttcactcaccaaccatgtcatggcctgttcctggcacacttatgattgaaccaactgaaagtgagagcaaggccgagctggacaggttctgtgatgctcttatctccatcagggaagagatcgcagagatagaaaatggcaaagcagatgtgctcaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggcgaccgcaacctcatctgcacactgcagcaggcgtcccaggtgaccgaggaagccgccgcagctgcaactgcgtaa

SEQ ID NO: 10674 - protein, 1042 aa, Sorghum bicolor
  misc_feature: Ceres ANNOT ID no. 6114549
  misc_feature (81)..(510): Pfam Id: GDC-P Pfam Desc: Glycine cleavage system P-protein
  misc_feature (1)..(1039): NCBI GI: 33641855 NCBI Desc: glycine dehydrogenase p protein [oryza sativa (japonica cultivar-group)]
  misc_feature (1)..(1039): NCBI GI: 2565305 NCBI Desc: glycine decarboxylase p subunit [x tritordeum sp.]
  misc_feature (1)..(1039): NCBI GI: 710308 NCBI Desc: victorin binding protein
  misc_feature (1)..(1040): NCBI GI: 2894362 NCBI Desc: p-protein precursor [solanum tuberosum]
  misc_feature (1)..(1038): NCBI GI: 22136488 NCBI Desc: p-protein-like protein [arabidopsis thaliana]
  misc_feature (1)..(1040): SWISSPROT Homolog: EC 1.4.4.2 Glycine dehydrogenase [decarboxylating], mitochondrial precursor
  misc_feature: Up-regulated in shoot tissues in response to methyl jasmonate treatment
MERARRHASRALLRRLLAAATTTTTTASPATSSSRGISTLSPAAPAAGRQQQQRRRPPPHQHAQGRPVSVSALQPSDTFPRRHNSATPAEQAAMATTCGFDGGLDALIDATVPAAIRAPPMRFSGRFDAGLTESQMLDHMQRLASMNKAYKSFIGMGYYGTHVPGVVLRNLMENPAWYTQYTPYQAEIAQGRLESLLNYQTMVADLTGLPMSNASLLDEATAAAEAMAMCNGIVRGKKKTFLIASNCHPQTIDVCRTRADGFDISVVVADAKDFDYSGGDVCGVLVQYPGTEGEVLDYAQFVRDAHAHGVKVVMATDLLALTTLRPPGEIGADIAVGSAQRFGVPMGYGGPHAAFLATSQEYKRLMPGRIIGVSVDSTGKPALRMAMQTREQHIRRDKATSNICTAQALLANMAAMYAVYHGPAGLKAIADRVHGLAGTFAHGLKKLGTVTVQDLPFFDTVKVTCSDARAIAKEAVKNEMNLRVVDANTITVAFDETSTLEDVDKLFKVFNNGKSASFTAESLAPEVSSSIPSSLARESPYLTHPIFNMYHTEHELLRYLHKLQSKDLSLCHSMIPLGSCTMKLNATVEMMPVTYPNFANLHPFAPTDQAAGYHEMFDDLGNLLCTITGFDSFSLQPNAGAAGEYAGLMVIRAYLNSRGEHHRDVCIIPVSAHGTNPASAAMVGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGTISAAPWGSALILPISYAYIAMMGSQGLTDASKIAILNANYMAKRLEKHYPVLFRGVNGTVAHEFIIDLRGFKTTAGIEPEDVAKRLMDYGFHSPTMSWPVPGTLMIEPTESESKAELDRFCDALISIREEIAEIENGKADVLNNVLKGAPHPPQLLMGDTWSKPYSREYAAFPAAWLRGAKFWPTTGRVDNVYGDRNLICTLQQASQVTEEAAAAATA

SEQ ID NO: 10675 - DNA, 1512 bp, Sorghum bicolor
  misc_feature: Ceres ANNOT ID no. 6114551
  misc_feature: Encodes the peptide sequence at SEQ ID NO 10676
atgacggaggtggcgctcctccggggcccgaccaacctcgcttccaccgcaagccgcgcctccgccgcctcctcctcctcctcctccgcagcgctgcgctatttagccaatgccgacagcgacgtgctcccaggaagcggcagcccggagcgcgcagccggatctgcagggagccgacgactccttgaactgcgcgggcaagaggcggcggaggaggaagaggagcggtggtcgttcttggcgctgctctttgaactgctgcggaagtcgctgctcgggtgcagaacggtgagcggcggcagcggcgaaggcgaacacggcggctgcgggatggagattgggttgcccacggacgtgcagcacgtggcgcacgtcacgttcgataggttccatggattcctggggctgcccgttgaattcgagcctgaagtgccccgccgtgctcccagtgcgagtgcaagtgtcttcggtgtttcaacagaatcaatgcagtgttcctatgattccagaggaaacagtgtcccaacaatcctcttgatgatgcagagacgcctttatgaacagggtggtcttcaggcagaaggtatcttccgtataaatgcagagaatagccaggaggagtttgtgagagaccaattaaatagtggaattgttccagatggcattgatgtccactgtttggcaggtctaataaaagcctggtttagagaaatgccaaggggggtactggactctatcccacctgaacaggtgatgcaatgccaatctgaagaggactgtgctcgggtagcaaaatgccttccaccagctgaagcagctttgcttgactgggctgttaatctgatggctgatgtagtccaagaagaacagataaacaagatgaatgatcgaaatattgctatggtttttgcaccaaatatgactcagatggcagatcctttgactgcactgatgtatgcagtccaagtgatgaattttctcaagatgcttgtacagaagaccctcaaggatagagtggagtccactccagaggatgttttgctaccccagaaggacccatctgatgaaaatgggcatcagaaacccagcgtgacacttgattctctccttgaggaaggatccaggcgcccttcttttgccaaggaagagccccttctgagcagtcctgcccacagcactgatgataagtctaatgaaactaatacgactttaggagtcactgctgctttcactgcccagacaagtgaagtagtaacgagtgtggaggactccactagtggctcacaacctgcaactgctggcccagttgctattgctgatgcttcgggcgcgacggctacaaattctcttcaaggcaagggaagccgaagcctgaatcggaggaggactagaaagggcaagggccagagccagtctggtacacgcacaacacctgcagctgaaaaatcaagaggtgcgagcatcgtgagccggataaactccaaggttgagcggatcgaagcatggagatga

SEQ ID NO: 10676 - protein, 503 aa, Sorghum bicolor
  misc_feature: Ceres ANNOT ID no. 6114551
  misc_feature (175)..(312): Pfam Id: RhoGAP Pfam Desc: RhoGAP domain
  misc_feature (112)..(158): Pfam Id: PBD Pfam Desc: P21-Rho-binding domain
  misc_feature (63)..(503): NCBI GI: 110676572 NCBI Desc: rhogap1 [nicotiana tabacum]
  misc_feature (61)..(503): NCBI GI: 3695059 NCBI Desc: rac gtpase activating protein 1 [lotus japonicus]
  misc_feature (65)..(503): NCBI GI: 87240813 NCBI Desc: rhogap; wiscott-aldrich syndrome, c-terminal [medicago truncatula]
  misc_feature (87)..(360): NCBI GI: 34451568 NCBI Desc: rho gtpase activating protein 2 [oryza sativa (japonica cultivar-group)]
  misc_feature (56)..(341): NCBI GI: 3695061 NCBI Desc: rac gtpase activating protein 2 [lotus japonicus]
MTEVALLRGPTNLASTASRASAASSSSSSAALRYLANADSDVLPGSGSPERAAGSAGSRRLLELRGQEAAEEEEERWSFLALLFELLRKSLLGCRTVSGGSGEGEHGGCGMEIGLPTDVQHVAHVTFDRFHGFLGLPVEFEPEVPRRAPSASASVFGVSTESMQCSYDSRGNSVPTILLMMQRRLYEQGGLQAEGIFRINAENSQEEFVRDQLNSGIVPDGIDVHCLAGLIKAWFREMPRGVLDSIPPEQVMQCQSEEDCARVAKCLPPAEAALLDWAVNLMADVVQEEQINKMNDRNIAMVFAPNMTQMADPLTALMYAVQVMNFLKMLVQKTLKDRVESTPEDVLLPQKDPSDENGHQKPSVTLDSLLEEGSRRPSFAKEEPLLSSPAHSTDDKSNETNTTLGVTAAFTAQTSEVVTSVEDSTSGSQPATAGPVAIADASGATATNSLQGKGSRSLNRRRTRKGKGQSQSGTRTTPAAEKSRGASIVSRINSKVERIEAWR

SEQ ID NO: 10677 - DNA, 1512 bp, Sorghum bicolor
  misc_feature: Ceres ANNOT ID no. 6114553
  misc_feature: Encodes the peptide sequence at SEQ ID NO 10678
atggaccaggaacgcaccccgccggcgacgaagagggcaaggcgctcgcctcctccgcaagccggcgcggaggaccggctcggcgcgctcgacgacggcaccctccactccatcctcgtccgcttgccgctccgcgacgcggcggccacggtcgtgctctcccgccggtggccccgcgtcttcgccacgctcccgcgcctggtcctccgccccgccaccttcaaccgccgcggcttccccgacgaggagggcgacgaggaccgctgcgaggacccgacacgctggatgcgcgcactccgctgcgtcctcgaccgccgcgccgcgccggtcgcggctttcgagatcgactgcagattcatgagcctgtacggtgagtggttctcctgggtcttccgcgagctctgcgggagcggcgggctcctggagctcagcatcgccaacaccgactacaaagagtgctacgcgctgcccgacgctgtgtacacctgcacgacgctcacgtcgctggacctctacaactgctggctccaggtgccgagcagggccgctgcgatggcgctgcgcgccctgcagtcgctccgcctccgcaacgtggtcgcgagcgacagcgacatccgtctcatcatctgccggtgctccgccatagagcgtctggagatccatgacatccacatggcgcgaaacatcgtcatacgcgcgccttgcctcaagaagctagacatctactcgtatcgcccgctctgcatctccctgaagaaggcaaaggcacagccactgaacatggtgaggctgagcctctcctacggctaccctgagcattcttggagcctccacgacaccttggacaccaacagggagtgctccaatcatgaaatcgaggagatccttgattacaagaagatgtctgagagggagcacaagcagacggatgagatcaagaacatggaaacattcctcactgcactcagcttcaccaaaacgctccagttgcatttatcgactgaatactccgaggttttgaacatggccaaggcttcaacgttgatgagtttgcccaagaaaaagtacctgcttggcttgaaatcactcagcctaactctggatcacaaccatgaagttcttgctaccttagtttcatgcttgctgaacagctctcccaacctcaaggatctcagaatcattgagcttcggcatccgggaagccctgtgcccttagctgtagagttttgggagaagcagataactgcagacggatttctgtatcacctgtcaagtgtcaccttctacactgattcgctcttggaaggccacccttgtgggggcatttgcaagttcttggtgatgaacgcgagggtcctcaaaagaatgagcatcgtgtaccatcattcgcaggtcaagccggagcatgcagccaagcttgaggcagcccgaagggaactccatctctggccaagggcttctgcggatgtactgctggagttggctcctgtggatcgcttcccatggttctga

SEQ ID NO: 10678 - protein, 503 aa, Sorghum bicolor
  misc_feature: Ceres ANNOT ID no. 6114553
  misc_feature (25)..(278): NCBI GI: 140059780 NCBI Desc: cyclin-like f-box [medicago truncatula]
  misc_feature (13)..(241): NCBI GI: 140040589 NCBI Desc: cyclin-like f-box [medicago truncatula]
  misc_feature (22)..(241): NCBI GI: 140059783 NCBI Desc: cyclin-like f-box; fbd [medicago truncatula]
  misc_feature (10)..(241): NCBI GI: 140040591 NCBI Desc: cyclin-like f-box [medicago truncatula]
  misc_feature (7)..(220): NCBI GI: 38346008 NCBI Desc: osjnba0035o13.10 [oryza sativa (japonica cultivar-group)]
MDQERTPPATKRARRSPPPQAGAEDRLGALDDGTLHSILVRLPLRDAAATVVLSRRWPRVFATLPRLVLRPATFNRRGFPDEEGDEDRCEDPTRWMRALRCVLDRRAAPVAAFEIDCRFMSLYGEWFSWVFRELCGSGGLLELSIANTDYKECYALPDAVYTCTTLTSLDLYNCWLQVPSRAAAMALRALQSLRLRNVVASDSDIRLIICRCSAIERLEIHDIHMARNIVIRAPCLKKLDIYSYRPLCISLKKAKAQPLNMVRLSLSYGYPEHSWSLHDTLDTNRECSNHEIEEILDYKKMSEREHKQTDEIKNMETFLTALSFTKTLQLHLSTEYSEVLNMAKASTLMSLPKKKYLLGLKSLSLTLDHNHEVLATLVSCLLNSSPNLKDLRIIELRHPGSPVPLAVEFWEKQITADGFLYHLSSVTFYTDSLLEGHPCGGICKFLVMNARVLKRMSIVYHHSQVKPEHAAKLEAARRELHLWPRASADVLLELAPVDRFPWF

SEQ ID NO: 10679 - DNA, 1680 bp, Sorghum bicolor
  misc_feature: Ceres ANNOT ID no. 6114554
  misc_feature: Encodes the peptide sequence at SEQ ID NO 10680
  misc_feature: Down-regulated in shoot tissues in response to salicylic acid treatment
atggaggccaccacagcgctcgcgctctcctcgtcgctcgccaccgcacgccgctcgccggagaaggcggccgctgcttcgtccctccgcctccgaaacttctccgctacctcctcgctccaccacctccgcgctgcccggagcccagcgcctcgctcccacccgtcgtcgtcacccttccagggatggaggcggcgggggagggcgggagggctggtggttcgcgcggagatgttcggccagctcaccaccggccttgagtccgcctggaacaagttgaggggagtcgatatattgacaaaggaaaacatagccgaaccaatgcgggatatcagaagagcacttttggaggcagatgtaagtttgccagtagtaagaagatttattgagtctgtaagtgaaaaggccgtaggcactgatgtgatccgaggtgtccgacctgaccagcagttggtgaaggttgtgaatgatgaactggtacaactgatgggcggggaggtatcagatttggtgtttgcaaaatctgggccaactattatcttgttggcaggtctgcaaggtgttggaaaaactactgtttgtgcgaagcttgccttctatctaaaaaaaatgggcaagagttgcatgctagttgctgcagatgtttacaggcctgctgctattgatcaactcactattctgggtaaaaaggttggtgtaccagtttactcagaaggaactgaagcaaaaccttcacaaatagccaaaaacggtttgaaggaggcaaaagtcaataaggctgacgtaattatagtggacacggctggaagactgcaggtagataaatcaatgatgaatgagttgaaagaagtaaaaaaagcagtgaatcctacagaagttcttcttgtggttgatgccatgactggccaagaagctgcagggttggtcagctccttcaatgatgagattggtataactggtgctattctgacaaagctggatggtgactcaagaggtggagctgcactgagtgttaaagaggtgtctggaaagccaattaaatttgtaggacaaggagagcgtattgaagatctagagcctttctacccagatcgtatggcacaacgtatcctgggaatgggagatgtgctttcatttgttgaaaaagcacaagaagtgatgcgtcaagaagatgccgaggaattacagaagaagatcttgagtgcaaaatttaactttaacgactttctgaagcaaacacaaatgatcgcccaaatgggttcattcagtcgtttaattggcatgattccaggcatgaacaaggttacccctgcacaaatccgtgaagctgagaagaatctcaagtttatggagtcaatgatcaatgttatgactcctgaggaaagggaaagaccagagttactagctgaatcacgcgagagaaggaaacgagtggccaaggactctggaaagactgaacagcaggtgggtcaattggttgcgcaactcttccaaatgcgtgcaaaaatgcagaaaatgatgggtgctatacaaggaaaagagtcaccagatatggacgagctcatggaatcaatgaaagctgaggagcaggctgctgctggtactggacgacgtagaaggaagtatggcaacctgaggcagcggcaattggatgcaatgcgtggtttccggagacggtga

SEQ ID NO: 10680 - protein, 559 aa, Sorghum bicolor
  misc_feature: Ceres ANNOT ID no. 6114554
  misc_feature (176)..(372): Pfam Id: SRP54 Pfam Desc: SRP54-type protein, GTPase domain
  misc_feature (403)..(503): Pfam Id: SRP_SPB Pfam Desc: Signal peptide binding domain
  misc_feature (79)..(164): Pfam Id: SRP54_N Pfam Desc: SRP54-type protein, helical bundle domain
  misc_feature (179)..(357): Pfam Id: CbiA Pfam Desc: CobQ/CobB/MinD/ParA nucleotide binding domain
  misc_feature (67)..(541): NCBI GI: 3746964 NCBI Desc: signal recognition particle 54 kda subunit precursor [arabidopsis thaliana]
  misc_feature (64)..(547): NCBI GI: 3746903 NCBI Desc: signal recognition particle 54 kda subunit precursor [pisum sativum]
  misc_feature (78)..(541): NCBI GI: 113476149 NCBI Desc: signal recognition particle protein [trichodesmium erythraeum ims101]
  misc_feature (78)..(506): NCBI GI: 119510257 NCBI Desc: signal recognition particle protein [nodularia spumigena ccy9414]
  misc_feature (78)..(543): NCBI GI: 22299516 NCBI Desc: signal recognition particle protein [thermosynechococcus elongatus bp-1]
  misc_feature: Down-regulated in shoot tissues in response to salicylic acid treatment
MEATTALALSSSLATARRSPEKAAAASSLRLRNFSATSSLHHLRAARSPAPRSHPSSSPFQGWRRRGRAGGLVVRAEMFGQLTTGLESAWNKLRGVDILTKENIAEPMRDIRRALLEADVSLPVVRRFIESVSEKAVGTDVIRGVRPDQQLVKVVNDELVQLMGGEVSDLVFAKSGPTIILLAGLQGVGKTTVCAKLAFYLKKMGKSCMLVAADVYRPAAIDQLTILGKKVGVPVYSEGTEAKPSQIAKNGLKEAKVNKADVIIVDTAGRLQVDKSMMNELKEVKKAVNPTEVLLVVDAMTGQEAAGLVSSFNDEIGITGAILTKLDGDSRGGAALSVKEVSGKPIKFVGQGERIEDLEPFYPDRMAQRILGMGDVLSFVEKAQEVMRQEDAEELQKKILSAKFNFNDFLKQTQMIAQMGSFSRLIGMIPGMNKVTPAQIREAEKNLKFMESMINVMTPEERERPELLAESRERRKRVAKDSGKTEQQVGQLVAQLFQMRAKMQKMMGAIQGKESPDMDELMESMKAEEQAAAGTGRRRRKYGNLRQRQLDAMRGFRRR

SEQ ID NO: 10681 - DNA, 1746 bp, Sorghum bicolor
  misc_feature: Ceres ANNOT ID no. 6114583
  misc_feature: Encodes the peptide sequence at SEQ ID NO 10682
atggatgagacaactgaagcaagcccttcgtctaaactccatacaagattgagactctgggagtttcctgactgttatatatttgaaccaattgatggccttgctgacttgtacttgtcagttagccgggccagtggaacaatgaatctagttcaagacttgccgtcacgcggatccactacaaaacctaaagctcaaacagtatatggtgtgataggagtgcttaaacttgcagttggatcatattttctggtgatcacggatcgtgactgtgtgggatcctactttggacacacaatttttaaagtgacaggactgaaagttcttccctgcaataatgcacataacaccgcctcttctgagcagaaaaaaatggaaacagaattctcagaactcctggatgctgcagagaggactgtcggccttcacttctcctacgatgttaacctaacactttctgcacagaggctacatgatctaggcgatgagtataaatctcttcctctttggagacaggcagaaccaagatttctatggaacagttacctgttagaacctctaattgagaacaagctgaaccagtacttattgccagtaattcaaggtttccaaaatatccaagcagaagttgggtcagagaaggtaaatgtgacccttattgcacgtaggtgcacacgaaggataggtactcgaatgtggagacgaggagctgatgcagagggttatgctgcaaacttcgttgaatcagagcagataatgcagtcaaaagggtttacagcatcctatgtacaagttcgaggttctatgccattcttgtgggagcagattgttgatttgacatataaacctagttttgacgttgttagacaagaggaggcgcctcgtgtacttgagaggcacttccatgacttgcaaaagaaatacggagctgtcttagctgttgatcttgtcaatacaagtggtggagagggtcgcctccgtgaaagatatgcaaaatctattgaacctattcttagtgaagatataagatatgtgcactttgacttccaccgagtttgtggtcatattcactttgagcgcctttctcagttgtatgatcagatcaaggactatcttcagaaacataagtacttccttataaatgataaacaggagaaaattgagcagcagactggcactgtaagaacaaattgtatagattgtttggatcgcactaatgtgactcagagtatgattgggggaaagattctggaaagccaacttcaacgtataggagttcttggttctgtgtgggccaatcatggagatgcaataagcattcagtactctggaactcctgctctgaagggagattttgttcggtatgggaagcgaactacacaaggaattctgaacgatttgaggaatgcgcttgcaagatactacttgaataactttgttgatgggactaagcaggatgccatggatcttcttcaaggacattatataacgtccgttagtcgagacatggcagtgccaagcaaagcaggacttctggagagttatgcgtccttccgccttgcttttgcattggttatgggagcgctaatgttcatgatgatgtcactaaggcaagcacggaatgatgttcgccatttgttgctgtcacttatgtgggctggtctttgtattgccatcacacattttgttagagccaatggccgcacgttcactaaccggcctaggtttcaccagtcacgccattga

SEQ ID NO: 10682 - protein, 581 aa, Sorghum bicolor
  misc_feature: Ceres ANNOT ID no. 6114583
  misc_feature (68)..(361): Pfam Id: Syja_N Pfam Desc: SacI homology domain
  misc_feature (1)..(581): NCBI GI: 50725775 NCBI Desc: inositol 5-phosphatase 3-like protein [oryza sativa (japonica cultivar-group)]
  misc_feature (12)..(580): NCBI GI: 31415729 NCBI Desc: sac domain protein 6 [arabidopsis thaliana]
  misc_feature (12)..(429): NCBI GI: 91807100 NCBI Desc: phosphoinositide phosphatase family protein [arabidopsis thaliana]
  misc_feature (17)..(575): NCBI GI: 115452391 NCBI Desc: os03g0290500 [oryza sativa (japonica cultivar-group)]
  misc_feature (317)..(581): NCBI GI: 62734710 NCBI Desc: similar to sac domain protein 7 [oryza sativa (japonica cultivar-group)]
MDETTEASPSSKLHTRLRLWEFPDCYIFEPIDGLADLYLSVSRASGTMNLVQDLPSRGSTTKPKAQTVYGVIGVLKLAVGSYFLVITDRDCVGSYFGHTIFKVTGLKVLPCNNAHNTASSEQKKMETEFSELLDAAERTVGLHFSYDVNLTLSAQRLHDLGDEYKSLPLWRQAEPRFLWNSYLLEPLIENKLNQYLLPVIQGFQNIQAEVGSEKVNVTLIARRCTRRIGTRMWRRGADAEGYAANFVESEQIMQSKGFTASYVQVRGSMPFLWEQIVDLTYKPSFDVVRQEEAPRVLERHFHDLQKKYGAVLAVDLVNTSGGEGRLRERYAKSIEPILSEDIRYVHFDFHRVCGHIHFERLSQLYDQIKDYLQKHKYFLINDKQEKIEQQTGTVRTNCIDCLDRTNVTQSMIGGKILESQLQRIGVLGSVWANHGDAISIQYSGTPALKGDFVRYGKRTTQGILNDLRNALARYYLNNFVDGTKQDAMDLLQGHYITSVSRDMAVPSKAGLLESYASFRLAFALVMGALMFMMMSLRQARNDVRHLLLSLMWAGLCIAITHFVRANGRTFTNRPRFHQSRH

SEQ ID NO: 10683 - DNA, 1104 bp, Sorghum bicolor
  misc_feature: Ceres ANNOT ID no. 6114594
  misc_feature: Encodes the peptide sequence at SEQ ID NO 10684
atgcacctcgctctcctcctcccccgcattcgcctctcgccggccgccatgtccagcacccgctccgcctccgcctccaggctgctggtccgcgccgacctcaacccagttgtacgagaagtcaaacgcgaatccagtgtttcttttgacatttcaaagcccgaagcaactgcttctgttaagaggaaaagggtgaaacgagaacttgaattaaatggggagcatcataagaagcagtttggtgttgtccctgacatcgaggattttcgatatgaaaaggccaaaacattgacagcgtcaagtaaggcaacagcatcttcggtcaaggtggagaaaaaggtcagagtttcttcagtaataaaagttggagctccagataactgggaggcagttcttggaggcattaaaagcatgaggttatctggtgaagcccccgtagatacgaagggctgtgaaaaggctggttctctccttccacccaaggaaagaagatttgcagttctgatatcaactatgatgtcaagccagacaaaagatgaagttacgcatgctgctgtggaacgcctctctgaaaacggtttacttgatcctgatgctatagtgaggactgatgagaccacgcttgcgaatcttatcaaacctgtcggattctatcagagaaaggcacagttcataaaagaagcttctaaaatttgtcttgaacgttttggaggggatattccagattctctgaatgagctgcttgctctgagaggagttggccctaaaatggctcatttggtgatgagcattgcttggaagaatactcaaggaatctgcgttgacactcatgtgcatcgcatttctaatcgacttgggtgggtttttcgggaaggaacaaaacagaaaactacgacaccagaacagacaagaatttctctagagaaatggctacccaaggatgagtgggaacctataaatccattactggttggatttgggcaaactatctgtactccactgaggcccaaatgcgacaactgtggcatcaataacctttgcccttctgctttcaaggaatcatcaagcccaaatccaaagcaaaagaaaacaaggtctccatag

SEQ ID NO: 10684 - protein, 367 aa, Sorghum bicolor
  misc_feature: Ceres ANNOT ID no. 6114594
  misc_feature (169)..(313): Pfam Id: HhH-GPD Pfam Desc: HhH-GPD superfamily base excision DNA repair protein
  misc_feature (235)..(264): Pfam Id: HHH Pfam Desc: Helix-hairpin-helix motif
  misc_feature (1)..(365): NCBI GI: 62734224 NCBI Desc: endonuclease iii homologue [oryza sativa (japonica cultivar-group)]
  misc_feature (45)..(364): NCBI GI: 11181952 NCBI Desc: endonuclease iii homologue [arabidopsis thaliana]
  misc_feature (17)..(364): NCBI GI: 42571353 NCBI Desc: endonuclease-related [arabidopsis thaliana]
  misc_feature (17)..(364): NCBI GI: 6850320 NCBI Desc: contains similarity to an endonuclease iii homolog from homo sapiens gbu81285, and contains an endonuclease iii pf00730 domain. [arabidopsis thaliana]
  misc_feature (211)..(366): NCBI GI: 115485053 NCBI Desc: os11g0267300 [oryza sativa (japonica cultivar-group)]
  misc_feature (120)..(350): SWISSPROT Homolog: EC 4.2.99.18 Endonuclease III-like protein 1
MHLALLLPRIRLSPAAMSSTRSASASRLLVRADLNPVVREVKRESSVSFDISKPEATASVKRKRVKRELELNGEHHKKQFGVVPDIEDFRYEKAKTLTASSKATASSVKVEKKVRVSSVIKVGAPDNWEAVLGGIKSMRLSGEAPVDTKGCEKAGSLLPPKERRFAVLISTMMSSQTKDEVTHAAVERLSENGLLDPDAIVRTDETTLANLIKPVGFYQRKAQFIKEASKICLERFGGDIPDSLNELLALRGVGPKMAHLVMSIAWKNTQGICVDTHVHRISNRLGWVFREGTKQKTTTPEQTRISLEKWLPKDEWEPINPLLVGFGQTICTPLRPKCDNCGINNLCPSAFKESSSPNPKQKKTRSP

SEQ ID NO: 10685 - DNA, 1452 bp, Sorghum bicolor
  misc_feature: Ceres ANNOT ID no. 6114603
  misc_feature: Encodes the peptide sequence at SEQ ID NO 10686
  misc_feature: Down-regulated in root tissues in response to methyl jasmonate treatment
  misc_feature: Up-regulated in shoot tissues in response to methyl jasmonate treatment
atgggagatactagtagttctagccattcaaggcaggatccctgtgctcttggctatggcttccatggtgccatcgccaattccattcctgcaaacttctttgaccaagacggaggtgcctattttggagagctggaagaggctttcatgcatcaggttgcctcactcgcaagaactcaacaagctgcaactacctccatagctcatcatggagacatcaagccctttcccactgctgctactgtcacagctgcaacgactacagctaggccacctcctacactggacatcttcccagcttggcctatgaggtctcttcacacacccaaggagggctcaaatgtgacagcagacagcacagacgactcggagagcagcagcaagaacaacagcaaccactcagatcagcacggagcagcagcagacatgcaaagccagtttggtcaaggttcacagcagcagcagcagcagcagcttcagcacaagaatatggctactagtttcaccccaaggactggcaagactcctgatccaaagacaatcagaaggcttgcgcagaaccgagaagctgcacgcaaaagccggctgcgaaagaaggcttacattcagcagcttgagagcagcaaactgaagcttgctcagatagaacaggatatgcagagagcacattcccagggcatctttctaggaggagctccaggtgcaaactctagctcaggcgccgcaatgttcgacgtggagtacgcccgttggctggatgaccacggccggcgcatggccgagctgcacggagctctgcatgcgcacttgccagatggtgacctcagagccatcgtggatgacaccctgacccaccacgatgagctgttccagctaaaggcgtcggcagccaagtctgacgtgttccacctcatcaccggggtgtggacgaccccggctgagcggtgcttcctctggatgggtggattcaggccatcggatctggtcaagacgctgctgccccagctagatcccttgactgagcagcaactggtaggcatatgcaaccttcaacagtcatcacagcaggcagaggaagctctctcccagggcctggaccagctgcatcagtccctagctgacaccatggccggtggatctctgattgacgacaccaacatgagcttcatgggtcaaatggcccttgcccttggcaagctgtccaaccttgaaggttttgtgatacaggctgataacttgaggcagcagactcttcatcagatgcaccggattctgacagttcggcaggcagctcgatgtttcttggccattggcgagtaccacaaccgcctccgtgccttaagctccctctgggtttctcggcctcgagagatactgggtgcagatgaaggcaattgtggggagataagcattgcggcacaagcatctcaaagccaattttcatccttctga

SEQ ID NO: 10686 - protein, 483 aa, Sorghum bicolor
  misc_feature: Ceres ANNOT ID no. 6114603
  misc_feature (175)..(227): Pfam Id: bZIP_1 Pfam Desc: bZIP transcription factor
  misc_feature (1)..(483): NCBI GI: 62732726 NCBI Desc: bzip transcription factor [oryza sativa (japonica cultivar-group)]
  misc_feature (12)..(483): NCBI GI: 77553042 NCBI Desc: bzip transcription factor [oryza sativa (japonica cultivar-group)]
  misc_feature (12)..(483): NCBI GI: 115487384 NCBI Desc: os12g0152900 [oryza sativa (japonica cultivar-group)]
  misc_feature (161)..(483): NCBI GI: 2865394 NCBI Desc: basic leucine zipper protein [zea mays]
  misc_feature (161)..(483): NCBI GI: 28630433 NCBI Desc: liguleless2-like protein [zea mays]
  misc_feature: The sequence is a functional homolog of SEQ ID NO 1016 in the 10/225,066US patent application
  misc_feature: The sequence is a functional homolog of SEQ ID NO 1494 in the 10/374,780US patent application
  misc_feature: The sequence is a functional homolog of SEQ ID NO 1498 in the 10/374,780US patent application
  misc_feature: The sequence is a functional homolog of SEQ ID NO 156 in the 10/412,699US patent application
  misc_feature: The sequence is a functional homolog of SEQ ID NO 1564 in the 10/412,699US patent application
  misc_feature: The sequence is a functional homolog of SEQ ID NO 1568 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 1978 in the 10/374,780US patent application
  misc_feature: The sequence is a functional homolog of SEQ ID NO 2240 in the 10/374,780US patent application
  misc_feature: The sequence is a functional homolog of SEQ ID NO 242 in the 10/374,780US patent application
  misc_feature: The sequence is a functional homolog of SEQ ID NO 353 in the 11/479,226US patent application
  misc_feature: The sequence is a functional homolog of SEQ ID NO 369 in the 11/479,226US patent application
  misc_feature: The sequence is a functional homolog of SEQ ID NO 40 in the 10/374,780US patent application
  misc_feature: The sequence is a functional homolog of SEQ ID NO 580 in the 11/435,388US patent application
  misc_feature: The sequence is a functional homolog of SEQ ID NO 76 in the 10/412,699US patent application
  misc_feature: The sequence is a functional homolog of SEQ ID NO 764 in the 10/412,699US patent application
  misc_feature: The sequence is a functional homolog of SEQ ID NO 776 in the 10/225,066US patent application
  misc_feature: The sequence is a functional homolog of SEQ ID NO 826 in the 10/225,066US patent application
  misc_feature: The sequence is a functional homolog of SEQ ID NO 950 in the 11/435,388US patent application
  misc_feature: The sequence is a functional homolog of SEQ ID NO 96 in the 11/375,241US patent application
  misc_feature: Useful for making plants with modulated growth and phenotype characteristics
  misc_feature: The sequence is a functional homolog of SEQ ID NO 156 in the 20040045049 US patent application
  misc_feature: The sequence is a functional homolog of SEQ ID NO 156 in the 20040045049 US patent application
  misc_feature: The sequence is a functional homolog of SEQ ID NO 1564 in the 20040045049 US patent application
  misc_feature: The sequence is a functional homolog of SEQ ID NO 1568 in the 20040045049 US patent application
  misc_feature: The sequence is a functional homolog of SEQ ID NO 76 in the 20040045049 US patent application
  misc_feature: The sequence is a functional homolog of SEQ ID NO 764 in the 20040045049 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: Down-regulated in root tissues in response to methyl jasmonate treatment
  misc_feature: Up-regulated in shoot tissues in response to methyl jasmonate treatment
MGDTSSSSHSRQDPCALGYGFHGAIANSIPANFFDQDGGAYFGELEEAFMHQVASLARTQQAATTSIAHHGDIKPFPTAATVTAATTTARPPPTLDIFPAWPMRSLHTPKEGSNVTADSTDDSESSSKNNSNHSDQHGAAADMQSQFGQGSQQQQQQQLQHKNMATSFTPRTGKTPDPKTIRRLAQNREAARKSRLRKKAYIQQLESSKLKLAQIEQDMQRAHSQGIFLGGAPGANSSSGAAMFDVEYARWLDDHGRRMAELHGALHAHLPDGDLRAIVDDTLTHHDELFQLKASAAKSDVFHLITGVWTTPAERCFLWMGGFRPSDLVKTLLPQLDPLTEQQLVGICNLQQSSQQAEEALSQGLDQLHQSLADTMAGGSLIDDTNMSFMGQMALALGKLSNLEGFVIQADNLRQQTLHQMHRILTVRQAARCFLAIGEYHNRLRALSSLWVSRPREILGADEGNCGEISIAAQASQSQFSSF

SEQ ID NO: 10687 - DNA, 822 bp, Sorghum bicolor
  misc_feature: Ceres ANNOT ID no. 6114604
  misc_feature: Encodes the peptide sequence at SEQ ID NO 10688
atggcgctcgccgcctcccaccacggcctcctgcccgtcgcccccgcccccaccgccacccttaccccgtcgcggggtcacctgcgcttccgcgccgcgcgacctctgcggcaccgacccgcccggagaatttgttgccaatctatcaactcagctaatgtgttgggagcttcttcaaagacatctgatgaggcagtcccagtcccagttgtccagatagatcaagattcagaccgtgatgcaaccattgtgcagctaagttttggagatcgtttgggggcactacttgacacgatgaaagcactcaaggaccttggccttgatgtcacaaaaggaagtgtgacaactgactcagctgtcacacaaacaaagttccacatcatgcgatctggacgcaaggttgaggaccctgacatgttagaaaggattcggctaaccatcatcaacaaccttctccagtatcatcctgaatcaagtgagaagttagcgatgggtgaattttttgggataaagcctcctgagaagaaggctgttgtcgatattgcaacacgtatagttattgaagatgatggaccaaaaagaagcatgctttacatagagacagccgatcggcctggcctacttcttgagataatcaagattattgcggacacaaatgttgatgtggaatcagctgagattgatactgaaggtttggttgcaaaggacaagttccatgtaagttacagaggtgcaaaactaaacagctccttatctcaggcgctgatcaattgtctgcgttattacctccgaaggcctgagacagatgaagacagttattga

SEQ ID NO: 10688 - protein, 273 aa, Sorghum bicolor
  misc_feature: Ceres ANNOT ID no. 6114604
  misc_feature (56)..(194): NCBI GI: 115475491 NCBI Desc: os08g0242700 [oryza sativa (japonica cultivar-group)]
  misc_feature (58)..(173): NCBI GI: 42571513 NCBI Desc: uridylyltransferase-related [arabidopsis thaliana]
  misc_feature (76)..(256): NCBI GI: 118734823 NCBI Desc: utp-glnb uridylyltransferase, glnd [dinoroseobacter shibae dfl 12]
  misc_feature (71)..(256): NCBI GI: 88862937 NCBI Desc: utp-glnb (protein pii) uridylyltransferase, glnd [jannaschia sp. ccs1]
  misc_feature (48)..(259): NCBI GI: 94968516 NCBI Desc: utp-glnb (protein pii) uridylyltransferase, glnd [acidobacteria bacterium ellin345]
  misc_feature: Useful for making plants with altered alkaloid content
  misc_feature: Useful for making plants with altered lignin content
  misc_feature: Functional homolog of the protein sequence given in SEQ ID NO 13316
MALAASHHGLLPVAPAPTATLTPSRGHLRFRAARPLRHRPARRICCQSINSANVLGASSKTSDEAVPVPVVQIDQDSDRDATIVQLSFGDRLGALLDTMKALKDLGLDVTKGSVTTDSAVTQTKFHIMRSGRKVEDPDMLERIRLTIINNLLQYHPESSEKLAMGEFFGIKPPEKKAVVDIATRIVIEDDGPKRSMLYIETADRPGLLLEIIKIIADTNVDVESAEIDTEGLVAKDKFHVSYRGAKLNSSLSQALINCLRYYLRRPETDEDSY

SEQ ID NO: 10689 - DNA, 1029 bp, Sorghum bicolor
  misc_feature: Ceres ANNOT ID no. 6114607
  misc_feature: Encodes the peptide sequence at SEQ ID NO 10690
atggcccctaaattagtcttcgttcttccagttgtgctcctcggcttggtgctccaggcgattctccggccaccgcccccaaaactctgtggctcaccaggtggccctcctctgacatccccgaggatcaaactcagggacggaaggtaccttgcatacagagaagatggagtgcagaaagacaaggccaggtacaagatcatcacagtgcatgcgtttgatagcaccaaggacttccccttacctgtttctaaggagcttgtggaagaattgggaatttacatccttgcttatgatagagctggatatggggaaagtgacccgaatcccaagcgggatgtcaagagtgaggcactggatatcgaggagcttgctgaccagctggggcttgggcagaagttctatgtcttaggggcctcgatgggtggatactcagtatggggatgcctccagcttgcaggagctgcgatggttgtgccaattatcaactactggtggccttctttcccagctgaattatccaggcaggccttcaagagactggttgtgccagagcagagaactctttggattgcacataacataccatccttgctctacctgtggatgacccagaggtggttcccttcttctgcagcagccatgcaccaccctgaaatatttagcaagcatgatatggaggttcttcagaagatgatggcaatgccaaaaaccattgagaataaatcaaggcagcaaggcatttatgaatcaatccaccgtgatttacttgtcgcgttcggaagttgggagtttgatccaatgaacattaccaatccatttcctcaaaatgagggttctgtacacatctggcaaggatacgaagataggttggtgcttgttgagctgcagaggtacatttccaagaagcttccatggatcaagtatcatgaagtaccagaaggtggacacatgttcatgctggtagatggatggaccgaccgaattctcaaggcactcttgttaggagaagagaccctagatgtgtga

SEQ ID NO: 10690 - protein, 342 aa, Sorghum bicolor
  misc_feature: Ceres ANNOT ID no. 6114607
  misc_feature (93)..(332): Pfam Id: Abhydrolase_1 Pfam Desc: alpha/beta hydrolase fold
  misc_feature (1)..(338): NCBI GI: 115487372 NCBI Desc: os12g0152100 [oryza sativa (japonica cultivar-group)]
  misc_feature (4)..(342): NCBI GI: 20161637 NCBI Desc: p0489b03.5 [oryza sativa (japonica cultivar-group)]
  misc_feature (4)..(338): NCBI GI: 115458272 NCBI Desc: os04g0412000 [oryza sativa (japonica cultivar-group)]
  misc_feature (4)..(338): NCBI GI: 116310144 NCBI Desc: h0717b12.6 [oryza sativa (indica cultivar-group)]
  misc_feature (11)..(334): NCBI GI: 15232465 NCBI Desc: hydrolase, alpha/beta fold family protein [arabidopsis thaliana]
MAPKLVFVLPVVLLGLVLQAILRPPPPKLCGSPGGPPLTSPRIKLRDGRYLAYREDGVQKDKARYKIITVHAFDSTKDFPLPVSKELVEELGIYILAYDRAGYGESDPNPKRDVKSEALDIEELADQLGLGQKFYVLGASMGGYSVWGCLQLAGAAMVVPIINYWWPSFPAELSRQAFKRLVVPEQRTLWIAHNIPSLLYLWMTQRWFPSSAAAMHHPEIFSKHDMEVLQKMMAMPKTIENKSRQQGIYESIHRDLLVAFGSWEFDPMNITNPFPQNEGSVHIWQGYEDRLVLVELQRYISKKLPWIKYHEVPEGGHMFMLVDGWTDRILKALLLGEETLDV

SEQ ID NO: 10691 - DNA, 522 bp, Sorghum bicolor
  misc_feature: Ceres ANNOT ID no. 6114608
  misc_feature: Encodes the peptide sequence at SEQ ID NO 10692
atgtctaggtctgtggagcctctcatagttgggcgggtgattggagaagttctcgactcctttaacccatgtgtgaagatgatagtgacctacaactcaaacaaacttgtattcaatggccatgagatctacccatcagctgttgtatctaaacctagggtagaggttcaagggggtgacttgcggtctttcttcacattggttatgacggacccagatgtcccaggaccaagtgatccatatctaagggagcaccttcattggatcgtgactgatatacctgggacaacagatgcctcctttgggcgagaggtcataagctacgagagcccaagaccaaacattggtatccacaggttcatttttgtgctcttcaagcagaagggtaggcaaactgtaactgtgccatcctccagagatcatttcaacactcggcagttcgctgaggaaaatgaccttggcctccctgtagctgctgtctacttcaatgcacagagagaaactgcagctaggagacgctga

SEQ ID NO: 10692 - protein, 173 aa, Sorghum bicolor
  misc_feature: Ceres ANNOT ID no. 6114608
  misc_feature (19)..(165): Pfam Id: PBP Pfam Desc: Phosphatidylethanolamine-binding protein
  misc_feature (1)..(173): NCBI GI: 115498267 NCBI Desc: terminal flower 1 [zea mays]
  misc_feature (1)..(173): NCBI GI: 5360178 NCBI Desc: cen-like protein fdr2 [oryza sativa]
  misc_feature (1)..(173): NCBI GI: 5360180 NCBI Desc: cen-like protein fdr1 [oryza sativa]
  misc_feature (1)..(173): NCBI GI: 11139708 NCBI Desc: terminal flower 1-like protein [lolium perenne]
  misc_feature (1)..(173): NCBI GI: 115503906 NCBI Desc: tfl1b protein [vitis vinifera]
  misc_feature: The sequence is a functional homolog of SEQ ID NO 2 in US patent 7208653
  misc_feature: Useful for making plants with modulated flowering time
  misc_feature: Functional homolog of the protein sequence given in SEQ ID NO 13637
  misc_feature: The sequence is a functional homolog of SEQ ID NO 2 in US patent 7196246
MSRSVEPLIVGRVIGEVLDSFNPCVKMIVTYNSNKLVFNGHEIYPSAVVSKPRVEVQGGDLRSFFTLVMTDPDVPGPSDPYLREHLHWIVTDIPGTTDASFGREVISYESPRPNIGIHRFIFVLFKQKGRQTVTVPSSRDHFNTRQFAEENDLGLPVAAVYFNAQRETAARRR

SEQ ID NO: 10693 - DNA, 1209 bp, Sorghum bicolor
  misc_feature: Ceres ANNOT ID no. 6114616
  misc_feature: Encodes the peptide sequence at SEQ ID NO 10694
atggggaaggcactaccggccaccgtcgacgagatcaggcgtgcgcagcgcgcggaagggccggccgccgtgctcgccatcggcacggcgaacccgcccacaatcatgccccaggacgactaccccgactactacttccgcgtcaccaacagcgagcacctcaccgacctcaaggccaagctcagcaggatctgcaaccacaacaagtccggcatcaggcagcgctacctgcacctcaacgaggagcttctcgccgccaacccgggcttcatcgaccccaagcggccgtccctggacgagcgcgtggagatggcctccgccgccgtcccggagctggccgcgaaagccgccaccaaggccatcgcggagtggggccgtcccgccaccgacatcacccacctcatcttcagcacctactccggcgcgcgtgccccgagcggagaccgccgcctcgcctccctgctgggcctccgccccaccgtgtcccgcaccatcctcaacctccacggctgctacggcggggggcggtcgctccagctcgccaaggagatcgccgagaacaaccgcggcgcgcgcgtcctcgtcgcctgctccgagctcacgctcatcgccttctacgggcccgagggaggctgcgtcgacaacatcatcggccagaccttgttcggcgacggtgccggcgccgtcgtcgtcggcgccgaccctgacgccgccgtcgagcgcccgctgttcgagatggcgttcgcgacgcagaccacgataccggagagcgaggacgccatctccatgcagtacagcaaatgtggcatggagtaccacctctccagcaaggtgccacgcctgatagggtgcaacgtggaacgctcccttgtcgacacgttccgcacgctcggcgtcaccgccgcatggaatgacctgttctgggcggttcaccccggaggtcgtgccatcctggacaacatcgaggaagtgctcggtctggaggacgacaaactggcggcgagtcgccatgtgctcagtgagtttggcaacatgagtggcaccacggtgatcttcgtgctcgatgagttgcgccgacgtcgggcagcggcggcgaagcagggaggggaaacgccggagtggggagtgctcatggcttttggaccgggaatcacaatcgagaccatagtgctccacaccccaagcaacccggaactggagggaaattga

SEQ ID NO: 10694 - protein, 402 aa, Sorghum bicolor
  misc_feature: Ceres ANNOT ID no. 6114616
  misc_feature (7)..(235): Pfam Id: Chal_sti_synt_N Pfam Desc: Chalcone and stilbene synthases, N-terminal domain
  misc_feature (245)..(395): Pfam Id: Chal_sti_synt_C Pfam Desc: Chalcone and stilbene synthases, C-terminal domain
  misc_feature (294)..(393): Pfam Id: ACP_syn_III_C Pfam Desc: 3-Oxoacyl-[acyl-carrier-protein (ACP)] synthase III C terminal
  misc_feature (8)..(396): NCBI GI: 5732950 NCBI Desc: chalcone synthase [lilium hybrid cv. 'acapulco']
  misc_feature (8)..(396): NCBI GI: 86604613 NCBI Desc: chalcon synthase [lilium speciosum]
  misc_feature (8)..(393): NCBI GI: 21326760 NCBI Desc: chalcone synthase [lilium hybrid division i]
  misc_feature (8)..(393): NCBI GI: 22086369 NCBI Desc: chalcone synthase 11 [rubus idaeus]
  misc_feature (8)..(393): NCBI GI: 22086372 NCBI Desc: chalcone synthase 6 [rubus idaeus]
  misc_feature (8)..(395): SWISSPROT Homolog: EC 2.3.1.74 Chalcone synthase 1
  misc_feature (7)..(393): SWISSPROT Homolog: EC 2.3.1.95 Stilbene synthase 2
  misc_feature (8)..(396): SWISSPROT Homolog: EC 2.3.1.156 Phloroisovalerophenone synthase
  misc_feature: The sequence is a functional homolog of SEQ ID NO 2 in US patent 7202397
MGKALPATVDEIRRAQRAEGPAAVLAIGTANPPTIMPQDDYPDYYFRVTNSEHLTDLKAKLSRICNHNKSGIRQRYLHLNEELLAANPGFIDPKRPSLDERVEMASAAVPELAAKAATKAIAEWGRPATDITHLIFSTYSGARAPSGDRRLASLLGLRPTVSRTILNLHGCYGGGRSLQLAKEIAENNRGARVLVACSELTLIAFYGPEGGCVDNIIGQTLFGDGAGAVVVGADPDAAVERPLFEMAFATQTTIPESEDAISMQYSKCGMEYHLSSKVPRLIGCNVERSLVDTFRTLGVTAAWNDLFWAVHPGGRAILDNIEEVLGLEDDKLAASRHVLSEFGNMSGTTVIFVLDELRRRRAAAAKQGGETPEWGVLMAFGPGITIETIVLHTPSNPELEGN

SEQ ID NO: 10695 - DNA, 840 bp, Sorghum bicolor
  misc_feature: Ceres ANNOT ID no. 6114657
  misc_feature: Encodes the peptide sequence at SEQ ID NO 10696
atggggtcgagcatggcgctagcgctggcgggattctgcttcagcgtgctcttcatcgtcttcgtctgcacgcgcctcgcctgcgcgctcctccgccgccgccgccgctggacccgctcccgccgcgccgccgccgcgacgcccacgctcccgcagcactaccacgccgatcccgaccccttcccgttccacgtcgcccgctactaccaccaccaccaccaccaccaccacgccgccgcggcgggcgcctcacccggcctcgatcccgccgccgtcgccgctttccccacccgcgtctactacgccgccgcagcacaaacctccgacgaatccgacgacgattcccagtgcatcatttgtcttgcagaatacgaagagaaagacgtgctacgcattctgccttactgcagccataatttccacatggcctgtatcgatttatggctggagcagaactcaacctgcccggtctgtagaatctcactgcttgtgcttgataaccctgaaagcgaacacactgcacctcctcttacccctcctcctcctcctcctccccctccactatccagcatagtaataagccctccaagctctcctgaatcgtcgagatcagatccatgccgctgcctgtttgtcagcagtgggcactcatcaagggcatcagaggtggctccaagacatgagcccgaccaggagaatcaggttgtatctggtccatcagtagtggatggggctaacagcttgccgttgcctgaaggtgacccgcctccagaaaataacaacagccagacggtaagaaagcaggtggacagatctacccagctaggaccctgcaaatag

SEQ ID NO: 10696 - protein, 279 aa, Sorghum bicolor
  misc_feature: Ceres ANNOT ID no. 6114657
  misc_feature (117)..(158): Pfam Id: zf-C3HC4 Pfam Desc: Zinc finger, C3HC4 type (RING finger)
  misc_feature (66)..(175): NCBI GI: 124360239 NCBI Desc: zinc finger, ring-type [medicago truncatula]
  misc_feature (82)..(205): NCBI GI: 60389473 NCBI Desc: e3 ubiquitin ligase el5
  misc_feature (82)..(205): NCBI GI: 46391016 NCBI Desc: el5 [oryza sativa (japonica cultivar-group)]
  misc_feature (3)..(182): NCBI GI: 115439793 NCBI Desc: os01g0736600 [oryza sativa (japonica cultivar-group)]
  misc_feature (86)..(208): NCBI GI: 115480585 NCBI Desc: os09g0554200 [oryza sativa (japonica cultivar-group)]
  misc_feature: The sequence is a functional homolog of SEQ ID NO 1133 in the 10/666,642US patent application
  misc_feature: Useful for making plants with modulated growth and phenotype characteristics
  misc_feature: The sequence is a functional homolog of SEQ ID NO 1133 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MGSSMALALAGFCFSVLFIVFVCTRLACALLRRRRRWTRSRRAAAATPTLPQHYHADPDPFPFHVARYYHHHHHHHHAAAAGASPGLDPAAVAAFPTRVYYAAAAQTSDESDDDSQCIICLAEYEEKDVLRILPYCSHNFHMACIDLWLEQNSTCPVCRISLLVLDNPESEHTAPPLTPPPPPPPPPLSSIVISPPSSPESSRSDPCRCLFVSSGHSSRASEVAPRHEPDQENQVVSGPSVVDGANSLPLPEGDPPPENNNSQTVRKQVDRSTQLGPCK

SEQ ID NO: 10697 - DNA, 1566 bp, Sorghum bicolor
  misc_feature: Ceres ANNOT ID no. 6114665
  misc_feature: Encodes the peptide sequence at SEQ ID NO 10698
atgaggcaagccaagtgtgatccggcgatcgccgctgccgtcgtcgtccttctcgtcctcctctacgtgggatcgccggtggtgctcccggtggacggggccaagggagaagaagagctcacgacgcagctcattaacggcttcaccgcgacgcacgcggccgggtccgcggcgacgttcgagccattgctgtacgcgaccagcgccgtcttcgccctgggcttcctccgcgtcggccaggcgtcgctggacctcgccgtggtgcacctcccgtcgtccttccccgtctggcgcgccacgcctgccaacctcggggactggtctcgcccggccacgctcaccttcgacaccagccttgtcctcacggcccacgacggcgccgtgctgtggcggacgctcaacgccgcgggcgacgtcgtggcgctgctcaactcctccaacctcgtcgtgcagcggtacgcgaggccggtgccggcgtggcagagcttcgaccacccgtccgacacgctggtcgtggaccagaacttcaccgcctcgtcgccgccgctcatctccggtaaccgccgcttcgcgctgcggctcgggaagacgtacgtggcgctgcacatggagttcgacggcggccgggcgacgacgacggcgcccgcgtactggaagcacacggcgctcgaggcgcagccggagaacgccacggcgccgccggtctacggccgcctcgacggcctcgggttcttcggcctctacctcgagggcggcggcggccacccgacggtggacgtgctgtcgttcgacacgttcgtcctcaacctcaccggcgtgttccggcggatgacggtagacgacgacggcaacctccgcgcgtactactggtccagcgacgccaaggcgtggacgtcggactacaaggcgatcgcggagcggtgcgagctgccgacgtcgtgcggcgcgtacggcctgtgcgtccccgggaacgcccagtgccagtgcctcgacagtaacggcacgagcaccaccagctccccgccgtgccacgccgtcgaggagaccggcgacctctgcagcaacgggcttcggcagccggacttcgacgtggtgcggcggacgcgggtgtcggtggcgtacaaggaggagctgccggtgcagacgaacacgacggcggagaggtgcgagatggcgtgcgcgcgcaactgcacctgctggggcgcggtgttcaacggcgcgagcgggtactgctacctcatcgacttccccgtggagacgctggtgtaccaggccgacgaccggatggtgggctacttcaagatcaggaaggcggcggcgacggcgacgaggagatcggcgcggcgaggcatgtcgccgggcgttaccgccgcgacggtggtgctgtcgctggtcctggtggcgctggctgcggccggagcgtactggggatacaggatgtgggagaagaggaagaggaaacgggccgggatggagcaggagctggcgccggggccgtacaaggacctcaagtccatggccagctctaacagttcgttcaaaagcagccatgaattccagccatga

SEQ ID NO: 10698 - protein, 521 aa, Sorghum bicolor
  misc_feature: Ceres ANNOT ID no. 6114665
  misc_feature (92)..(191): Pfam Id: B_lectin Pfam Desc: D-mannose binding lectin
  misc_feature (171)..(511): NCBI GI: 7340655 NCBI Desc: s-receptor kinase-like protein [arabidopsis thaliana]
  misc_feature (61)..(412): NCBI GI: 39545725 NCBI Desc: osjnba0071i13.3 [oryza sativa (japonica cultivar-group)]
  misc_feature (63)..(413): NCBI GI: 115441493 NCBI Desc: os01g0885700 [oryza sativa (japonica cultivar-group)]
  misc_feature (18)..(341): NCBI GI: 115468174 NCBI Desc: os06g0494100 [oryza sativa (japonica cultivar-group)]
  misc_feature (81)..(483): NCBI GI: 38344588 NCBI Desc: osjnba0079m09.4 [oryza sativa (japonica cultivar-group)]
  misc_feature: The sequence is a functional homolog of SEQ ID NO. 495 in the 11/188,298 US application
MRQAKCDPAIAAAVVVLLVLLYVGSPVVLPVDGAKGEEELTTQLINGFTATHAAGSAATFEPLLYATSAVFALGFLRVGQASLDLAVVHLPSSFPVWRATPANLGDWSRPATLTFDTSLVLTAHDGAVLWRTLNAAGDVVALLNSSNLVVQRYARPVPAWQSFDHPSDTLVVDQNFTASSPPLISGNRRFALRLGKTYVALHMEFDGGRATTTAPAYWKHTALEAQPENATAPPVYGRLDGLGFFGLYLEGGGGHPTVDVLSFDTFVLNLTGVFRRMTVDDDGNLRAYYWSSDAKAWTSDYKAIAERCELPTSCGAYGLCVPGNAQCQCLDSNGTSTTSSPPCHAVEETGDLCSNGLRQPDFDVVRRTRVSVAYKEELPVQTNTTAERCEMACARNCTCWGAVFNGASGYCYLIDFPVETLVYQADDRMVGYFKIRKAAATATRRSARRGMSPGVTAATVVLSLVLVALAAAGAYWGYRMWEKRKRKRAGMEQELAPGPYKDLKSMASSNSSFKSSHEFQP

SEQ ID NO: 10699 - DNA, 1590 bp, Sorghum bicolor
  misc_feature: Ceres ANNOT ID no. 6114673
  misc_feature: Encodes the peptide sequence at SEQ ID NO 10700
atggcgaagggcgacgacgcgctggcgcggaagcgcaaccgggtgcgccgcaagcgcctccgcagcagcgagaacgctgtctccgcgcgggtcgcggcaatcatcgcctccaagcgccgccgcaagtcggggaagcgccgcggctgcgagggcatgtgcttctcgctccctacgcccgacgacccattcaacgagcgccacggcaagaagcgcaaggtcgatgacgagccgaccgaggacacagccgccgccaaggacggcgacgaccccaagaagaagggcgcgaacaccaaaaaggagcagccggtggcaaaggccggcgccgaggccaaggccaaggccaaggccaagtcgaaggcagttcgcgagagggcgacgggagcggatgagggccgcgtggacttggaccggccctccaagttcctggtggtctgcctcaacgccatccgggacacgctggcgcccgaggacggcggcggcagcattcacggcgccggcgactggggcgtggagctctggcggtgctgctccgcccaggcgccgtccgacgtgctcgacgctagcggcgcgtgcgccacggtggaccagaccgcgtggctcgtctccaccgcctgcgacatcgtcgctaggaaggagaggcttgggatggtcgtgtcctgccccttcctgctgtacctcgtcccgtcccaggagaaggccgcgcaggtgcgatcgatatgcaaacccctgaagcctcttgggattcattcagtgagcttgcatcctggcgcatccattgaacaccagatttctggactgaaaacttgtgagccggagtttcttatagctacccctgagaggcttcttgaacttgtttcgttaaaggcgattgacatatcaagtgtatcaatgctggtcattgatggactgaaatgtttcgtggaccacaatgccagtgacaaaatattttctattagagacgccatatcaaacaatcctcagattactatcttcaccgatccatctgataaaaaggttgcagcaatggctaaaagcctactccgtggaagaattacaaagctttctatcaatgattctgtttcttcacgaagtgcatttatagcccagcatgtacacttctgtccatcagaggagctgaaaacatcaaaggtcaaggaaattcttgaggggatattgcaaagtcatcctaaaaagacatcgaaggttcttctagtagtcgcaaacgatcaaaaagcgcgatacatgtcatcgtcacttaagctgaaaaattgcacagtgattgatgattcacatggcagctcttttacgatatgcagcagtttggggctgatgaatgtcattgtgaaagatcgggagaacatggcagtgacagatgcagaggaatttgaaacagtgctggtggtggatctgcctccttcagtcgacgaatatgttgagatcctcactggggttgctcttcatgtgattggaggcgaagtgcatagtatattctgtaacgctgatgcgtctattgcaaaacctctggcggagcttcttgcagattgccgtcaggtggtgcctgagtttttcaaaaacctggagtcttcatag

SEQ ID NO: 10700 - protein, 529 aa, Sorghum bicolor
  misc_feature: Ceres ANNOT ID no. 6114673
  misc_feature (193)..(349): Pfam Id: DEAD Pfam Desc: DEAD/DEAH box helicase
  misc_feature (223)..(524): NCBI GI: 74660558 NCBI Desc: atp-dependent rna helicase dbp3
  misc_feature (223)..(521): NCBI GI: 6321360 NCBI Desc: dbp3p [saccharomyces cerevisiae]
  misc_feature (223)..(521): NCBI GI: 74656726 NCBI Desc: atp-dependent rna helicase dbp3
  misc_feature (221)..(521): NCBI GI: 143359932 NCBI Desc: pre-mrna-processing atp-dependent rna helicase prp5
  misc_feature (221)..(529): NCBI GI: 60115445 NCBI Desc: p68 rna helicase [tubifex tubifex]
MAKGDDALARKRNRVRRKRLRSSENAVSARVAAIIASKRRRKSGKRRGCEGMCFSLPTPDDPFNERHGKKRKVDDEPTEDTAAAKDGDDPKKKGANTKKEQPVAKAGAEAKAKAKAKSKAVRERATGADEGRVDLDRPSKFLVVCLNAIRDTLAPEDGGGSIHGAGDWGVELWRCCSAQAPSDVLDASGACATVDQTAWLVSTACDIVARKERLGMVVSCPFLLYLVPSQEKAAQVRSICKPLKPLGIHSVSLHPGASIEHQISGLKTCEPEFLIATPERLLELVSLKAIDISSVSMLVIDGLKCFVDHNASDKIFSIRDAISNNPQITIFTDPSDKKVAAMAKSLLRGRITKLSINDSVSSRSAFIAQHVHFCPSEELKTSKVKEILEGILQSHPKKTSKVLLVVANDQKARYMSSSLKLKNCTVIDDSHGSSFTICSSLGLMNVIVKDRENMAVTDAEEFETVLVVDLPPSVDEYVEILTGVALHVIGGEVHSIFCNADASIAKPLAELLADCRQVVPEFFKNLESS

SEQ ID NO: 10701 - DNA, 1584 bp, Sorghum bicolor
  misc_feature: Ceres ANNOT ID no. 6114689
  misc_feature: Encodes the peptide sequence at SEQ ID NO 10702
atgcattccaccaaccttttgctcgaggagcccatccggatggcctccatcctcgagccatccaagaccagcttcttcccggcgatgaccaagatcgtcggcacgctcgggcccaagtcccgctccgtcgacaccatctcctcctgcctcaaggccggcatgtccgtcgctcgcttcgatttctcgtggggagacgctgcctaccaccaggagacgctcgagaacctcaagctcgccatcaagtccaccaagaagctctgcgctgttatgcttgacacggttggaccggagctgcaggtggtcaacaagagtgagacccccatctcccttgaggagaacgggactgtcgtgctcacgccgcatcagggccaagaagccacctccaccttgctgcccatcaacttctctgggctcgccaaggctgtgacaccaggtgcaacaatatttgtgggtcaatacttgttcaccggtagcgagactacttcagtttggttggaggtttctgaagttaaaggagacgatgtggtttgtataatcaagaacacagctaccttggctgggtcactcttcacactgcattgctcccagatccatattgacttgcccacgctgtctcatgaggataaggatgttatcaaaaaatggggtgctccaaataagattgacttcctctctttgtcttacacaagacatgcagaagatgtgcggcaggcacgcgagtacctctcgaaattgggtgatcttagccaaactcagatttttgccaaaattgagaatgttgagggcttgaaccattttgatgaaatactggcagaggcagatggtatcattctgtcaagaggaaacctaggaattgaccttccacctgagaaggtctttctgtttcaaaagtctgcgcttcacaagtgcaacatggctggaaagcctgctgttgttactcgtgtcgtggacagcatgactgacaacctcaggcctactcgtgcggaggcaactgatgtggcaaatgcagttctcgatgggagtgatgccattctccttggtgctgagactctccgtggtttatatccagtggagactatttcaacagtgggcagaatttgtgctgaggctgagaaggtattcaaccaagatttatactacaagcgaactgtgaagtatgtgggagaacctatgacccacttggagtctattgcttcctcagcagtgcgagctgctatcaaagttaaggcatcagtcatcatttgcttcacctcttctggacgggctgcaaggctcattgccaagtacaggcccaacatgcctgttctttctgttgtcattcctcgtctgaagacaaaccaactgaggtggagtttcacaggtgcttttgaggcaaggcaatcactcatagttaggggcctcttccctatgcttgctgatccacggcatccagctgaatctaccagtgctacaaatgagtctgtgttgaaggttgctcttgaccatggcaaagcctcgggtgtcatcaagtcccatgaccgtgtcgttgtttgccagaaagtgggtgattcctctgttgtgaagatcattgagctggatgattag

SEQ ID NO: 10702 - protein, 527 aa, Sorghum bicolor
  misc_feature: Ceres ANNOT ID no. 6114689
  misc_feature (30)..(379): Pfam Id: PK Pfam Desc: Pyruvate kinase, barrel domain
  misc_feature (394)..(524): Pfam Id: PK_C Pfam Desc: Pyruvate kinase, alpha/beta domain
  misc_feature (1)..(527): NCBI GI: 77548686 NCBI Desc: pyruvate kinase [oryza sativa (japonica cultivar-group)]
  misc_feature (1)..(527): NCBI GI: 77553678 NCBI Desc: pyruvate kinase, barrel domain [oryza sativa (japonica cultivar-group)]
  misc_feature (37)..(527): NCBI GI: 20562907 NCBI Desc: pyruvate kinase-like [deschampsia antarctica]
  misc_feature (1)..(527): NCBI GI: 92887883 NCBI Desc: pyruvate kinase [medicago truncatula]
  misc_feature (1)..(527): NCBI GI: 23308151 NCBI Desc: at2g36580/f1o11.21 [arabidopsis thaliana]
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEATSTLLPINFSGLAKAVTPGATIFVGQYLFTGSETTSVWLEVSEVKGDDVVCIIKNTATLAGSLFTLHCSQIHIDLPTLSHEDKDVIKKWGAPNKIDFLSLSYTRHAEDVRQAREYLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPNMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 10703 - DNA, 1425 bp, Sorghum bicolor
  misc_feature: Ceres ANNOT ID no. 6114691
  misc_feature: Encodes the peptide sequence at SEQ ID NO 10704
atgccgctgggctcgcccgtgaagcgcctgctgcggcgtgcggccaaggggaggctagacaaggccgagctggcggtggcggggctggccgcggcggccgccgcgctgctgctgctcctcctctgcgcctcctcgctccgctgctcggccgccgcgctggtgtccgcgcacgggaggctctgggccggcggggtctccatcgctgctgcttcggacgcggatgcggcggcggatgtcgacaagcggcccgtctccgcaccggctactgcggcggcggggagtggtggcgacgacgaggaggagtgcgacctgttcgacggggagtgggtctcggctggtggcggcgggtacccgctctacgactccagggactgcccgttcctcgacgtcggcttccgctgcgccgagaacggccgccccgacacgtcctacaccaagtggcgctggcagccgtcgcgatgccatctccccagatttgatgccaaaagcatgctggagaagctacgaaacaaaagagtagtttttgttggtgattcaattggaaggaaccaatgggagtctctactttgtatgctctctagtgctgttcataacaagagctctatctatgaagttaatgggaatcccatcacaaagcacatgggtttcttgattttcaactttacagactacaattgcactgtggaatactacagatccccctttatagtccttcaaggtcgtccaccagcaggagcccctgagattgttaggtacagtattcgagtggatgcaatggattggatgtctgaccggggtaagtggaaggatgctgatgtattgatcttcaacactgggcattggtggaacaatgagaaaacaatcagggggggtgcctactttcaagtaggagatgaggtcaaaatgggcatgactgttgcagatgcttacagaaggtcgatacagacattgtctgattggcttcacaaagaagttaacacaagcaagacccatgtcatctaccgtacatatgctcctgtgcatttcagaggtggtgactggaagactggtgggagctgtcacttagaaactcttccagatgtgatgccagtgaagtccctggatgaatgggctgacttgcttcagcccgtgaatgattttctagggagcaacctcagatccaagttggttggattagacctgcttaatgtgacgagaatgacagctcagagaaaagacggccacctctcagtatacctgagcccttcaggacctgtccctcgctacaaacaggattgcagccactggtgccttcctggagttcctgatacctggaatgagcttctctacgcccttgtcatgagaaagcatgagaagatgggtcagaatgcttcccttgctagcactaggacactgcacactgaagatggaaatgtcttcagctga

SEQ ID NO: 10704 - protein, 474 aa, Sorghum bicolor
  misc_feature: Ceres ANNOT ID no. 6114691
  misc_feature (152)..(465): NCBI GI: 115484169 NCBI Desc: os11g0148200 [oryza sativa (japonica cultivar-group)]
  misc_feature (102)..(455): NCBI GI: 51091192 NCBI Desc: lustrin a-like [oryza sativa (japonica cultivar-group)]
  misc_feature (102)..(455): NCBI GI: 115467002 NCBI Desc: os06g0207500 [oryza sativa (japonica cultivar-group)]
  misc_feature (90)..(442): NCBI GI: 56784629 NCBI Desc: leaf senescence related protein-like [oryza sativa (japonica cultivar-group)]
  misc_feature (89)..(447): NCBI GI: 115464003 NCBI Desc: os05g0426300 [oryza sativa (japonica cultivar-group)]
MPLGSPVKRLLRRAAKGRLDKAELAVAGLAAAAAALLLLLLCASSLRCSAAALVSAHGRLWAGGVSIAAASDADAAADVDKRPVSAPATAAAGSGGDDEEECDLFDGEWVSAGGGGYPLYDSRDCPFLDVGFRCAENGRPDTSYTKWRWQPSRCHLPRFDAKSMLEKLRNKRVVFVGDSIGRNQWESLLCMLSSAVHNKSSIYEVNGNPITKHMGFLIFNFTDYNCTVEYYRSPFIVLQGRPPAGAPEIVRYSIRVDAMDWMSDRGKWKDADVLIFNTGHWWNNEKTIRGGAYFQVGDEVKMGMTVADAYRRSIQTLSDWLHKEVNTSKTHVIYRTYAPVHFRGGDWKTGGSCHLETLPDVMPVKSLDEWADLLQPVNDFLGSNLRSKLVGLDLLNVTRMTAQRKDGHLSVYLSPSGPVPRYKQDCSHWCLPGVPDTWNELLYALVMRKHEKMGQNASLASTRTLHTEDGNVFS

SEQ ID NO: 10705 - DNA, 1251 bp, Sorghum bicolor
  misc_feature: Ceres ANNOT ID no. 6114693
  misc_feature: Encodes the peptide sequence at SEQ ID NO 10706
atggccgccgtcacgctgctcgcgctcggcaacggcgcgcccgacgcgttcgcctccgccgccgcgctcggcgggccacgagggatgcccagggccgggctcgccgccatcctctccgcgggcgccttcgtctccgccttcgtcgtcggggctgttgcgctcatcgccgcgcccttcgctgtcccgccggcgtcgttcgcgcgtgacgtcttcttctacctcgtcgctgcgtcggggctgttctatgtctacctcagcgctgagatcttcctctggcaggctgttgggctcgtgctcttctatgctttcttcgtggggctagtgttctacatggatttgggtagcgcggaggggaaagcggtcagcgccgcggcagctgagctggagatggtgagtggcagtggccgtgtggccgtggacctgccgatcacagtggaggatcgccggcaacaacgacaccctgctttttgtgcgttgctctggaaggtaacagaagtttgggagtggcccattgcatttgttctgaagcttacaataccatcaacccttccttctgagtggagcaaagtttacatcagtgcaaatatatgtctgtgtcctctcttagttctgtattctttcagttcgttcattcctctagatacccgaatagtgtttcttctccctcaaatccgtttccctctatggtctgttgtgcttttcgctagcttttgtttagctctatcccattaccttttcgagaaagaagccccagaaacagaaaacattgcaagcaccatcatctcttttattatgagtgtcttctggatctcgaccatggctggagagctcctgaactgccttgccgcaattggagtcatcatggatttccctccagctatactcgggatgacagttttggcatgggggaactctgtgggagaccttgttgcagatgtagcgctggccaaggctgggcaacctacaattgccatcgctggctgctttgctggtccgatgttcaatatgctggttggattgggaactgcccttgtagtacaaacagcaagagtgtatcccagggcttttgtacttgaattccatgttggaattgtcgttgcatttgtgtttcttcttctgagcttgatgggcaccctgttggtggtcacctgggctaggtttcgggtacccagattttggggctactgccttatgggtatatacatcttgtttaccatagtcagtattgccattgcaagttcttcaggatga

SEQ ID NO: 10706 - protein, 416 aa, Sorghum bicolor
  misc_feature: Ceres ANNOT ID no. 6114693
  misc_feature (268)..(408): Pfam Id: Na_Ca_ex Pfam Desc: Sodium/calcium exchanger protein
  misc_feature (1)..(412): NCBI GI: 124359718 NCBI Desc: sodium/calcium exchanger membrane region [medicago truncatula]
  misc_feature (1)..(169): NCBI GI: 115484167 NCBI Desc: os11g0148000 [oryza sativa (japonica cultivar-group)]
  misc_feature (159)..(409): NCBI GI: 110665634 NCBI Desc: solute carrier family 24 member 6 [bos taurus]
  misc_feature (161)..(409): NCBI GI: 47571313 NCBI Desc: na+/ca2+ k+ independent exchanger [homo sapiens]
  misc_feature (1)..(409): NCBI GI: 18483233 NCBI Desc: k-exchanger-like protein [sorghum bicolor]
MAAVTLLALGNGAPDAFASAAALGGPRGMPRAGLAAILSAGAFVSAFVVGAVALIAAPFAVPPASFARDVFFYLVAASGLFYVYLSAEIFLWQAVGLVLFYAFFVGLVFYMDLGSAEGKAVSAAAAELEMVSGSGRVAVDLPITVEDRRQQRHPAFCALLWKVTEVWEWPIAFVLKLTIPSTLPSEWSKVYISANICLCPLLVLYSFSSFIPLDTRIVFLLPQIRFPLWSVVLFASFCLALSHYLFEKEAPETENIASTIISFIMSVFWISTMAGELLNCLAAIGVIMDFPPAILGMTVLAWGNSVGDLVADVALAKAGQPTIAIAGCFAGPMFNMLVGLGTALVVQTARVYPRAFVLEFHVGIVVAFVFLLLSLMGTLLVVTWARFRVPRFWGYCLMGIYILFTIVSIAIASSSG

SEQ ID NO: 10707 - DNA, 1260 bp, Sorghum bicolor
  misc_feature: Ceres ANNOT ID no. 6114717
  misc_feature: Encodes the peptide sequence at SEQ ID NO 10708
atgagcatctcggtgaacgggcagtcgtgcgtgccgccggggttccggttccacccgacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggcccccagaacgactggtacttcttcagccacaaggacaagaagtacccgacggggacgcgcacgaaccgcgccacggcggccggattctggaaggccaccggccgcgacaaggccatctacaacgccgtcaagcgcatcggcatgcgcaagacgctcgtcttctacaagggccgcgcgccgcacggccagaaatcagactggattatgcatgagtaccgcctcgacgaccctgccgcctccggcgatgccgccgccgccgctaccgctgccgctgccgccacggtcgccgctgcggctgcgtcgtcggacggtgggcaggaggacgcctgggtggtgtacagggtgttcaagaagaagcaccaccacaaggagtcatcaggcggaggcgggggcagcaagcacggcggcagtaacaacgagcacgggcacggcggcggcaaggcggcggcggctgctgcggcggcggcgcaccagcaccacggcggtctgcagtactcctccagcgacgacgcgctggaccagatcctgcagtacatgggcaggtcgtgcaagcaggagcacgagctgctgtcgccgccgccgccggggcgtgcggcgtccaggtacctccggcccatcgagaccgtgctgggcgggcacgggttcatgaagctgcccccgctcgagagcccgtcggccgcggcggcgatgaccccgcaagccgtctcaggcgacgccggggtcgtcgacgacctcctcggcctccaccgcggcgggattgggaacgggatcacggactgggccatgatggaccggctggtggcgtcgcacctcaacgggcaggaggcgcccgacgtcgcgcccgccgcggaccagctcggcagctgcttcgacgacgccaccggcgccgacgacgcggacgccgccggcctcgccttctactcggccgccgccaacaggctgctcgtcggatccgccggctccagcggcgccggcagcgacgacgacctgtggagcttcacgcggtcgtcggccgcggccgcggccgcaacgtcgacagagcggctcagccacgtctcactgtag

SEQ ID NO: 10708 - protein, 419 aa, Sorghum bicolor
  misc_feature: Ceres ANNOT ID no. 6114717
  misc_feature (11)..(140): Pfam Id: NAM Pfam Desc: No apical meristem (NAM) protein
  misc_feature (1)..(203): NCBI GI: 30690500 NCBI Desc: no apical meristem (nam) family protein [arabidopsis thaliana]
  misc_feature (1)..(203): NCBI GI: 3510262 NCBI Desc: nam (no apical meristem)-like protein [arabidopsis thaliana]
  misc_feature (1)..(196): NCBI GI: 115466196 NCBI Desc: os06g0131700 [oryza sativa (japonica cultivar-group)]
  misc_feature (1)..(205): NCBI GI: 21536577 NCBI Desc: nam-like protein [arabidopsis thaliana]
  misc_feature (1)..(205): NCBI GI: 6899889 NCBI Desc: nam-like protein [arabidopsis thaliana]
  misc_feature: The sequence is a functional homolog of SEQ ID NO 1270 in the 10/374,780US patent application
  misc_feature: The sequence is a functional homolog of SEQ ID NO 1378 in the 10/666,642US patent application
  misc_feature: The sequence is a functional homolog of SEQ ID NO 142 in the 10/412,699US patent application
  misc_feature: The sequence is a functional homolog of SEQ ID NO 1423 in the 10/412,699US patent application
  misc_feature: The sequence is a functional homolog of SEQ ID NO 160 in the 10/666,642US patent application
  misc_feature: The sequence is a functional homolog of SEQ ID NO 1750 in the 10/412,699US patent application
  misc_feature: The sequence is a functional homolog of SEQ ID NO 194 in the 10/374,780US patent application
  misc_feature: The sequence is a functional homolog of SEQ ID NO 286 in the 11/435,388US patent application
  misc_feature: The sequence is a functional homolog of SEQ ID NO 288 in the 10/714,887US patent application
  misc_feature: The sequence is a functional homolog of SEQ ID NO 333 in the 11/479,226US patent application
  misc_feature: The sequence is a functional homolog of SEQ ID NO 38 in the 10/374,780US patent application
  misc_feature: The sequence is a functional homolog of SEQ ID NO 54 in the 10/225,068US patent application
  misc_feature: The sequence is a functional homolog of SEQ ID NO 586 in the 10/225,066US patent application
  misc_feature: The sequence is a functional homolog of SEQ ID NO 634 in the 10/412,699US patent application
  misc_feature: The sequence is a functional homolog of SEQ ID NO 638 in the 11/435,388US patent application
  misc_feature: The sequence is a functional homolog of SEQ ID NO 898 in the 10/225,066US patent application
  misc_feature: The sequence is a functional homolog of SEQ ID NO 898 in the 10/666,642US patent application
  misc_feature: Useful for making plants with altered cell wall content and/or composition
  misc_feature: Useful for making plants with altered lignin content
  misc_feature: Useful for making plants with modulated growth and phenotype characteristics
  misc_feature: Functional homolog of the protein sequence encoded by LOCUS at1g32770
  misc_feature: The sequence is a functional homolog of SEQ ID NO 142 in the 20040045049 US patent application
  misc_feature: The sequence is a functional homolog of SEQ ID NO 1423 in the 20040045049 US patent application
  misc_feature: The sequence is a functional homolog of SEQ ID NO 634 in the 20040045049 US patent application
  misc_feature: The sequence is a functional homolog of SEQ ID NO 898 in the 20050160493 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MSISVNGQSCVPPGFRFHPTEEELLNYYLRKKVASQEIDLDVIRDVDLNKLEPWDIQEKCKIGSGPQNDWYFFSHKDKKYPTGTRTNRATAAGFWKATGRDKAIYNAVKRIGMRKTLVFYKGRAPHGQKSDWIMHEYRLDDPAASGDAAAAATAAAAATVAAAAASSDGGQEDAWVVYRVFKKKHHHKESSGGGGGSKHGGSNNEHGHGGGKAAAAAAAAAHQHHGGLQYSSSDDALDQILQYMGRSCKQEHELLSPPPPGRAASRYLRPIETVLGGHGFMKLPPLESPSAAAAMTPQAVSGDAGVVDDLLGLHRGGIGNGITDWAMMDRLVASHLNGQEAPDVAPAADQLGSCFDDATGADDADAAGLAFYSAAANRLLVGSAGSSGAGSDDDLWSFTRSSAAAAAATSTERLSHVSL

SEQ ID NO: 10709 - DNA, 459 bp, Sorghum bicolor
  misc_feature: Ceres ANNOT ID no. 6115097
  misc_feature: Encodes the peptide sequence at SEQ ID NO 10710
atggagtacggtcagcagggacagcacggccacggcaccaccggccgtgtcgaccagtacggcaaccctgtcggcgccggaaccggtggcatggggaccgggaccggcggcatggggcagctgggtgagcacggcggcgctggcatgggtggcgggcagttccagccagcgagggaggagcataagaccggcggcatcctgcatcgctccggcagctccagctccagctcgtctgaggacgacggcatgggcggaaggaggaagaagggaatcaaggagaagatcaaggagaagctgcccggaggccacaaggacaaccagcacgccacggcgaccggcggcggcgccgcctacgggcagcaagaacacaccggcgccggaacctacggtaccgagggcaccggcgagaagaaaggcatcatggacaagatcaaggagaagctgcccggacagcactaa

SEQ ID NO: 10710 - protein, 152 aa, Sorghum bicolor
  misc_feature: Ceres ANNOT ID no. 6115097
  misc_feature (14)..(152): Pfam Id: Dehydrin Pfam Desc: Dehydrin
  misc_feature (1)..(152): NCBI GI: 18964 NCBI Desc: dehydrin [zea mays]
  misc_feature (1)..(152): NCBI GI: 126632258 NCBI Desc: rab17 protein [zea mays]
  misc_feature (1)..(152): NCBI GI: 126632260 NCBI Desc: rab17 protein [zea mays]
  misc_feature (1)..(152): NCBI GI: 295856 NCBI Desc: rab-17 [zea mays]
  misc_feature (1)..(152): NCBI GI: 239236 NCBI Desc: rab-17 protein=substrate for casein kinase 2 [zea mays l.=maize, line w64 a, peptide, 168 aa]
MEYGQQGQHGHGTTGRVDQYGNPVGAGTGGMGTGTGGMGQLGEHGGAGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 10711 - DNA, 1038 bp, Sorghum bicolor
  misc_feature: Ceres ANNOT ID no. 6115144
  misc_feature: Encodes the peptide sequence at SEQ ID NO 10712
atggagcagcggagatggctcgcggcttccgttttgatgtgcctgctggtgctttgctccgggagagacctgaagaccaaacatgcgcccatatatgaccctgggcttgcccggacacttgctgaatatacttctgctgtctatactgctgacctgagccaactgtttacatggacgtgtgaaagatgttgtgacttaacagaggggttcgaggtgatagagttgattgttgatgtgaaaaattgcttacaggcatatgttggatttgctagagacatgaatgcagttatagttgggttcaggggcactcaagaaaacagcattcagaactggatcgaagatttattctggaaacaacttgatctcgactacccaggcatgcctgaagcaaaggttcacagtggattttattctgcttaccataacacaacaatgcgtgatggagttgtcagaggtattaaaagtactagggaactgtatggtgatgttcccatcatggtcacaggacattccatgggaggcgctatggcttcattttgcgctcttgatcttgttgttaatcttgggttcaaggatgttacactcatgacatttgggcaacctcggattggcaatgctatatttgcttctaatttcaaaagatatttgccgaatgcaattcgagtgaccaatgaacatgatattgtacctcatttacccccatactatcactactttccacaaaagacataccaccatttcccacgagaggtatggattcataatgttggcctaggaagcctcatcatatattcgatcgaggaaatttgtgatgattctggagaagacccgacttgtagcaggtctgtgagtggaaacagcgtgcatgaccatatacactatcttggcatcagcatgcatgccgagtcatggggacattgcagaatcgtcacggacaatagaaccctgccacagcagtataagatggatcctgatggcaatataatcttgtcgaagcagcctggcttatcagtgaatgaactacacagtgcacaatga

SEQ ID NO: 10712 - protein, 345 aa, Sorghum bicolor
  misc_feature: Ceres ANNOT ID no. 6115144
  misc_feature (97)..(237): Pfam Id: Lipase_3 Pfam Desc: Lipase (class 3)
  misc_feature (1)..(345): NCBI GI: 21425569 NCBI Desc: triacylglycerol lipase [triticum aestivum]
  misc_feature (1)..(345): NCBI GI: 21425571 NCBI Desc: triacylglycerol lipase [triticum aestivum]
  misc_feature (1)..(332): NCBI GI: 15238889 NCBI Desc: lipase class 3 family protein [arabidopsis thaliana]
  misc_feature (1)..(332): NCBI GI: 50198977 NCBI Desc: at5g18630 [arabidopsis thaliana]
  misc_feature (21)..(334): NCBI GI: 77552336 NCBI Desc: triacylglycerol lipase [oryza sativa (japonica cultivar-group)]
MEQRRWLAASVLMCLLVLCSGRDLKTKHAPIYDPGLARTLAEYTSAVYTADLSQLFTWTCERCCDLTEGFEVIELIVDVKNCLQAYVGFARDMNAVIVGFRGTQENSIQNWIEDLFWKQLDLDYPGMPEAKVHSGFYSAYHNTTMRDGVVRGIKSTRELYGDVPIMVTGHSMGGAMASFCALDLVVNLGFKDVTLMTFGQPRIGNAIFASNFKRYLPNAIRVTNEHDIVPHLPPYYHYFPQKTYHHFPREVWIHNVGLGSLIIYSIEEICDDSGEDPTCSRSVSGNSVHDHIHYLGISMHAESWGHCRIVTDNRTLPQQYKMDPDGNIILSKQPGLSVNELHSAQ

SEQ ID NO: 10713 - DNA, 1434 bp, Sorghum bicolor
  misc_feature: Ceres ANNOT ID no. 6115161
  misc_feature: Encodes the peptide sequence at SEQ ID NO 10714
atgggagggtgcttctccttggacggcgacgtgcgcggcggcatggaggccgtcggcggcggcgtgacagcggcgtctgcgcagcagggcgggctgaacgacgcggtcgactatttcttccagacgcgcggcctccgcggcctctacacgcccatcgagctatcattttcagcatcgaaattgcggaatttagatgccttttcaaagagtgatcctatgctagtggtctacactaacataaaaggaaagctagaggagattggccgtactgaagtgattttaaattcactggagccctcatggatcacaaaggttacaatgtcttaccaatttgagattgtgcaaccattcatattcaggatatatgatgttgacacaaagtaccacaacactccagtgaagatgttgaatttgtctcagcaagattttctgggggaagcatgctgcaacttatcagagattgtaacaaaatttaaccatagcctcacattgaatcttcggagtgattgtggacatggtcttcatggaacaatcacagtacacgctgaagaaagtgactcctctagaatggcagttgagatgactctgcgttgcttaaacttggaaaacaaagatgtgttctccaaaagtgataacccactgctagttgagtgttttgatttcaattccagtggagaccatgtactgataggggccttccagacaactattactcagcttgaaagtctatatacctcaaagtctggagcaaatttttacagccacaagggacaaagaaaggcaatactcggggttggcgaagttctgcagttttatgacactgataggcgatttcctgcatggggttttggagcaagggcacaaggtcacatatcacattgttttaacttgaatacagctactaatgactgtgaggtggttggagttgaaggcattatgtcagcatacacctcttctctttacagtgtttcccttgctgggccgactatgttcgggcccgtgatcaacaaagctgcagaaattgcaagccagtcccttcaatattcaaacaataaatattttgtccttctcattatcacggatggagttctcactgacatccaagaaacaaaagattgtattgtaagggcatctgacctgccattgtcgattctcatcgtcggcgttggaaatgctgatttcaaacaaatggagatcttggacgcggacaacggtaagcgactggaaagctctactggcaggatcgcgacacgcgacatcgtccagtttgtccccatgagggaagtccaaggtggggagatctccgtcgtgcaatctcttctggaggaactccccggtcagttcctgcactacatgcgcactcgcgggatcaagccacagcagcagcagggggcggggcttgcttcagcgcccgtttaccctcctcagcagtga

SEQ ID NO: 10714 - protein, 477 aa, Sorghum bicolor
  misc_feature: Ceres ANNOT ID no. 6115161
  misc_feature (242)..(390): Pfam Id: Copine Pfam Desc: Copine
  misc_feature (52)..(148): Pfam Id: C2 Pfam Desc: C2 domain
  misc_feature (1)..(475): NCBI GI: 115463533 NCBI Desc: os05g0373300 [oryza sativa (japonica cultivar-group)]
  misc_feature (259)..(459): NCBI GI: 79339171 NCBI Desc: bon3 (bonzai 3) [arabidopsis thaliana]
  misc_feature (259)..(459): NCBI GI: 7576168 NCBI Desc: copine-like protein [arabidopsis thaliana]
  misc_feature (259)..(459): NCBI GI: 55824367 NCBI Desc: bon2 [arabidopsis thaliana]
  misc_feature (239)..(463): NCBI GI: 124360145 NCBI Desc: c2; von willebrand factor, type a; copine [medicago truncatula]
MGGCFSLDGDVRGGMEAVGGGVTAASAQQGGLNDAVDYFFQTRGLRGLYTPIELSFSASKLRNLDAFSKSDPMLVVYTNIKGKLEEIGRTEVILNSLEPSWITKVTMSYQFEIVQPFIFRIYDVDTKYHNTPVKMLNLSQQDFLGEACCNLSEIVTKFNHSLTLNLRSDCGHGLHGTITVHAEESDSSRMAVEMTLRCLNLENKDVFSKSDNPLLVECFDFNSSGDHVLIGAFQTTITQLESLYTSKSGANFYSHKGQRKAILGVGEVLQFYDTDRRFPAWGFGARAQGHISHCFNLNTATNDCEVVGVEGIMSAYTSSLYSVSLAGPTMFGPVINKAAEIASQSLQYSNNKYFVLLIITDGVLTDIQETKDCIVRASDLPLSILIVGVGNADFKQMEILDADNGKRLESSTGRIATRDIVQFVPMREVQGGEISVVQSLLEELPGQFLHYMRTRGIKPQQQQGAGLASAPVYPPQQ

SEQ ID NO: 10715 - DNA, 1527 bp, Sorghum bicolor
  misc_feature: Ceres ANNOT ID no. 6115164
  misc_feature: Encodes the peptide sequence at SEQ ID NO 10716
atggggaaggaggagcgcgaggggcagcagcagcgggagcagccgacgccggcggagggaggcgcagggggaagcggcggaggaggaagaggagggcggtgtagccgtgggtgctgcggggccgtgcggccgcaatgcgcggccgcgctgctgctcggcgccgccgtggctctctccgcgctcttcctgctgccgcccttcgtggggcgcggcgacggccgcgcggcggcgcgggatccgagcgcagcgttcgcagctgatattgtggcaagctttatgctacaaaagacagtttctgagttgagtgaaagtacatctaagcttgaatttgacatctatgaggaagttggcgttcctaattcaactgtgaccataaattttctacaaccattaggcgcatccaactggacaaatgtgatcttcaccattgtaccttatccagtacactcaactatatcaccaacttggttgagcattcttaggtcttcttttatgtccttggttgtggagcagtcgacactccacctgacagagtctctatttggggcctcttcaaattttgaggtgtttaagttccctggaggaattaccattatccctccacaggctgcatttcttcttcagaaaccctatgcatctttcaacttcactctgaatttcccaatctacaaagtacaggaggaaacaaatgagttgaaagaccaaatgaagtctggactacgtctcaatccctatgagaacctctacatcaaattgacgaattcaaaaggttcaacggttgctcctccaacaattgttcaggcctcgattgttcttgaagttgggaatcaccagccatcccttccaaggatgaagcagttggcccaaacaattgctaattcatcgtcaggaaacttgggactgaatcacactgtgtttggcagagtaaagcagataagcctttcgtcttatcttacacattctttgcacagtggaggtggtactgacacacctagtccagcacctataccttatcaagatcatcctcagcaccaccaccaccaccaccaccaccaccatgaacaccaccaccataacaagagtcaagaggaaaagaagcattttgctccatctcctgctcctgtacattctcctgtccaacagcccaaatatatatctccatccccatcctgtccatatggatataccaccaagccaaagaataaagctcctgtagccccagctgctgagccagtagctagtaaccatcattatgcttcccctgcaaccataccccatgcagtgcctccaccatccattagcccaaccccctcttttaatcactcttctcctaataatcctaggagagacaacagctctcctgctccttcccctgcacttgcgaagccccatttgcgtggagtacctctcgttcatggacatcatcatgctcaaatgccagcagcggctcctgcatatgccacccgtaggcactcgtgccattggaccctggcactcctgatgtatatgctgatgggtctgccatga

SEQ ID NO: 10716 - protein, 508 aa, Sorghum bicolor
  misc_feature: Ceres ANNOT ID no. 6115164
  misc_feature (10)..(495): NCBI GI: 115463537 NCBI Desc: os05g0373500 [oryza sativa (japonica cultivar-group)]
  misc_feature (1)..(507): NCBI GI: 57900395 NCBI Desc: hydroxyproline-rich glycoprotein-like [oryza sativa (japonica cultivar-group)]
  misc_feature (22)..(458): NCBI GI: 42563995 NCBI Desc: zinc finger (c3hc4-type ring finger) family protein [arabidopsis thaliana]
  misc_feature (22)..(447): NCBI GI: 51535954 NCBI Desc: hydroxyproline-rich glycoprotein-like protein [oryza sativa (japonica cultivar-group)]
  misc_feature (13)..(406): NCBI GI: 46805446 NCBI Desc: ring zinc finger protein-like [oryza sativa (japonica cultivar-group)]
MGKEEREGQQQREQPTPAEGGAGGSGGGGRGGRCSRGCCGAVRPQCAAALLLGAAVALSALFLLPPFVGRGDGRAAARDPSAAFAADIVASFMLQKTVSELSESTSKLEFDIYEEVGVPNSTVTINFLQPLGASNWTNVIFTIVPYPVHSTISPTWLSILRSSFMSLVVEQSTLHLTESLFGASSNFEVFKFPGGITIIPPQAAFLLQKPYASFNFTLNFPIYKVQEETNELKDQMKSGLRLNPYENLYIKLTNSKGSTVAPPTIVQASIVLEVGNHQPSLPRMKQLAQTIANSSSGNLGLNHTVFGRVKQISLSSYLTHSLHSGGGTDTPSPAPIPYQDHPQHHHHHHHHHHEHHHHNKSQEEKKHFAPSPAPVHSPVQQPKYISPSPSCPYGYTTKPKNKAPVAPAAEPVASNHHYASPATIPHAVPPPSISPTPSFNHSSPNNPRRDNSSPAPSPALAKPHLRGVPLVHGHHHAQMPAAAPAYATRRHSCHWTLALLMYMLMGLP

SEQ ID NO: 10717 - DNA, 1317 bp, Sorghum bicolor
  misc_feature: Ceres ANNOT ID no. 6115165
  misc_feature: Encodes the peptide sequence at SEQ ID NO 10718
atgggcgaggtacacgaagctgacaagaatattgagatctggagggtcaagaagttaatcaaggcgcttgatgctgcaaggggcaatggcactagcatgatttctctcatcatgccacctcgtgatcagatttcacgcgtcactaagatgctgggtgatgagtatggaactgcctcaaacatcaagagcagagtcaacagacagtctgtgttggctgccataacctcggctcaacagaggttgaagctttacagtcgagttccccccaatggcttggtgctctatactggtaccattgtcaccgatgatggcaaagagaagaaggttacctttgactttgagccatttagacccattaatgcttccctgtatctctgtgacaacaagtttcacactgaggcactgaatgagcttctggcatctgatgacaaatttggtttcataatcatggatggcaatggaacactgtatggcacgctgagcggaaacagcagggaggttctgtacaagttcagtgttgatctcccaaagaagcatgggcgaggagggcaatctgcagtccgctttgcccgcttgcgcatggagaggcgacacaattacctgcgcaaggttgctgagcttgcgacacaatacttcatcaatcctgccaccaaccagccaaacatcgttgggcttattcttgccggttctgctgacttcaagaatgaacttggtaaatctgagatgtttgatccgcgtcttcaggccaaagtagtcaagatgattgacgtgtcttatggtggggacagcggcttcaaccaagccatcgagatgtccgctgaggttctttctgatgttaagtttgtccaagaaaagaagcttatcgggaagtactttgaggagataagccaagacacagggaagtatgtccttggcgtcgaggacaccatgacagccctggaaatgggcgctgtagaaatcctgattgtgtgggaaaaccttgatgtcaggcgttatgagctcaagaacagtgtcacaggagaaacagttgtgaagtacctgaaccccactcaggaggctgatcagagcaactttactgacgcggcgacatccggagatctggaggtcattgacaacacacagctgctggagtggtttgctgagaactaccaccagtttggctgctcgcttgagtttgtcaccaacaagtcccaggaaggttctcagttctgccggggatttggcgggatcggtgggatcctccgctacccagccgatgtcagtgcctaccaggatggtgacttgtctgatggggagtatgatgaagacttcgaatag

SEQ ID NO: 10718 - protein, 438 aa, Sorghum bicolor
  misc_feature: Ceres ANNOT ID no. 6115165
  misc_feature (6)..(140): Pfam Id: eRF1_1 Pfam Desc: eRF1 domain 1
  misc_feature (144)..(278): Pfam Id: eRF1_2 Pfam Desc: eRF1 domain 2
  misc_feature (281)..(418): Pfam Id: eRF1_3 Pfam Desc: eRF1 domain 3
  misc_feature (6)..(436): NCBI GI: 140047443 NCBI Desc: peptide chain release factor erf/arf subunit 1 [medicago truncatula]
  misc_feature (1)..(438): NCBI GI: 79330086 NCBI Desc: erf1-1 (eukaryotic release factor 1-1); translation release factor/ translation release factor, codon specific [arabidopsis thaliana]
  misc_feature (1)..(438): NCBI GI: 1155261 NCBI Desc: eukaryotic release factor 1 homolog
  misc_feature (1)..(438): NCBI GI: 23506095 NCBI Desc: at5g47880/mca23_22 [arabidopsis thaliana]
  misc_feature (1)..(436): NCBI GI: 83283955 NCBI Desc: eukaryotic peptide chain release factor subunit 1-3-like protein [solanum tuberosum]
MGEVHEADKNIEIWRVKKLIKALDAARGNGTSMISLIMPPRDQISRVTKMLGDEYGTASNIKSRVNRQSVLAAITSAQQRLKLYSRVPPNGLVLYTGTIVTDDGKEKKVTFDFEPFRPINASLYLCDNKFHTEALNELLASDDKFGFIIMDGNGTLYGTLSGNSREVLYKFSVDLPKKHGRGGQSAVRFARLRMERRHNYLRKVAELATQYFINPATNQPNIVGLILAGSADFKNELGKSEMFDPRLQAKVVKMIDVSYGGDSGFNQAIEMSAEVLSDVKFVQEKKLIGKYFEEISQDTGKYVLGVEDTMTALEMGAVEILIVWENLDVRRYELKNSVTGETVVKYLNPTQEADQSNFTDAATSGDLEVIDNTQLLEWFAENYHQFGCSLEFVTNKSQEGSQFCRGFGGIGGILRYPADVSAYQDGDLSDGEYDEDFE

SEQ ID NO: 10719 - DNA, 1317 bp, Sorghum bicolor; identical to SEQ ID NO: 10717
  misc_feature: Ceres ANNOT ID no. 6115167
  misc_feature: Encodes the peptide sequence at SEQ ID NO 10720

SEQ ID NO: 10720 - protein, 438 aa, Sorghum bicolor; identical to SEQ ID NO: 10718
  misc_feature: Ceres ANNOT ID no. 6115167
  misc_feature (6)..(140): Pfam Id: eRF1_1 Pfam Desc: eRF1 domain 1
  misc_feature (144)..(278): Pfam Id: eRF1_2 Pfam Desc: eRF1 domain 2
  misc_feature (281)..(418): Pfam Id: eRF1_3 Pfam Desc: eRF1 domain 3
  misc_feature (6)..(436): NCBI GI: 140047443 NCBI Desc: peptide chain release factor erf/arf subunit 1 [medicago truncatula]
  misc_feature (1)..(438): NCBI GI: 79330086 NCBI Desc: erf1-1 (eukaryotic release factor 1-1); translation release factor/ translation release factor, codon specific [arabidopsis thaliana]
  misc_feature (1)..(438): NCBI GI: 1155261 NCBI Desc: eukaryotic release factor 1 homolog
  misc_feature (1)..(438): NCBI GI: 23506095 NCBI Desc: at5g47880/mca23_22 [arabidopsis thaliana]
  misc_feature (1)..(436): NCBI GI: 83283955 NCBI Desc: eukaryotic peptide chain release factor subunit 1-3-like protein [solanum tuberosum]

SEQ ID NO: 10721 - DNA, 1569 bp, Sorghum bicolor
  misc_feature: Ceres ANNOT ID no. 6115185
  misc_feature: Encodes the peptide sequence at SEQ ID NO 10722
atgaaaccatcagttctgcagtacctgaactttttcgttttattttcctttggtgtagtcaccacctcccacacaactgaccaagatgtgctcgcaaccctcagtaaactacccctcgatggccatttcagcttccatgatgtgtctactgctgcctgggactttggcaatctctctagtttcatgccagctgctgtgcttcatccaggatcagtagacgacattgccactacggtcaggcatgtcttcttggggggagagcactccatgctcaccgtggcagcccgtgggcatggacactcactccgagggcagtgccaggcagctggagggattgtcattaaaatggagtccctccctaatgacaggatgcaggtgcagtctggtgcatcgccctatgttgatgcctcaggaggagaactctggataaatgtcctgcatgagacattgaagtacggtctggcaccaaagtcatggactgattatctccacctcacaattggaggcacgttgtcaaatgcaggggtcagtgggcagacgttccgacatggcccacaaatcagcaacgtaaacgagctggagattgtgacaggaaaaggagacatcatcacttgctcaccggagcggaactctgatctcttccatgctgctcttggtggcttaggtcagttcggtatcatcactagggccaggattgtgctcgagcctgctccaaaaatggtgaggtggattagagttctctactcagacttcacaagctttgcagaggatcaggagatgcttatttcagcagagaggacctttgattacatagagggcttcgtcatcatcaacaggacaggtatcctgaacaactggagatcatcatttagcccacaggatccagtgtgggcaagccagttcaaatcagatggaagagtgctcttctgcctcgagatgacgaagaactacaaccctgaagagtcagacaacatggaacaggaggtcaatagcctactgcatcaacttagacatatgcctccatccctattccacacagatgtcacctacatcgagttcctggatagggtgcactcctctgaggttaaactgagagctaaggggatgtgggaggtcccacacccatggctaaatctcatggttccaaaaagttcgatccacacatttgcaagggaggtctttgggaaaatcctgaaagacagcaacagtggtcccatattgctctacccagtaaacaaattcagatgggacaatagaacgtcagtagtcataccagatgaggaagttttctacctagtgggattcctatcctcagtgccatcttcatcaggtcctcacggcgtcgaacatgcactgaacctcaataaccagataatagaattctctggcaaggcaggtattagggtgaagcaatatctgcccaactacaacactgcacaggagtggaaggcccactttgaggcaaggtgggagacatttcaacgaaggaaaaatgcctatgacccattggccatcctagctccaggacaaggaatatttcaaaaggcatcaccgcccttgtccctatga

SEQ ID NO: 10722 - protein, 522 aa, Sorghum bicolor
  misc_feature: Ceres ANNOT ID no. 6115185
  misc_feature (238)..(513): Pfam Id: Cytokin-bind Pfam Desc: Cytokinin dehydrogenase 1, FAD and cytokinin binding
  misc_feature (63)..(206): Pfam Id: FAD_binding_4 Pfam Desc: FAD binding domain
  misc_feature (7)..(522): NCBI GI: 115463543 NCBI Desc: os05g0374200 [oryza sativa (japonica cultivar-group)]
  misc_feature (1)..(521): NCBI GI: 23267157 NCBI Desc: cytokinin dehydrogenase 2 [hordeum vulgare]
  misc_feature (1)..(521): NCBI GI: 27312007 NCBI Desc: cytokinin dehydrogenase 2 [hordeum vulgare]
  misc_feature (1)..(521): NCBI GI: 28883584 NCBI Desc: cytokinin dehydrogenase 3 [hordeum vulgare]
  misc_feature (1)..(522): NCBI GI: 38520863 NCBI Desc: cytokinin oxidase 3 [zea mays]
  misc_feature (29)..(521): SWISSPROT Homolog: EC 1.5.99.12 Cytokinin dehydrogenase 1 precursor
MKPSVLQYLNFFVLFSFGVVTTSHTTDQDVLATLSKLPLDGHFSFHDVSTAAWDFGNLSSFMPAAVLHPGSVDDIATTVRHVFLGGEHSMLTVAARGHGHSLRGQCQAAGGIVIKMESLPNDRMQVQSGASPYVDASGGELWINVLHETLKYGLAPKSWTDYLHLTIGGTLSNAGVSGQTFRHGPQISNVNELEIVTGKGDIITCSPERNSDLFHAALGGLGQFGIITRARIVLEPAPKMVRWIRVLYSDFTSFAEDQEMLISAERTFDYIEGFVIINRTGILNNWRSSFSPQDPVWASQFKSDGRVLFCLEMTKNYNPEESDNMEQEVNSLLHQLRHMPPSLFHTDVTYIEFLDRVHSSEVKLRAKGMWEVPHPWLNLMVPKSSIHTFAREVFGKILKDSNSGPILLYPVNKFRWDNRTSVVIPDEEVFYLVGFLSSVPSSSGPHGVEHALNLNNQIIEFSGKAGIRVKQYLPNYNTAQEWKAHFEARWETFQRRKNAYDPLAILAPGQGIFQKASPPLSL

SEQ ID NO: 10723 - DNA, 1770 bp, Sorghum bicolor
  misc_feature: Ceres ANNOT ID no. 6115275
  misc_feature: Encodes the peptide sequence at SEQ ID NO 10724
atggggaggccgcggaagacgaagcccgagccggagccagcccccgccttctcgatcggcaactgcaaggtggagatccgcgggagcgggctgcggtgcgagacgacggagcaggggctgacaatctccgggcccaggggcgccaaggccgtcgtctctgtttctggggatcagaggggcgcttcgattggcgtcggtgatggctctcagttcatcctcctcaatccaggcgatgcagatagccaaaccaagtccttgcttcaggaagtattgatgctctacaagcaagagcttcctagtatggactttgctgcagacactgggagaaagtcagggtttcttgaaaaatgcacaactaatgggaaatacaagactctaattctgctgtctagctctgcggcacagcatgaagaggttatagctactgtatcatatcagattgtgccagctgacactcagtatgctgaaatacctctggcagttgtgagatcatcttatcaacgtgtgggtattggccagctcttatataaggaactatcgcagaggcttcagaatgttggtgtcacatccattttctgctgggcagataagggttttgtatctgttggagaagtggatactaaaggtaaggttcgaaagattccagtaagggctgatataaagagaacattatgctttcctggtggatcaacacttatggttgcacaccttaagaagcaattgccaatcatgcaaacatgggagaaaccgcagacaacactccatactgtagtaccagatagtatatctcctggtgataccaattttctctcatctgataacatggtcctccagacatataaacgccgtgtcagaaagactgcaaaggaggcaacaaatgaagtttgcaatgcttatggtgaaagttcattatctcagcaagagccaaagaaacgtatgtatgaaatgtcatcatcatcactaaagtcaaaaagaataagatgtagcaatgatggtgacaattgccaagacatgaatcaaattggtgcacatgacaataacttgtgcagttcccctggaaattcactgcatcgaattcctaaagaacatcatgttcctagcatgggaggtgattttgaaagcaaaatgtctcaagatgacaaggccgttatctattccaatggaagccctacagttatgctcatgaatattgcagacgaacaaaagaaggcacgccttacaaaggttgttgaaacgcttagggggtctgttacttgcgatggacattcatgcacacatgttgttactggaaaagctcgcaggactatgaatttctgtattgctttgtgctctggtgcttggataatttccccaaactggctaaaagaaagcttcagagaagggcagtttgtaggagaagcacaatatgttctggaagatgaagaatataggatgcaatataagtctgaacttagagatgcagttatgagagctaaagaaaggcctaactccttgtttgctggctatactttctgtctttcaaagcacatccagccctcttttgatgttctctcagccattattaagtctactggaggcaagatcataaagaaactgagtgagttagatgagccgtccttgacaatctttttggtctgtgaagaggaggcagaacttgcattggttgcagcaaaaagtggcatcaaaacattcagcagtgactggttcatgagctgtgtcatgaaacaggaacttgacctcgaggcgcctcagtttattgtatctctatga

SEQ ID NO: 10724 - protein, 589 aa, Sorghum bicolor
  misc_feature: Ceres ANNOT ID no. 6115275
  misc_feature (494)..(573): Pfam Id: BRCT Pfam Desc: BRCA1 C Terminus (BRCT) domain
  misc_feature (311)..(589): NCBI GI: 87241454 NCBI Desc: brct [medicago truncatula]
  misc_feature (389)..(588): NCBI GI: 73536228 NCBI Desc: chain b, crystal structure of the brct repeat region from the mediator of dna damage checkpoint protein 1, mdc1
  misc_feature (389)..(588): NCBI GI: 83754973 NCBI Desc: chain b, crystal structure of mdc1 tandem brct domains
  misc_feature (389)..(588): NCBI GI: 88192186 NCBI Desc: chain b, crystal structure of the mdc1 brct repeat in complex with the histone tail of gamma-h2ax
  misc_feature (389)..(585): NCBI GI: 14249898 NCBI Desc: paxip1l protein [homo sapiens]
MGRPRKTKPEPEPAPAFSIGNCKVEIRGSGLRCETTEQGLTISGPRGAKAVVSVSGDQRGASIGVGDGSQFILLNPGDADSQTKSLLQEVLMLYKQELPSMDFAADTGRKSGFLEKCTTNGKYKTLILLSSSAAQHEEVIATVSYQIVPADTQYAEIPLAVVRSSYQRVGIGQLLYKELSQRLQNVGVTSIFCWADKGFVSVGEVDTKGKVRKIPVRADIKRTLCFPGGSTLMVAHLKKQLPIMQTWEKPQTTLHTVVPDSISPGDTNFLSSDNMVLQTYKRRVRKTAKEATNEVCNAYGESSLSQQEPKKRMYEMSSSSLKSKRIRCSNDGDNCQDMNQIGAHDNNLCSSPGNSLHRIPKEHHVPSMGGDFESKMSQDDKAVIYSNGSPTVMLMNIADEQKKARLTKVVETLRGSVTCDGHSCTHVVTGKARRTMNFCIALCSGAWIISPNWLKESFREGQFVGEAQYVLEDEEYRMQYKSELRDAVMRAKERPNSLFAGYTFCLSKHIQPSFDVLSAIIKSTGGKIIKKLSELDEPSLTIFLVCEEEAELALVAAKSGIKTFSSDWFMSCVMKQELDLEAPQFIVSL

SEQ ID NO: 10725 - DNA, 387 bp, Sorghum bicolor
  misc_feature: Ceres ANNOT ID no. 6115278
  misc_feature: Encodes the peptide sequence at SEQ ID NO 10726
atggcgatggcggcggcgaggagagcgctcctggcccacctccgcgtgccggcggtccaccctgcggcggcgggagggactatccccgcggcacggaggctcctgtcgtcgacgacggaggagacgaaggggtcgttcctcgacaagggcgaggtcgccgaccgcgtcctctccgtcgtcaagaacttccagaaggtcgaaccctcaaaggtgacacctactgcccatttccagaaggaccttggactcgatagcttggacactgtcgaggttgtgatggcgtttgaggaagaattttcctttgagatccctgacaatgaagcagagaagattgactccatcaagacagctgttgacttcatcgcctcacatcctcaagcaaaataa

SEQ ID NO: 10726 - protein, 128 aa, Sorghum bicolor
  misc_feature: Ceres ANNOT ID no. 6115278
  misc_feature (54)..(121): Pfam Id: PP-binding Pfam Desc: Phosphopantetheine attachment site
  misc_feature (5)..(128): NCBI GI: 3335337 NCBI Desc: similar to acyl carrier protein, mitochondrial precursor (acp) nadh-ubiquinone oxidoreductase 9.6 kd subunit (myacp-1), gbl23574 from a. thaliana. ests gbz30712, gbz30713,
  misc_feature (5)..(128): NCBI GI: 3335337 (continued) gbz26204, gbn37975 and gbn96330 come from this gene. [arabidopsis thaliana]
  misc_feature (39)..(128): NCBI GI: 92867896 NCBI Desc: acyl carrier protein (acp) [medicago truncatula]
  misc_feature (5)..(127): NCBI GI: 3341682 NCBI Desc: acyl carrier protein [arabidopsis thaliana]
  misc_feature (1)..(128): NCBI GI: 34485510 NCBI Desc: acyl carrier protein 1 [chlamydomonas reinhardtii]
  misc_feature (5)..(127): NCBI GI: 16974477 NCBI Desc: at2g44620/f16b22.11 [arabidopsis thaliana]
MAMAAARRALLAHLRVPAVHPAAAGGTIPAARRLLSSTTEETKGSFLDKGEVADRVLSVVKNFQKVEPSKVTPTAHFQKDLGLDSLDTVEVVMAFEEEFSFEIPDNEAEKIDSIKTAVDFIASHPQAK

SEQ ID NO: 10727 - DNA, 1815 bp, Sorghum bicolor
  misc_feature: Ceres ANNOT ID no. 6115291
  misc_feature: Encodes the peptide sequence at SEQ ID NO 10728
atggggcggtggtggtcgccggcgtcggcggctgtggagccgcggtccgtgcagctcctcctcctgggcgtcgccctcgtcgccgcttccttctacgccggcaccctcttcggctcctccgcgtccccggcgctcgtactgcccgcctcgaggtcccgatcgcccgattccttcagtgccgaagatgttccgatgtttacaaacagagtttctcgtaagtaccgggcgaaaccagtcgcagttccagatcatggagttgatgtgtgtcctttggaatacaatgagtatgtcccctgccatgatgcatcctatataagaagcttgaagaacctggatagatctaggcatgaggatcttgaaagtatttgtcctccacgagagaaacaattgttctgtttggtgccccctccaaatgactacaagataccaataagatggccaacaagccgagactacgtatggcgtagtaatgtcaaccattcgcatcttgctgaggtcaaaggaggacagaactgggtgcatgagaagggcaagctttggtggtttcctggaggtggtactcacttcaaacatggtgcatcagagtacatagagaggctaggaaatatgacaacaaataatactggtgatctccgttctgccggagtagttcaagttttggatgttggatgtggtgttgctagtttttctgcttatcttcttcccctagacattcaaaccatgtcatttgctccaaaagatggccatgagaatcaaatacagtttgctttagaacgtgggattggtgcaatgatctctgtgttggccacaaaacaattaccttatcctgaaagttcatttgaaatggttcactgttcaaggtgtcgtgttgattggcatgaaaatgatggaatattgctcaaagaggtagaccgccttttgcgacctaatggatattttgtatactctgctccaccggcttataggaaagataaagacttccctgttatctgggagaagctagttaatattacaacaacaatgtgttggaagcttattgctaagcatgttcaaacagctatttgggttaaacctgaagatgaatcctgccggcagaaaaaggctgatatgaagctactgaatatttgtgaatccaatgacaacgtttcaccatcatggaaaattccgttaatgaattgtgtgaagcttaacaaggacaaatccaatattcagaaattgccttccagatctgatcgcctatcattttatttcaagagtttggagatgataggagtcgcaccagagaggtttgagaagaataaccagttctggaagaaccaggttcacaagtattggtcatttcttggtgttgaaaagactagcattcggaacgtcatggacatgaatgctaattatggcggatttgctgcagcactaagcagtgaccctgtctggattatgaatatagtaccccataccatgacgaacacattgccagttatctacgaccgtgggttactcggttcttaccatgactggtgtgagccattctcaacatatcctagatcctatgatttgttgcatgctttccacctcttttctcattatgaaggtggcaaggaagattgttcgttggaggatatcatgttagaaatggatcgcatcattcgaccccagggttttgtcattattagagatgagaatcacactctctcaagaatcatcgatctagcaccgaagttcctttgggatgttactgcacacatgttggaaaacgaggatagcgggacagatcaagttctgttttgcaggaagaaattctgggctattgtttga

SEQ ID NO: 10728 - protein, 604 aa, Sorghum bicolor
  misc_feature: Ceres ANNOT ID no. 6115291
  misc_feature (220)..(315): Pfam Id: Methyltransf_11 Pfam Desc: Methyltransferase domain
  misc_feature (58)..(601): NCBI GI: 52077023 NCBI Desc: dehydration-responsive protein-like [oryza sativa (japonica cultivar-group)]
  misc_feature (14)..(603): NCBI GI: 42573369 NCBI Desc: dehydration-responsive protein-related [arabidopsis thaliana]
  misc_feature (20)..(592): NCBI GI: 21536697 NCBI Desc: ankyrin-like protein [arabidopsis thaliana]
  misc_feature (88)..(601): NCBI GI: 11994314 NCBI Desc: ankyrin-like protein [arabidopsis thaliana]
  misc_feature (22)..(601): NCBI GI: 7268141 NCBI Desc: ankyrin like protein [arabidopsis thaliana]
MGRWWSPASAAVEPRSVQLLLLGVALVAASFYAGTLFGSSASPALVLPASRSRSPDSFSAEDVPMFTNRVSRKYRAKPVAVPDHGVDVCPLEYNEYVPCHDASYIRSLKNLDRSRHEDLESICPPREKQLFCLVPPPNDYKIPIRWPTSRDYVWRSNVNHSHLAEVKGGQNWVHEKGKLWWFPGGGTHFKHGASEYIERLGNMTTNNTGDLRSAGVVQVLDVGCGVASFSAYLLPLDIQTMSFAPKDGHENQIQFALERGIGAMISVLATKQLPYPESSFEMVHCSRCRVDWHENDGILLKEVDRLLRPNGYFVYSAPPAYRKDKDFPVIWEKLVNITTTMCWKLIAKHVQTAIWVKPEDESCRQKKADMKLLNICESNDNVSPSWKIPLMNCVKLNKDKSNIQKLPSRSDRLSFYFKSLEMIGVAPERFEKNNQFWKNQVHKYWSFLGVEKTSIRNVMDMNANYGGFAAALSSDPVWIMNIVPHTMTNTLPVIYDRGLLGSYHDWCEPFSTYPRSYDLLHAFHLFSHYEGGKEDCSLEDIMLEMDRIIRPQGFVIIRDENHTLSRIIDLAPKFLWDVTAHMLENEDSGTDQVLFCRKKFWAIV

SEQ ID NO: 10729 - DNA, 1293 bp, Sorghum bicolor
  misc_feature: Ceres ANNOT ID no. 6115323
  misc_feature: Encodes the peptide sequence at SEQ ID NO 10730
atggcgcatgcgccggtggtgaagacgacgacgacgacggtcgccgacctcacggacctcgtcctccaggccatcctcctccgcctcagccccgccgacctcctccgcgcggcgctcacctgccaccgctggcgccgcgccgccacccacgccctcccacgcgtgccgcccctcctcggctacttcttccacccacagggccccggcaatccgccccccatgccgatgtacgacacgacccaccaccccgccgtctttctcccgctcgacgccgcctcctccccgtgcctctccctcgacctcaccccgggcgctgccagcagcctctccatccaggacgtccacctcggcctcgtcctcctcctccctcactcgcgccccaagtcgctcctgccccgcatcctcgccgtcgacccggcgtcgcgccgccgcgtcctgctcccgccgccgccgcgcgacgcgctgcctgagcgtgacgatcgctggcgccgcgacaggtgcgtcatcggcgtcgccgttctcgcgcgcgcgcaccctagcaggctcaccttcgacgccgtctgcctcaccatcgacggcgacctcccgcgcgcctgggtcgcgtccgtccgcgaaggcaactgcgcctggcgcgcgttgccgagggccgaggggatcaccatcaacttcgacccgtggttgttcgagggccgctgcgtgcacgccgctgggaacatctactggcacatctgcaactccagccgcttactccagctggatccttgcacgctggacttctccttcatgcccgtgcctgccgtcctgggggatcgcttcgaaaagtaccgcatcggagagacgccggaggatggccgtttgtgcatggcatcgatcgtggagaatctcagtctgcagatctgggtgcgtggagaggccaggtgcagcagcgacagggggtggttgctggagaggaagatttgcatgaccaaactgctcgacaccgtgcctggcctacccaaggacagcatgatgcgggtgctttgcacctggctcagcgacatggactacgctcgcaccggaaaggtgttcatcactacatggggatatgggcgctactcgttccatctggagaccagcaagctagagcgattggtgatggaagatggcaaggagcatggaaaccctatctatgcctacaccttggcctggccgcctgagttcctcgcccaagaaactggccttctggagttttatagtttggaatggtacttttgtacattttgtatgtatcagaattacatgttgctatgttaa

SEQ ID NO: 10730 - protein, 430 aa, Sorghum bicolor
  misc_feature: Ceres ANNOT ID no. 6115323
  misc_feature (12)..(59): Pfam Id: F-box Pfam Desc: F-box domain
  misc_feature (37)..(421): NCBI GI: 48717071 NCBI Desc: ribosomal protein-like [oryza sativa (japonica cultivar-group)]
  misc_feature (231)..(401): NCBI GI: 115462089 NCBI Desc: os05g0147700 [oryza sativa (japonica cultivar-group)]
  misc_feature (9)..(121): NCBI GI: 115478659 NCBI Desc: os09g0341500 [oryza sativa (japonica cultivar-group)]
  misc_feature (17)..(398): NCBI GI: 115481050 NCBI Desc: os10g0135300 [oryza sativa (japonica cultivar-group)]
  misc_feature (19)..(170): NCBI GI: 115481344 NCBI Desc: os10g0188000 [oryza sativa (japonica cultivar-group)]
MAHAPVVKTTTTTVADLTDLVLQAILLRLSPADLLRAALTCHRWRRAATHALPRVPPLLGYFFHPQGPGNPPPMPMYDTTHHPAVFLPLDAASSPCLSLDLTPGAASSLSIQDVHLGLVLLLPHSRPKSLLPRILAVDPASRRRVLLPPPPRDALPERDDRWRRDRCVIGVAVLARAHPSRLTFDAVCLTIDGDLPRAWVASVREGNCAWRALPRAEGITINFDPWLFEGRCVHAAGNIYWHICNSSRLLQLDPCTLDFSFMPVPAVLGDRFEKYRIGETPEDGRLCMASIVENLSLQIWVRGEARCSSDRGWLLERKICMTKLLDTVPGLPKDSMMRVLCTWLSDMDYARTGKVFITTWGYGRYSFHLETSKLERLVMEDGKEHGNPIYAYTLAWPPEFLAQETGLLEFYSLEWYFCTFCMYQNYMLLC

SEQ ID NO: 10731 - DNA, 984 bp, Sorghum bicolor
  misc_feature: Ceres ANNOT ID no. 6115328
  misc_feature: Encodes the peptide sequence at SEQ ID NO 10732
atggccgacgaagttcagcagctcaccagggccttctcaggccttggcgggctcggcgtggatgagccgacgatggtgtcggcgctggcgcggtggcggaagcagcccgagaagcggtcggggttccgcaagggcttcccgggcttcttcaagagccacggcgagatcgaccggtgcgaggacgagtacatgctgcacctggccgccgagttcgcgcggttcaagaacctgatggtgctgtgggcgatgcacccgtgggagcgcgacgcccggctggcgcaccacgtcctccaccagcagcacccgcccgccatcgtcgtggaggtcgcctgcacgcggtccgccgacgagctcctgggcacgcgccgcgcgtaccaggcgctcttccaccactccctcgaggaggacgtcgcgtaccgcgccagggacaagccctactgcagcctgctggtggggctggtgagcgcgtaccggtacgagggcccgcgggtgaacgaggaggtggcgaaggcggaggccaaggcgctgggcgccgccgtgaagagcgcggctgctgccggcggcggcgggaagaagctggtggagaacgaggaggtggtccggatcctgaccaccaggagcaagccgcacctggtggagacgttcaagtactacaaggagatgcacggccggcacgtggaggaggacctgagccagagcagcggggaggaggagacgacgaccctgctggagaccgtgctgtgcctcgccgcgccggccaagtacttcagccaggtgatggagggcgcgctgagggacggcgcggaccaccacgggaaggaggcactgacgagggtggccgtgacgcggtcggaccacgacatggacgacatcagagccgcctaccaccagcagttcggggccaagctggaggacgccattgcggccaaggcgcacgggcactacagggacgcgctgctctccttggtcggcgccggcaagtga

SEQ ID NO: 10732 - protein, 327 aa, Sorghum bicolor
  misc_feature: Ceres ANNOT ID no. 6115328
  misc_feature (171)..(243): Pfam Id: Annexin Pfam Desc: Annexin
  misc_feature (258)..(322): Pfam Id: Annexin Pfam Desc: Annexin
  misc_feature (74)..(324): NCBI GI: 6272285 NCBI Desc: annexin p33 [zea mays]
  misc_feature (2)..(324): NCBI GI: 58177603 NCBI Desc: chain b, x-ray structure of annexin from arabidopsis thaliana gene at1g35720
  misc_feature (74)..(326): NCBI GI: 38194890 NCBI Desc: anx1 [gossypium hirsutum]
  misc_feature (2)..(324): NCBI GI: 1621539 NCBI Desc: annexin-like protein
  misc_feature (73)..(325): NCBI GI: 1370603 NCBI Desc: annexin p35 [zea mays]
MADEVQQLTRAFSGLGGLGVDEPTMVSALARWRKQPEKRSGFRKGFPGFFKSHGEIDRCEDEYMLHLAAEFARFKNLMVLWAMHPWERDARLAHHVLHQQHPPAIVVEVACTRSADELLGTRRAYQALFHHSLEEDVAYRARDKPYCSLLVGLVSAYRYEGPRVNEEVAKAEAKALGAAVKSAAAAGGGGKKLVENEEVVRILTTRSKPHLVETFKYYKEMHGRHVEEDLSQSSGEEETTTLLETVLCLAAPAKYFSQVMEGALRDGADHHGKEALTRVAVTRSDHDMDDIRAAYHQQFGAKLEDAIAAKAHGHYRDALLSLVGAGK

SEQ ID NO: 10733 - DNA, 1086 bp, Sorghum bicolor
  misc_feature: Ceres ANNOT ID no. 6115329
  misc_feature: Encodes the peptide sequence at SEQ ID NO 10734
atgtgttgctggtgctgctgcctggagtgcatccataacatcgctcctctcaaccttctcttcctccacttctccgccgacccagctctcccaggcgaagcaggagcagcacctgcctccatggcttccatctcggtccccaacccggtcccttctgcgacccaagacgccgagaacattaggaaagcagtgcaaggatggggcacggacgagaaggcgctgatcgagatactgggccaccggacggcggcgcagcgcgcggagatcgccgtggcctacgagggcctctgcaacgaatccctcctcgacagactccactccgagctctccggcgacttccggagcgcgatgatgctgtggacggcggacccggcggcgcgtgacgccaagctcgcccacaaggccatgaagaagaagggcgagcggtacgtgtgggtgctcatcgaggtcgcctgcgcgtcgacgccggaccacctcgtcgccgtcaggaaggcctaccgcgaggcctactccgcctccctggaggaggacgtcgccgcgtgcccgctctacaacaaggaccccctcctcaagcagttcttggtgcggctggtgagctcgtaccggtactccggcgagctcgtcgacgacgagctggcgagggcggaggccgcggagctgcacgacgcggtggtggccaggaagcagccgctgcacggcgacgtcgtgcgcatcgtcagctccaggagcaagccgcagctgaaggcgacgttcgagcggtacaggcagggccatggcaaggccatcgacgaggtgctcgaggaagaacgccgcagcgaccagctcgcggcggtgctcaagacagcggtgtggtgcttgacgtcgccggagaagcacttcgcggaggtgatccggagctccatcgtcgggctcgggacggacgaggagtccctgacgcgggcgatcgtctcgcgcgccgagatcgacatgaagaaggtgaaggaggagtacaaggccaggtaccgcaagacggtgaccagcgacgtcaacggcgacacgtccggatactacaatggcatcttgctcactctagtcgggcccgagtga

SEQ ID NO: 10734 - protein, 361 aa, Sorghum bicolor
  misc_feature: Ceres ANNOT ID no. 6115329
  misc_feature (55)..(120): Pfam Id: Annexin Pfam Desc: Annexin
  misc_feature (127)..(197): Pfam Id: Annexin Pfam Desc: Annexin
  misc_feature (216)..(281): Pfam Id: Annexin Pfam Desc: Annexin
  misc_feature (292)..(357): Pfam Id: Annexin Pfam Desc: Annexin
  misc_feature (41)..(359): NCBI GI: 6503082 NCBI Desc: annat3 [arabidopsis thaliana]
  misc_feature (41)..(361): NCBI GI: 6010777 NCBI Desc: annexin [fragaria x ananassa]
  misc_feature (41)..(359): NCBI GI: 38194890 NCBI Desc: anx1 [gossypium hirsutum]
  misc_feature (41)..(359): NCBI GI: 3928134 NCBI Desc: annexin p38 [capsicum annuum]
  misc_feature (189)..(361): NCBI GI: 50510056 NCBI Desc: annexin-like protein [oryza sativa (japonica cultivar-group)]
MCCWCCCLECIHNIAPLNLLFLHFSADPALPGEAGAAPASMASISVPNPVPSATQDAENIRKAVQGWGTDEKALIEILGHRTAAQRAEIAVAYEGLCNESLLDRLHSELSGDFRSAMMLWTADPAARDAKLAHKAMKKKGERYVWVLIEVACASTPDHLVAVRKAYREAYSASLEEDVAACPLYNKDPLLKQFLVRLVSSYRYSGELVDDELARAEAAELHDAVVARKQPLHGDVVRIVSSRSKPQLKATFERYRQGHGKAIDEVLEEERRSDQLAAVLKTAVWCLTSPEKHFAEVIRSSIVGLGTDEESLTRAIVSRAEIDMKKVKEEYKARYRKTVTSDVNGDTSGYYNGILLTLVGPE

SEQ ID NO: 10735 - DNA, 396 bp, Sorghum bicolor
  misc_feature: Ceres ANNOT ID no. 6115332
  misc_feature: Encodes the peptide sequence at SEQ ID NO 10736
atggaggccaagatggaacgcttcttcgagtccgtgggcaatttcttcaccggaggcgacaacatcccctggtgcgaccgcgacctcatcgccggcattgaaagagagcttgccgacgctgcaaatgatgaacagaggaatgctagccttatgaggttatcatgggcccttgtgcactccaagcagacagacgatgtaaaccgtggaatcagcatgcttcaagcttctttggataattctggcagtcctctggagactaaggaaaagatgtacctgttggcagttgggctcttcaggattggcgactactcaaaaagtaggcaacttgcagatcgctgtttggagttatgttgtgaagcatttgacttcaatagcttctctgatgtgttctattaa

SEQ ID NO: 10736 - protein, 131 aa, Sorghum bicolor
  misc_feature: Ceres ANNOT ID no. 6115332
  misc_feature (1)..(116): NCBI GI: 115463619 NCBI Desc: os05g0383000 [oryza sativa (japonica cultivar-group)]
  misc_feature (1)..(116): NCBI GI: 115442269 NCBI Desc: os01g0951800 [oryza sativa (japonica cultivar-group)]
  misc_feature (1)..(116): NCBI GI: 124359978 NCBI Desc: protein kinase [medicago truncatula]
  misc_feature (28)..(106): NCBI GI: 40889302 NCBI Desc: chain a, solution structure of human mitochondria fission protein fis1
  misc_feature (30)..(106): NCBI GI: 28948406 NCBI Desc: chain a, solution structure of rsgi ruh-001, a fis1p-like and cgi- 135 homologous domain from a mouse cdna
MEAKMERFFESVGNFFTGGDNIPWCDRDLIAGIERELADAANDEQRNASLMRLSWALVHSKQTDDVNRGISMLQASLDNSGSPLETKEKMYLLAVGLFRIGDYSKSRQLADRCLELCCEAFDFNSFSDVFY

SEQ ID NO: 10737 - DNA, 111 bp, Sorghum bicolor
  misc_feature: Ceres ANNOT ID no. 6115372
  misc_feature: Encodes the peptide sequence at SEQ ID NO 10738
atgcttactctcaaactttttgtttatacagtagtgatattctttgtttccctctttatctatggattcttacctaatgacccaggacgtaatcttgggcgtgaggagtaa

SEQ ID NO: 10738 - protein, 36 aa, Sorghum bicolor
  misc_feature: Ceres ANNOT ID no. 6115372
  misc_feature (1)..(36): Pfam Id: PsbI Pfam Desc: Photosystem II reaction centre I protein (PSII 4.8 kDa protein)
  misc_feature (1)..(36): NCBI GI: 109945501 NCBI Desc: photosystem ii protein i [populus alba]
  misc_feature (1)..(36): NCBI GI: 69217410 NCBI Desc: photosystem ii protein i [ranunculus macranthus]
  misc_feature (1)..(36): NCBI GI: 69217412 NCBI Desc: photosystem ii protein i [typha latifolia]
  misc_feature (1)..(36): NCBI GI: 69217414 NCBI Desc: photosystem ii protein i [yucca schidigera]
  misc_feature (1)..(36): NCBI GI: 49065801 NCBI Desc: photosystem ii reaction center i protein (psii 4.8 kda protein) (psii i-protein)
MLTLKLFVYTVVIFFVSLFIYGFLPNDPGRNLGREE

SEQ ID NO: 10739 - DNA, 1437 bp, Sorghum bicolor
  misc_feature: Ceres ANNOT ID no. 6115380
  misc_feature: Encodes the peptide sequence at SEQ ID NO 10740
atgaaaatggcgcacttgatcactaactgtagtttcagtacatctcctgctgttcagacattctccagttctcctaattactgccgcagtgttggccaattacagaactcaaaatcttcaaatttatccctcaaatcttgttccaggagacaaaagaagtcatatgtttcctgtgctagtgcagccgtacaaggacagacacaaacacctcttactggtagccagcaagcttatgagcattcatcctccaaacctaaaaaggtaatggttattggtggagatggatactgtgggtgggcaacagctcttcatctctcaaacaaaggttatgaggttgctattgttgataatcttgttcgccgtctttttgatcaccaacttggtcttgattcccttacccccataacttcaatccaaaatcgtgtccgtagatggaagtctctcactggtaagacaattcagctctttatcggtgacatatgtgattttgaattcctctcggaagctttcaagtcttttgagccggatgctgctgttcactttggtgagcaaagatccgcaccatactctatgattgatcgttcgcgggcagtctacacgcagcataacaatgtcattgggacacttaatgtcttgtttgccataaaggaatacagtgacgagtgccatttggttaagctaggaactatgggtgagtatggaacaccaaacattgacattgaagaggggtttatcactattactcacaatggaagaacagacaccttgccttatccaaaacaagcgagttctttctaccatctaagcaaagtgcatgactcccacaacatagcatttacctgcaaggcttggggtataagggccacagatcttaaccaaggtgtggtctatggggtcagaacagatgaaactgcactgcatgaagagctatctaacagatttgactatgatggcgtctttgggacagcactaaataggttctgcgttcaggctgctgtagggcatccacttacagtttatggaaaaggtggtcagacccggggatatctggacatcagagacactgtacagtgcgttgagctagcaatagccaacccagccaaacctggcgagttcagagtcttcaaccagttcactgagcaattctctgtcaatgagctagccaaactggtgacagccgcaggagcgaagcttggtctagaagtgcagaccaaatcggtgcccaacccacgagtcgaggctgaggagcactattacaacgccaagcacacgaagctcattgagctcggcctggtgccccacctgctctcagactccctgcttgactcgcttctcaactttgccatccaatacaaggatcgggtcgacacagcacagatcatgccaagcgtgtcatggaagaagatgggtgccaagccacggacagtctctgtttag

SEQ ID NO: 10740 - protein, 478 aa, Sorghum bicolor
  misc_feature: Ceres ANNOT ID no. 6115380
  misc_feature (88)..(378): Pfam Id: Epimerase Pfam Desc: NAD dependent epimerase/dehydratase family
  misc_feature (3)..(476): NCBI GI: 28398021 NCBI Desc: udp-sulfoquinovose synthase sqd1 [spinacia oleracea]
  misc_feature (3)..(477): NCBI GI: 21360527 NCBI Desc: at4g33030/f26p21_150 [arabidopsis thaliana]
  misc_feature (3)..(477): NCBI GI: 92898453 NCBI Desc: nad-dependent epimerase/dehydratase [medicago truncatula]
  misc_feature (71)..(477): NCBI GI: 33357043 NCBI Desc: chain a, high resolution crystal structure of the wild-type protein sqd1, with nad and udp-glucose
  misc_feature (86)..(477): NCBI GI: 6573642 NCBI Desc: chain a, crystal structure of sqd1 protein complex with nad and udp- glucose
  misc_feature (3)..(476): SWISSPROT Homolog: EC 3.13.1.1 UDP-sulfoquinovose synthase, chloroplast precursor
MKMAHLITNCSFSTSPAVQTFSSSPNYCRSVGQLQNSKSSNLSLKSCSRRQKKSYVSCASAAVQGQTQTPLTGSQQAYEHSSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSDECHLVKLGTMGEYGTPNIDIEEGFITITHNGRTDTLPYPKQASSFYHLSKVHDSHNIAFTCKAWGIRATDLNQGVVYGVRTDETALHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLIELGLVPHLLSDSLLDSLLNFAIQYKDRVDTAQIMPSVSWKKMGAKPRTVSV

SEQ ID NO: 10741 - DNA, 1335 bp, Sorghum bicolor
  misc_feature: Ceres ANNOT ID no. 6115415
  misc_feature: Encodes the peptide sequence at SEQ ID NO 10742
atggagaaggaggagaagcaggagctggagggtgctgctgctgcggcggccgcggcgaggcggcggctggtgatcggggtggggttctgggtgcagggcttccggctcttcccgtggctgggcgtcaatttcttcctcaaggacggcatgggcgtcgccgcctcctcgctgcagatcctccaggcctccgccaacctacccatggtcgccaagccgctccttggcctcctgtccgatgccgtccccatacgcggccatcgacgcctgccctacgtcgccatcggcgctctcttgcaggcaatttcatggctagcaattgcactttggcaagatatctctcttcaggttcttaccatttttctcctcttgagcaactttggtgcttccatatgtgaggttgccaatgatgccattgtggcggaggctgggaagatagtgacctcttcctcaggatcaggtcagcttcaatcgtttgcttggatgttcggctcttctgctggtgctttaggaaacctccttggaggcattgcactcagctatttttctcccaaaatcatgtttctgtttttcgcaatccttctcctgctccagttcttcacaaccgtggctatacctgagagctctctcaaactcccaaaggcagctactcctagcaatctatcagcactcaccagcatccgtaagcaagtcaaagagctgtcatgtgccctatctatgcctgaaatgttttggtcaatcatatggtttacagtgtcttatgccgtcataccttttctacttgggaccatgttcttctatcagactgaagtgttaagactagactcatcagttattggcttatcaaaggtgtttgggcaagtggctctcttggcttggagcatgtcatacaacaagtacttcaaaacaatgtccgcacggaaggtcctatcagttctgcagtttgtcacagcactcataatgttgtcagatgtgttattcgttcagggaatatacaggaaggtcggaataccagactccatatacacgattgtcttctccgggttgctcgagggtcttatgtttttcaaggttctgcccttcagtgttcttattgcaaaactttgccctgctggatgtgagggatcggtaatggcctttgtcatgtctgcacttgcccttgccactatcgtcagtggctatcttggagttgctcttgctgccttcatgggagtatctggagatgatttctcagcactgccagcttgcctgttgattgaggctgtgtgcacaatactgccactatgttgctcgtctttgatcaaagagaggagagaaaaggagaagaaagaagagtag

SEQ ID NO: 10742 - protein, 444 aa, Sorghum bicolor
  misc_feature: Ceres ANNOT ID no. 6115415
  misc_feature (32)..(445): Pfam Id: BT1 Pfam Desc: BT1 family
  misc_feature (28)..(392): Pfam Id: MFS_1 Pfam Desc: Major Facilitator Superfamily
  misc_feature (23)..(442): NCBI GI: 30678917 NCBI Desc: integral membrane transporter family protein [arabidopsis thaliana]
  misc_feature (103)..(442): NCBI GI: 2494120 NCBI Desc: similar to synechocystis integral membrane protein (gbd64002). [arabidopsis thaliana]
  misc_feature (29)..(207): NCBI GI: 20147215 NCBI Desc: at5g54860/mbg8_12 [arabidopsis thaliana]
  misc_feature (218)..(427): NCBI GI: 115435608 NCBI Desc: os01g0243200 [oryza sativa (japonica cultivar-group)]
  misc_feature (11)..(435): NCBI GI: 115455887 NCBI Desc: os03g0795000 [oryza sativa (japonica cultivar-group)]
MEKEEKQELEGAAAAAAAARRRLVIGVGFWVQGFRLFPWLGVNFFLKDGMGVAASSLQILQASANLPMVAKPLLGLLSDAVPIRGHRRLPYVAIGALLQAISWLAIALWQDISLQVLTIFLLLSNFGASICEVANDAIVAEAGKIVTSSSGSGQLQSFAWMFGSSAGALGNLLGGIALSYFSPKIMFLFFAILLLLQFFTTVAIPESSLKLPKAATPSNLSALTSIRKQVKELSCALSMPEMFWSIIWFTVSYAVIPFLLGTMFFYQTEVLRLDSSVIGLSKVFGQVALLAWSMSYNKYFKTMSARKVLSVLQFVTALIMLSDVLFVQGIYRKVGIPDSIYTIVFSGLLEGLMFFKVLPFSVLIAKLCPAGCEGSVMAFVMSALALATIVSGYLGVALAAFMGVSGDDFSALPACLLIEAVCTILPLCCSSLIKERREKEKKEE

SEQ ID NO: 10743 - DNA, 1182 bp, Sorghum bicolor
  misc_feature: Ceres ANNOT ID no. 6115416
  misc_feature: Encodes the peptide sequence at SEQ ID NO 10744
atgctaaaaccacagacgtcgtgggcagcttccctccctctcttcatcgtccgccgctgctcgagatccgcggccagcccatctcctgccggtgaccggcggctctcctttctcccggtttgcaagcggcggatgagcacgctggcgcagcccaggttcgcccctctccctacggagcgaattgaatcccaaacagatgctggtgctgctgggtaccagttccggctggtctcttacaacatcttggcccaggtttatattaagagtacgttttttcctcactctccatctgcatgcctcaagtggaaatctcgatcgaaagctattcttacagaactgaagagctttgatgctgacctcatgtgcatacaggagttggatgagtatgataccttctacaagaaaaatatggaaaactctggatattcaagtatttacattcagcgatctggagacaaaagagatggctgtggtatattctataaacctaaaagtgcagaactggtgcagaaagaaggaatacattacaatgatttagtggaaaaatacgttcctagtgatcatgtaaatagtgcccaggaaaataattcttcaacagaagaagacaagaatgcaaaaccagataatagcaagcgtggagatccaaatgatccacgtgtaagattgaagcgtgactgtgttggtctgctcgcagctttcaagcttagtgatccttgtgatcacattttaattgtggcaaacacacatatttattgggacccagaatggatcgatgtaaagttggctcaggcaaaatatcttctttcgagagtatctcagtttgagcaactcatctcaaataaatataattgtaaaccttcagtgatcattgctggtgacttcaattcgacccctggtgacaaggtatacaattaccttgtatctgccggcggtgaaactccgatcaagttaagcagcctttatgctgcgaatggaggggagccagagtacacaaactacactcctggctttactggaacactggactacatattcttgtccgatggtagttcaataaaacctactagcctactttgtttgccgcgaggggattctgaggatgtgaaaggaggcttgcccaactttcaacatcctagcgatcatctaccaattggtgctgattttctggtagttaacagctaa

SEQ ID NO: 10744 - protein, 393 aa, Sorghum bicolor
  misc_feature: Ceres ANNOT ID no. 6115416
  misc_feature (74)..(388): Pfam Id: Exo_endo_phos Pfam Desc: Endonuclease/Exonuclease/phosphatase family
  misc_feature (40)..(388): NCBI GI: 42562445 NCBI Desc: endonuclease/exonuclease/phosphatase family protein [arabidopsis thaliana]
  misc_feature (70)..(388): NCBI GI: 145324102 NCBI Desc: endonuclease/exonuclease/phosphatase family protein [arabidopsis thaliana]
  misc_feature (71)..(388): NCBI GI: 79605875 NCBI Desc: hydrolase [arabidopsis thaliana]
  misc_feature (40)..(302): NCBI GI: 42571707 NCBI Desc: endonuclease/exonuclease/phosphatase family protein [arabidopsis thaliana]
  misc_feature (73)..(308): NCBI GI: 3859080 NCBI Desc: spcc5e4.02c [schizosaccharomyces pombe]
MLKPQTSWAASLPLFIVRRCSRSAASPSPAGDRRLSFLPVCKRRMSTLAQPRFAPLPTERIESQTDAGAAGYQFRLVSYNILAQVYIKSTFFPHSPSACLKWKSRSKAILTELKSFDADLMCIQELDEYDTFYKKNMENSGYSSIYIQRSGDKRDGCGIFYKPKSAELVQKEGIHYNDLVEKYVPSDHVNSAQENNSSTEEDKNAKPDNSKRGDPNDPRVRLKRDCVGLLAAFKLSDPCDHILIVANTHIYWDPEWIDVKLAQAKYLLSRVSQFEQLISNKYNCKPSVIIAGDFNSTPGDKVYNYLVSAGGETPIKLSSLYAANGGEPEYTNYTPGFTGTLDYIFLSDGSSIKPTSLLCLPRGDSEDVKGGLPNFQHPSDHLPIGADFLVVNS

SEQ ID NO: 10745 - DNA, 1608 bp, Sorghum bicolor
  misc_feature: Ceres ANNOT ID no. 6115420
  misc_feature: Encodes the peptide sequence at SEQ ID NO 10746
atgggatctgggagcagcaaggccaccaccacctcctcctcctcctcctcctcctcgtcatcgcgcacgttggcggaggcggcgggcggcgaggttaagaggccgaatgggagcgggaaggggaggagggggaggagccttttgccgagctcctcctgcttccgtggctccacgacgccgccgtgcgaaggcgacgcttccgcagcaccggtggacgtcgagtgtaacaagggaggggagactgcaagcctgccttcactcactcacactgcaaagtctgatgaagatgttcttgcaatgcctaagtcttatcccggcgaaggggtagcagtaccttcatcagatagtgaaagagatcaagatgatgatgtgctacagaatgctgctgccactagcacatcaacagcggccaatcaattgccaaatccttctgggaggtcaaggccacgttttggtgtcaactttgggttgagtagagctgtcagcttgggatcatcagcagcctgctctattctgtcatctggcctcccgacttctgctaatccaggtgaaggtcggagagatgtggatgactcttctgatacaggcatctcccagcagggtactgcaccgactgctgggattgattcgactctggatatgcttagagatagtgtcacggcacaagctagagcagctcgtcaggctaggagaaatctgctagaatctgaagatgctagcttgaggagctcctacagaaggatggggtctcaggaaccttttgaaggcagtgttcggtttagccgaacattaagtgttgggcggcttcgggacagagttctcaggcggcctccattctcagatgggctattcaccccttcgcttctttatgatagggcagtatggccatctggaaacgctagtgctaggcaagattcagcagtaatgcaaaggactaattcagacaggagttcagaaccgcgatctgatccttcaaccaacgatatgtacaacttgagctctgagaggcaggccagtaatagcgacctactggagcgcagatcagcttttcttgagaggaggaggaggatacgatctcaggtcagagctctgcaaaggttgggcagcaggtttgaaaatttatcaggtcatgagaggtcctgcatattatccggtcagcatagaacaggaaattgcaactgcagaacaggtagtcgacaaggcaatcctgatgaagaaactagcacaagggctagcatatcgagaattgttatgttagcagaagcactttttgaggttcttgatgaaattcaccaccaatctgctgcattatcgtcatcaagaccatcgttttcttcaattggatccgttcctgctccaagggagattgttgagcgtcttcctgcaaaagtgtataggaaaccgttgaaataccagagcgatgaagctgcacaatgctatatttgccttgttgaatatgaagagggagattgtctccgtatacttccatgccatcatgaatttcatctaacatgtgtagataaatggctaaaggagattcacagggtttgtccactttgtcgtggcgatgtctgcagatctgatgcaccgagtagaaaggtcagctga

SEQ ID NO: 10746 - protein, 535 aa, Sorghum bicolor
  misc_feature: Ceres ANNOT ID no. 6115420
  misc_feature (479)..(520): Pfam Id: zf-C3HC4 Pfam Desc: Zinc finger, C3HC4 type (RING finger)
  misc_feature (1)..(533): NCBI GI: 17978924 NCBI Desc: at5g45290/k9e15_7 [arabidopsis thaliana]
  misc_feature (1)..(533): NCBI GI: 22327588 NCBI Desc: zinc finger (c3hc4-type ring finger) family protein [arabidopsis thaliana]
  misc_feature (297)..(529): NCBI GI: 51091322 NCBI Desc: zinc finger protein-like [oryza sativa (japonica cultivar-group)]
  misc_feature (317)..(525): NCBI GI: 92872222 NCBI Desc: zinc finger, ring-type; ringv [medicago truncatula]
  misc_feature (476)..(521): NCBI GI: 42408776 NCBI Desc: zinc finger protein family-like [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
MGSGSSKATTTSSSSSSSSSSRTLAEAAGGEVKRPNGSGKGRRGRSLLPSSSCFRGSTTPPCEGDASAAPVDVECNKGGETASLPSLTHTAKSDEDVLAMPKSYPGEGVAVPSSDSERDQDDDVLQNAAATSTSTAANQLPNPSGRSRPRFGVNFGLSRAVSLGSSAACSILSSGLPTSANPGEGRRDVDDSSDTGISQQGTAPTAGIDSTLDMLRDSVTAQARAARQARRNLLESEDASLRSSYRRMGSQEPFEGSVRFSRTLSVGRLRDRVLRRPPFSDGLFTPSLLYDRAVWPSGNASARQDSAVMQRTNSDRSSEPRSDPSTNDMYNLSSERQASNSDLLERRSAFLERRRRIRSQVRALQRLGSRFENLSGHERSCILSGQHRTGNCNCRTGSRQGNPDEETSTRASISRIVMLAEALFEVLDEIHHQSAALSSSRPSFSSIGSVPAPREIVERLPAKVYRKPLKYQSDEAAQCYICLVEYEEGDCLRILPCHHEFHLTCVDKWLKEIHRVCPLCRGDVCRSDAPSRKVS

SEQ ID NO: 10747 - DNA, 2769 bp, Sorghum bicolor
  misc_feature: Ceres ANNOT ID no. 6115428
  misc_feature: Encodes the peptide sequence at SEQ ID NO 10748
atgtccgccgcttccaccgccacggccacccgcctcatcctcccgcgcccttcagtcccgttccgctccctcctcctttcccgccgccggggccgcctccgccgcgcgttccacgccagcgccgtcgccgctggcggcggcggaggaggcagcggggccggcgagggcgccgcgaaggagccgccgcggacgctgttccccggcgggttcaagcggccggagatccaggtgccggcgctcgtcctgcgcgtcggcgccgaggaggcgctgcggtgcggggatgaggtggccgccgccgtgtcccggggcgtggggatcgtcgtgctcgaggccggagaggagggcggtgggcgagcgtacgaggccgctcgcgcgctcagggccacggtcggggaccgcgcgtacctgctgatcgcggagcgcgtcgacgtcgcgtccgcagtcggggcgagcggcgtcgtgctcgctgacgatggcattcctgctattgttgcaaggagtatgatgatgaaatcaaatgctgactccatatatctccctattgttgctagaaggatacaatctgcaaactctgcaataagcgcttcaagttctgaaggggctgattttctgattgtaaatactggcactggtgattttacggatcttatgaatggtggtgttggtcaacatgtgaagattccgattttcttcacactgaatcatttgagtgaaggaacttattctgacttcacatccaggttgctccaatctggtgcatctggagttgttacatccttagctggtatgcaacttctcactgatgatcttataaaaaagtacttctcaaaagtggactcagctgaggaagtcccacgagcgagttactcttctgctgggatgctggaagatgttaataatgtaatggtcctaactcgcgatcgcgagaagactaaagttgctggatttacaaaattggatgaaaaagtgatgcagttgatagaaatagagaagcctattcttaatgaagctattgctattatccgcaaggcagcaccaatgatggaggaggttgagcttctagtggatgctgcttctcgcctgagtgagccatttttgttggttactgtgggtgaatttaactcaggaaagtcaacttttataaatgctttacttggaaggcagtatcttcaggagggagttgtgcctacgacaaatgagattacactactatcatattctgaggttgaatctgaaagctttgaacgatgtgagaggcatccagatggtcaattcatgtgctatttatctgttccaattttaaaggaaatgaatctagttgatacacctggaacaaatgttattcttcagaggcagcaacgactcactgaagaatacgtgccacgagctgatttgatactctttgtcctatcatcagatagaccattaactgaaagtgaggttggatttcttcagtatgtccagcagtggaagaagaaagttgtatttgttctaaacaaattggacctctatcggaacagcaatgagcttgaagaagctactgcatttgtcaaggaaaatgcaatgaaattgcttaacgcggaagatgtcacactgtttcctgtatcttcacgctctgctctggaagccaagctttcatattccaaaaacagtgacggaaagcatttgagggaagctatgtttagtgatcctagatggagaagcagcaatttttgtgaacttgaggattacttactgagtttcttagatagttcaacagaaaatggaaaagaaagggtccggctgaaacttgaaacaccaataggcattgcagatcgattgttaacttcatgtcaaagactcgtgaaactagaatatgaaaaggctgttgaagatttaacatccatcaaggatcttgtttatggtgcaaacaattatgccatcaaacttaagtctgatagcaattcctggcagaaccagatttcatctcttattgagagagcaaaaggtcgagcagtaacacttatgggatctacacttcagctgtcaaatattgaccttatttttacatacacggtcaaaggaaaaacaggcagttccacgagagccacatcatttgttcagaatgatattctgagtccaacccttgacgatgctgtgaatttactaggtgactactcgacatggttgagttctagcaatacccgtgaagcaaaagtatatttggagtgtttcagtgcaagatgggatgcactggttggtccagaagaaagggctctgttagatccaaatggacttgtcaatgaaggggagaaactcaccataaaggcactggatggcttcaacgccagtgctgctgccaaggtttttgaagaggaaatcagagaagtggcttttggaacatttggagggctaggtattgctggactgtcagcttctcttttgacatctgttttgtcaactactcttgaagatcttcttgctcttgcgctttgctcagctggcgggttttttgttttatcaagtttccctggtcgacggaagcttgcaatacagaaggttaacaaggctgccgatgaactctcgagaaaagttgatgaagctatccaaaaggatatctcacagagtgctaatgacctaatccgctttgttgaggtcatcagcaaaccttaccaggaagcatgccagcgaaaaatagattggttacagggcgttcagggtgagctatctgctgtcgagcgtaagctccaaactttgaaagttgaaatccaaaatcttcatggatcgtga

SEQ ID NO: 10748 - protein, 922 aa, Sorghum bicolor
  misc_feature: Ceres ANNOT ID no. 6115428
  misc_feature (367)..(501): Pfam Id: Dynamin_N Pfam Desc: Dynamin family
  misc_feature (365)..(502): Pfam Id: MMR_HSR1 Pfam Desc: GTPase of unknown function
  misc_feature (362)..(584): Pfam Id: GTP_EFTU Pfam Desc: Elongation factor Tu GTP binding domain
  misc_feature (247)..(922): NCBI GI: 92911702 NCBI Desc: fzl [arabidopsis thaliana]
  misc_feature (62)..(790): NCBI GI: 4587579 NCBI Desc: f10o3.1 [arabidopsis thaliana]
  misc_feature (247)..(658): NCBI GI: 34365773 NCBI Desc: at1g03160 [arabidopsis thaliana]
  misc_feature (354)..(583): NCBI GI: 113940452 NCBI Desc: dynamin [herpetosiphon aurantiacus atcc 23779]
  misc_feature (333)..(586): NCBI GI: 76259849 NCBI Desc: dynamin:gtp-binding protein, hsr1-related [chloroflexus aurantiacus j-10-fl]
MSAASTATATRLILPRPSVPFRSLLLSRRRGRLRRAFHASAVAAGGGGGGSGAGEGAAKEPPRTLFPGGFKRPEIQVPALVLRVGAEEALRCGDEVAAAVSRGVGIVVLEAGEEGGGRAYEAARALRATVGDRAYLLIAERVDVASAVGASGVVLADDGIPAIVARSMMMKSNADSIYLPIVARRIQSANSAISASSSEGADFLIVNTGTGDFTDLMNGGVGQHVKIPIFFTLNHLSEGTYSDFTSRLLQSGASGVVTSLAGMQLLTDDLIKKYFSKVDSAEEVPRASYSSAGMLEDVNNVMVLTRDREKTKVAGFTKLDEKVMQLIEIEKPILNEAIAIIRKAAPMMEEVELLVDAASRLSEPFLLVTVGEFNSGKSTFINALLGRQYLQEGVVPTTNEITLLSYSEVESESFERCERHPDGQFMCYLSVPILKEMNLVDTPGTNVILQRQQRLTEEYVPRADLILFVLSSDRPLTESEVGFLQYVQQWKKKVVFVLNKLDLYRNSNELEEATAFVKENAMKLLNAEDVTLFPVSSRSALEAKLSYSKNSDGKHLREAMFSDPRWRSSNFCELEDYLLSFLDSSTENGKERVRLKLETPIGIADRLLTSCQRLVKLEYEKAVEDLTSIKDLVYGANNYAIKLKSDSNSWQNQISSLIERAKGRAVTLMGSTLQLSNIDLIFTYTVKGKTGSSTRATSFVQNDILSPTLDDAVNLLGDYSTWLSSSNTREAKVYLECFSARWDALVGPEERALLDPNGLVNEGEKLTIKALDGFNASAAAKVFEEEIREVAFGTFGGLGIAGLSASLLTSVLSTTLEDLLALALCSAGGFFVLSSFPGRRKLAIQKVNKAADELSRKVDEAIQKDISQSANDLIRFVEVISKPYQEACQRKIDWLQGVQGELSAVERKLQTLKVEIQNLHGS

SEQ ID NO: 10749 - DNA, 1644 bp, Sorghum bicolor
  misc_feature: Ceres ANNOT ID no. 6115432
  misc_feature: Encodes the peptide sequence at SEQ ID NO 10750
atgagcctcgccgaggcgccgtcgtcgtccccgtcgtcgtcgagcgggagcgacgacttcgcggccctcctcgcctccgagctcgagctcgagctcgcctccggcgctgactccgccttccctggcgacgcctcctccgctttccccgccaccgacggcgagggcgaggatgaggatgaggatccggaggagctagaggttgaagccgtagaacaaaacgctaccaaaaggcgtagagtggaggaacaacaccgagatcaaggaacatcagttaggcctgacaaaattcccactggtgcatctaaaaatattcaggtcgaggcatgtccacatcctggatatatacgtggactttgctatatatgtggcaatccacaagatgaggaatatatttcaggagttgctttagattacatcgacaagggcttgaggctacgtacctcagaaattgacagacttcgttgtgctgatttgaagaatctgttgcgtgaaagaaaattagtactcattttggacttggatcacacactgatcaactcgaccaaactccaaaatatttcttctgctgaaaaagatttgggtattcagactgctgcttcaaaagatgatccaaacagaagcatctttgcactagaatcaatgcagttgctcacaaagttgagaccatttgtccgagaatttctgaaagaagcaagcaatatgtttgagatgtatatatacaccatgggtgacaaagcttatgcaattgaaattgcaaagcttcttgaccctagcaacatctattttcctttaaaagtgatttcaaactcagattgcactaagcgacaccagaaaggtcttgatgtgattcttggagctgcaagtgttgcagtgattcttgatgacactgagtttgtatggaagaagcataaagagaacctgattctgatggagagatatcatttctttgcttcaagctgccgcgaatttggttttgctgttaggtctttgtcagagttgatgcaagatgaaagggagagtgatggtgctttggctaccgttttagatgtcttgaagcgcatacacgcgattttctttgatatggctgttgaaactgatgatctttcctcacgggatgtaagacaggtgatcaaggcagtacggaaggaaatactgcaaggttgcaaaatagtcttcagtcgggtgttcccaaacaatacacgcccacagaagcagatggtctggaagatggctgagtatctgggtgccgtttgctctacagatgtggattccagtgtcacccatgttgtaactgtggatctaggaacagagaaggcccgctggggtgttgccaacaagaagttcttggtccacccacgctggatcgaagcagcaaatttccggtggcataggcaaccggaggaagattttcctgtcactgccccgaaggaaaagagcagagggaaaaataatgctgtggctggcaagaaggagacgagcaaggataaggagaatgctgcagctggccagaaggaaacgaggaaggacaaagaagaaaatgatgtgtctagtcagaaggaaacgaggaacgtggaaacaaaagtagctggtcatgccaacgaaaacgttgtggccacatctacaacaggtcctgctgactcgtaa

SEQ ID NO: 10750 - protein, 547 aa, Sorghum bicolor
  misc_feature: Ceres ANNOT ID no. 6115432
  misc_feature (380)..(459): Pfam Id: BRCT Pfam Desc: BRCA1 C Terminus (BRCT) domain
  misc_feature (158)..(353): Pfam Id: NIF Pfam Desc: NLI interacting factor-like phosphatase
  misc_feature (34)..(478): NCBI GI: 145334837 NCBI Desc: cpl4 (c-terminal domain phosphatase-like 4) [arabidopsis thaliana]
  misc_feature (104)..(472): NCBI GI: 140052388 NCBI Desc: brct; nli interacting factor [medicago truncatula]
  misc_feature (136)..(472): NCBI GI: 115485681 NCBI Desc: os11g0521900 [oryza sativa (japonica cultivar-group)]
  misc_feature (154)..(476): NCBI GI: 144923902 NCBI Desc: brct; nli interacting factor [medicago truncatula]
  misc_feature (136)..(472): NCBI GI: 77551160 NCBI Desc: ctd phosphatase-like 3 [oryza sativa (japonica cultivar-group)]
  misc_feature: The sequence is a functional homolog of SEQ ID NO. 347 in the 11/188,298 US application
MSLAEAPSSSPSSSSGSDDFAALLASELELELASGADSAFPGDASSAFPATDGEGEDEDEDPEELEVEAVEQNATKRRRVEEQHRDQGTSVRPDKIPTGASKNIQVEACPHPGYIRGLCYICGNPQDEEYISGVALDYIDKGLRLRTSEIDRLRCADLKNLLRERKLVLILDLDHTLINSTKLQNISSAEKDLGIQTAASKDDPNRSIFALESMQLLTKLRPFVREFLKEASNMFEMYIYTMGDKAYAIEIAKLLDPSNIYFPLKVISNSDCTKRHQKGLDVILGAASVAVILDDTEFVWKKHKENLILMERYHFFASSCREFGFAVRSLSELMQDERESDGALATVLDVLKRIHAIFFDMAVETDDLSSRDVRQVIKAVRKEILQGCKIVFSRVFPNNTRPQKQMVWKMAEYLGAVCSTDVDSSVTHVVTVDLGTEKARWGVANKKFLVHPRWIEAANFRWHRQPEEDFPVTAPKEKSRGKNNAVAGKKETSKDKENAAAGQKETRKDKEENDVSSQKETRNVETKVAGHANENVVATSTTGPADS

SEQ ID NO: 10751 - DNA, 2937 bp, Sorghum bicolor
  misc_feature: Ceres ANNOT ID no. 6115441
  misc_feature: Encodes the peptide sequence at SEQ ID NO 10752
atggccgtggccgtggggaagcgggtgctcgacacgggctggctcgccgcgcgctccaccgaggtcgcgctcaccggcgtccagctcaccaccacgcacccgccggcagccgaccccgccccgcccgcgccctggatgagcgccgccgtccccggcaccgtgctggggacgctgctcaagaacaatctcatccccgaccccttctacgggctgaacaaccaggccatcgtcgacatcgccgacgccgggagggactactacaccttttggttcttcaccacgttccagtgtgccccgtcagcaaatcagcacgtgactttaaatttccggggaataaactactcggccgaagtgtacttaaatggtcatgaggaggtactaccaaaaggaatgttccgaaggcacaccattgatattactgacattctccatcctgatggtaacaatcagcttgctgtccttgttcatcctcctgatcaccctggcaaaattcctcctcaggggggccagggtggtgatcatgagattggaaaagatgttgctacacaatatgttgaaggatgggattggatgtgcccaataagggatcgaaatactggtatctgggatgaggtatcaatttccatatctgggcctgtgaatataatagacccccatctggtttcaacttttcatgatgattttaagaggtcatacctacattgtacacttcagttggagaacaaaagttcttggattgcagattgtaccttgaaaatacaggtttcaactgaacttgaagggaacgtttgtttggtggaacacctccaaagttatgcaataacagtccctcctcaatcagatatagagtacaccattccttctttattcttctataagcccaacctgtggtggccaaatggcatgggaaagcaatccctatacaacgttgagattagtgtggatgtcaaagggttcggagaatctgattcctggagccattattttggatttcgcaagattgagagtacaattgatgattctacgggtgggaggatcttcaaggtaaatggtgaacctatttttatccgaggggggaactggatattgtcagatggccttcttagattaacaaagaagcgatatatgactgacatcaagttccacgctgacatgaacttcaatatgcttagatgttggggtggtggattagcagagaggcctgacttttatcatttttgcgatgtctatggtctgatggtatggcaagaattttggataactggagatgttgatggccgaggagatccaatatctaaccttaatggccctttggatcatgatctctttcttttgtgtgctagagataccgtaaaattactcaggaatcatgccagtctagctttatgggttggtggtaatgagcaagtcccaccagttgacattaacaaagcactgaagaatgatttgaagctacatccaatgtttgtaagttaccagacatcaaaaaatgaagaaagatatttatctgaagaatcaactgaccctagtaaataccttgatggtactcgggtgtatgtgcaaggatcgatgtgggatggttttgcgaacggtaaaggtgactggactgatggtccatatgagattcagtatccagagagttttttcaaagacagcttctacaaatatgggttcaatcctgaagttgggtctgtgggggttccagttgccgcaacaattagggccacaatgcctccagtaggatggagcattccaattttcaagaaaagaattgacgggtacattgaagaagtaccaaatccaatatgggactaccacaagtatattccatactcaaaaccagggaaggtccatgatcagattgaattatatggaaccccaaaagacctggatgatttttgtgaaaaggcacagctggtgaactatgttcagtacagagcacttttggaaggatggacttccttcatgtggacaaagtttacaggtgttctaatttggaagacgcagaatccttggactggattaaggggccagttctatgatcacctccaagatcaaaccgctgggttttatggttgccgttgtgcttctgaacctattcatgtccaactgaatttggtcactttctttgtagaggtggtaaacactacagctgatgaactcaaagacatggccgtcgaaatttcagtgtgggatctagatggtgcatgcccttattacaaagttactgagaaaatagttgtaccaccaaagaaagtgaagcaaactatcgagatgaaatacccaaagatgaaagatgccaagcctgtgtattttctgctcctcaaactcttcaggttgtcagacaatggaataatctccagaaacttctactggctacatcttcctgggcaggactacaaattgttggggcagtatcagcagaaaaagattccactaaaaatttattctgacatctcagtttcagggacgatgcacaaagtaagaatgacagtagagaacaactcaaagaagtcagtagcagaaagcacacgttcattatcagcaatggatctaggtgatgtaagtggttcccacagcactggcaaagaaactactcggaagggaaacgagagtgatggactgtggaggaaaataagcaatggccttgggttcgcaagaccaagtgacaaccaaagaacactggaggtcaacgggaccgattcaggggtcgcattcttcctccatttctcagtgcatacctctgaatcatcaacagctaaggaggaatacaatgacacaagaatccttccggtccactactcagacaactacttctcgctgacgccgggggagaagatggccatcgacatctcgttcgaggctccccagggatccaatcccaaagtcgtcctcagaggctggaaccatcatctggaccacgccgtgatgatctga

SEQ ID NO: 10752 - protein, 978 aa, Sorghum bicolor
  misc_feature: Ceres ANNOT ID no. 6115441
  misc_feature (65)..(166): Pfam Id: Glyco_hydro_2_N Pfam Desc: Glycosyl hydrolases family 2, sugar binding domain
  misc_feature (213)..(332): Pfam Id: Glyco_hydro_2 Pfam Desc: Glycosyl hydrolases family 2, immunoglobulin-like beta-sandwichdomain
  misc_feature (2)..(978): NCBI GI: 115463689 NCBI Desc: os05g0391500 [oryza sativa (japonica cultivar-group)]
  misc_feature (1)..(977): NCBI GI: 28195699 NCBI Desc: glycosyl hydrolase [gossypium hirsutum]
  misc_feature (5)..(913): NCBI GI: 118766235 NCBI Desc: endo-beta-mannosidase [lilium longiflorum]
  misc_feature (5)..(913): NCBI GI: 75222425 NCBI Desc: mannosylglycoprotein endo-beta-mannosidase (endo-beta-mannosidase) [contains: mannosylglycoprotein endo-beta-mannosidase 31 kda subunit; mannosylglycoprotein
  misc_feature (5)..(913): NCBI GI: 75222425 (continued) endo-beta-mannosidase 28 kda subunit; mannosylglycoprotein endo-beta-mannosidase 42 kda subunit]
  misc_feature (5)..(853): NCBI GI: 75226517 NCBI Desc: mannosylglycoprotein endo-beta-mannosidase (endo-beta-mannosidase) (atebm) [contains: mannosylglycoprotein endo-beta-mannosidase 31 kda subunit; mannosylglycoprotein
  misc_feature (5)..(853): NCBI GI: 75226517 (continued) endo-beta-mannosidase 28 kda subunit; mannosylglycoprotein endo-beta-mannosidase 42 kda subunit]
  misc_feature (5)..(913): SWISSPROT Homolog: EC 3.2.1.152 Mannosylglycoprotein endo-beta-mannosidase
MAVAVGKRVLDTGWLAARSTEVALTGVQLTTTHPPAADPAPPAPWMSAAVPGTVLGTLLKNNLIPDPFYGLNNQAIVDIADAGRDYYTFWFFTTFQCAPSANQHVTLNFRGINYSAEVYLNGHEEVLPKGMFRRHTIDITDILHPDGNNQLAVLVHPPDHPGKIPPQGGQGGDHEIGKDVATQYVEGWDWMCPIRDRNTGIWDEVSISISGPVNIIDPHLVSTFHDDFKRSYLHCTLQLENKSSWIADCTLKIQVSTELEGNVCLVEHLQSYAITVPPQSDIEYTIPSLFFYKPNLWWPNGMGKQSLYNVEISVDVKGFGESDSWSHYFGFRKIESTIDDSTGGRIFKVNGEPIFIRGGNWILSDGLLRLTKKRYMTDIKFHADMNFNMLRCWGGGLAERPDFYHFCDVYGLMVWQEFWITGDVDGRGDPISNLNGPLDHDLFLLCARDTVKLLRNHASLALWVGGNEQVPPVDINKALKNDLKLHPMFVSYQTSKNEERYLSEESTDPSKYLDGTRVYVQGSMWDGFANGKGDWTDGPYEIQYPESFFKDSFYKYGFNPEVGSVGVPVAATIRATMPPVGWSIPIFKKRIDGYIEEVPNPIWDYHKYIPYSKPGKVHDQIELYGTPKDLDDFCEKAQLVNYVQYRALLEGWTSFMWTKFTGVLIWKTQNPWTGLRGQFYDHLQDQTAGFYGCRCASEPIHVQLNLVTFFVEVVNTTADELKDMAVEISVWDLDGACPYYKVTEKIVVPPKKVKQTIEMKYPKMKDAKPVYFLLLKLFRLSDNGIISRNFYWLHLPGQDYKLLGQYQQKKIPLKIYSDISVSGTMHKVRMTVENNSKKSVAESTRSLSAMDLGDVSGSHSTGKETTRKGNESDGLWRKISNGLGFARPSDNQRTLEVNGTDSGVAFFLHFSVHTSESSTAKEEYNDTRILPVHYSDNYFSLTPGEKMAIDISFEAPQGSNPKVVLRGWNHHLDHAVMI

SEQ ID NO: 10753 - DNA, 834 bp, Sorghum bicolor
  misc_feature: Ceres ANNOT ID no. 6115451
  misc_feature: Encodes the peptide sequence at SEQ ID NO 10754
atgcgcgtgccatgctgctcgttatgcaacgtcagatatgacgaggaggagcggacgccgctgctcctccactgcggccatggattctgccgcgcctgcctctcccgcatgctggcggcagcccccggagccacgctggcgtgcccgcgatgtcgccatccgaccgccgtaggcaactcagtctctgcgctgcggaagaacttccccattctctcgctcctctccgcatccccgtcatccccgtctttcctccactccgactcggggtcatcctccgacggctccgaggatgaggacgacttcttcgcgcgccccagtcgccgccccgcgcccgcgcccgccgctgccccgccaggatgcagctccttcgacctcgtctcacacccggacctcaagctcgcccgtcgcatcgggagcggcccgcccggacccgccgggcaggaggtgtgggccggcatgctgtctcgtggcggcggcggcggcggggtcaagcggtgcaagcaccaggtggcagtgaagagggtgcccctggccgcaggggacgggctcgaggttgttcaggaggaggtggagcggctgaggcgtgcctccacatggtgtcggaacgtgtgcacattccatggtgctgtgagggtcggcggccacctctgtttcgtgatggatcgctatgtcgggtctgtgcaggcggagatgcggcagaatggtggacgcctcacgctggagcagattctcaggtgtgacattgcatctaaacgtcagtacttagtaatatcgagtagctattctttctgctgctgtcttaccaataatcactgcaaacatattagccagtaa

SEQ ID NO: 10754 - protein, 277 aa, Sorghum bicolor
  misc_feature: Ceres ANNOT ID no. 6115451
  misc_feature (6)..(51): Pfam Id: zf-C3HC4 Pfam Desc: Zinc finger, C3HC4 type (RING finger)
  misc_feature (1)..(249): NCBI GI: 9955545 NCBI Desc: ankyrin-repeat containing protein [arabidopsis thaliana]
  misc_feature (1)..(249): NCBI GI: 83817349 NCBI Desc: ring e3 ligase protein [arabidopsis thaliana]
  misc_feature (1)..(253): NCBI GI: 140039463 NCBI Desc: protein kinase; zinc finger, ring-type [medicago truncatula]
  misc_feature (1)..(253): NCBI GI: 140041135 NCBI Desc: protein kinase; zinc finger, ring-type; nucleic acid-binding, ob-fold [medicago truncatula]
  misc_feature (6)..(80): NCBI GI: 83754838 NCBI Desc: chain a, solution structure of the ring domain of the tripartite motif protein 32
  misc_feature: The sequence is a functional homolog of SEQ ID NO. 329 in the 11/188,298 US application
MRVPCCSLCNVRYDEEERTPLLLHCGHGFCRACLSRMLAAAPGATLACPRCRHPTAVGNSVSALRKNFPILSLLSASPSSPSFLHSDSGSSSDGSEDEDDFFARPSRRPAPAPAAAPPGCSSFDLVSHPDLKLARRIGSGPPGPAGQEVWAGMLSRGGGGGGVKRCKHQVAVKRVPLAAGDGLEVVQEEVERLRRASTWCRNVCTFHGAVRVGGHLCFVMDRYVGSVQAEMRQNGGRLTLEQILRCDIASKRQYLVISSSYSFCCCLTNNHCKHISQ

SEQ ID NO: 10755 - DNA, 783 bp, Sorghum bicolor
  misc_feature: Ceres ANNOT ID no. 6115453
  misc_feature: Encodes the peptide sequence at SEQ ID NO 10756
atgggggtaggcgagtgcaagagcaacgactacggcgccgccgcatactgggacgcccgttactcctccggctccccagcttccgccgccgccgccgccggctgtgggttcttcgactggtaccagacgtacccggcgctgcggtcgctcctccgcgcccgcgtgccgacctcctcccgcgtcctcatgctcggctgcggcaactcccttttgtcagaggatatggcgaaggatggttatgaggacattgtaaacatagacatttcatctgtggtcatcgagcagatgagagagaaacacaaggagatcacacagctaacatatatgcagatggatattagggacatgggtttctttggtgatgaatcatttgattgtgtccttgataaaggaaccatggatgctatgatgtgtgctgatgatgctcctcatggtgcttccaaaatgctagcagaagtggcaaggcttctgatgcctcatggggtctacctgttgataacatatggtgctcctaaggaacgagtcccacttttgaaccagtccggatgcagctggagtattgcactctacatcatgcccacacctggatacctactgagaatgagtgaaggtgctccacagcctatcatggaggaagttacactcacagacgatgggcaactaccacctgactatgttctcaaagatccagagtcgcatttcatttatgtctgtcacaagttggcagagaaaggggctaattgcagagatactgatccaggggaaacagcaaattcaaattaa

SEQ ID NO: 10756 - protein, 260 aa, Sorghum bicolor
  misc_feature: Ceres ANNOT ID no. 6115453
  misc_feature (62)..(165): Pfam Id: Methyltransf_11 Pfam Desc: Methyltransferase domain
  misc_feature (93)..(259): NCBI GI: 115463699 NCBI Desc: os05g0392200 [oryza sativa (japonica cultivar-group)]
  misc_feature (8)..(187): NCBI GI: 146186037 NCBI Desc: protein kinase domain containing protein [tetrahymena thermophila sb210]
  misc_feature (3)..(187): NCBI GI: 50198934 NCBI Desc: at4g34360 [arabidopsis thaliana]
  misc_feature (10)..(260): NCBI GI: 66359066 NCBI Desc: methylase [cryptosporidium parvum]
  misc_feature (10)..(260): NCBI GI: 46228382 NCBI Desc: methylase [cryptosporidium parvum]
  misc_feature: The sequence is a functional homolog of SEQ ID NO. 415 in the 11/188,298 US application
MGVGECKSNDYGAAAYWDARYSSGSPASAAAAAGCGFFDWYQTYPALRSLLRARVPTSSRVLMLGCGNSLLSEDMAKDGYEDIVNIDISSVVIEQMREKHKEITQLTYMQMDIRDMGFFGDESFDCVLDKGTMDAMMCADDAPHGASKMLAEVARLLMPHGVYLLITYGAPKERVPLLNQSGCSWSIALYIMPTPGYLLRMSEGAPQPIMEEVTLTDDGQLPPDYVLKDPESHFIYVCHKLAEKGANCRDTDPGETANSN

SEQ ID NO: 10757 - DNA, 1008 bp, Sorghum bicolor
  misc_feature: Ceres ANNOT ID no. 6115457
  misc_feature: Encodes the peptide sequence at SEQ ID NO 10758
atggcgggtgatggcggcggcggggtggactgggagagcctggcggaggccacctccggggcaatcggctcgctcgtcagcaccaccgtgctctacccgctcgacacctgcaagaccaagttccaggccgagctccagacgcagcacggcgcgcagaagtataggaacctttcagatgtcttttgggaagcgattcgtaaaaggcaatttttgtctctatatcagggccttaacacgaagaacattcagtcttttgtttcctcgtttttttatttttatgggtatagctattttaaaagactctacttagagaagagtggagcaaagtctattggaacatctgccaacttgttagttgcagctgctgctggtgcttgcactgttatcgttacacagccattagatacagcagcttctaggatgcagacaagtgcctttggaaagtctaaagggctgagggaaactctttcagaaggcacttggatggaagcattcgatggcttgggcatttccatcatattgacttgcaatccttctattcagtacaccgtatttgatcagctcaagcaaaggataattcagaggcagcgacgcaaaaatgcaggatcagcagaggataattcccgagttgctctttctgctttctcagcttttctgcttggtgccgtctccaaaagtattgctacagtattaacttatccattaatcaggtgcaaggtgatgattcaggctgcagacccagatgaagatgatgacaatgaatctgaaaggccaagcaaatcaagagcaccaaaaacaatggcaggtgccttgcatgctatctggaccaaggaaggcattccaggcttcttcaaaggcctgaatgctcagatccttaaaacagttttgagctccgccttgctgctgatgataaaggagaagatctcgaagttcacttgggtctctctgcttgccctgcggcggtatctcttcgtttctcagaagaggatcaagagtgtaactgtataa

SEQ ID NO: 10758 - protein, 335 aa, Sorghum bicolor
  misc_feature: Ceres ANNOT ID no. 6115457
  misc_feature (12)..(106): Pfam Id: Mito_carr Pfam Desc: Mitochondrial carrier protein
  misc_feature (112)..(196): Pfam Id: Mito_carr Pfam Desc: Mitochondrial carrier protein
  misc_feature (213)..(316): Pfam Id: Mito_carr Pfam Desc: Mitochondrial carrier protein
  misc_feature (165)..(317): NCBI GI: 145341453 NCBI Desc: mc family transporter: peroxisomal membrane protein [ostreococcus lucimarinus cce9901]
  misc_feature (46)..(319): NCBI GI: 126132408 NCBI Desc: adp/atp carrier protein [pichia stipitis cbs 6054]
  misc_feature (9)..(309): NCBI GI: 24657533 NCBI Desc: cg32250-pa [drosophila melanogaster]
  misc_feature (9)..(309): NCBI GI: 25012556 NCBI Desc: re36975p [drosophila melanogaster]
  misc_feature (11)..(313): NCBI GI: 89267378 NCBI Desc: solute carrier family 25 (mitochondrial carrier; peroxisomal membrane protein, 34kda), member 17 [xenopus tropicalis]
  misc_feature: The sequence is a functional homolog of SEQ ID NO. 385 in the 11/188,298 US application
MAGDGGGGVDWESLAEATSGAIGSLVSTTVLYPLDTCKTKFQAELQTQHGAQKYRNLSDVFWEAIRKRQFLSLYQGLNTKNIQSFVSSFFYFYGYSYFKRLYLEKSGAKSIGTSANLLVAAAAGACTVIVTQPLDTAASRMQTSAFGKSKGLRETLSEGTWMEAFDGLGISIILTCNPSIQYTVFDQLKQRIIQRQRRKNAGSAEDNSRVALSAFSAFLLGAVSKSIATVLTYPLIRCKVMIQAADPDEDDDNESERPSKSRAPKTMAGALHAIWTKEGIPGFFKGLNAQILKTVLSSALLLMIKEKISKFTWVSLLALRRYLFVSQKRIKSVTV

SEQ ID NO: 10759 - DNA, 2403 bp, Sorghum bicolor
  misc_feature: Ceres ANNOT ID no. 6115464
  misc_feature: Encodes the peptide sequence at SEQ ID NO 10760
atggcctcctcctccctcccggcgccgccggccccgccctcttcctcctggcgcgggctcacgccccgccgccctacgcctcgccgcggccccctcctcctcgcccgcgcggcggcgcgctcttgccgctaccgcttccggaccgacgacgacggcgtggtggacgtggccgtcgccgggaaagacggcgatgcggggtacgcggtcgctgtagaggccccggcccatggacggcggagcggcggtctggtgctccgtcccgccggctccggcgagggcgtctctctggcccctgccgcgccgggaggcgcgctcgcggctgagctgtcctacgacggggcccgcgcgccgttccacgtctcgttcacgctggccgacgcgacgggagcggagatacggacgcaccgcgggacgagcttccgcgtgcctgtgggcgtcggacggggctgcccctcgccgctcggcctgtcccggtccaaggacggggccgctaacttcgcggtttacagcaagagcgccaagggcatggtgctctgcctgttcggcggcggggacgagcccgcgctggagatcgagctcgacccgtatgtccaccggacaggcgatgtctggcacgtctcgatggagagcgtggagggatacgccagctacggcttccgcagcgggctgttcgccatgtttggcattgaccgtccgctgctcgacccgtacgccaaggtgatcggggacttcgtccctgccgactctgttaatgaggatgggctagcggtgccggccgtcaggtgcctcgcgtccttgaagaatgcacccagctacgattggggcagggacaagcatccgtgcttgccattggagaagctggtggtctaccgggcaaatgtagctttgttcaccaaggacaagtcgagtggactagcagacgatgtcgccggtactttctctggcatggctgcgaaggtgaaacacttcaggcatcttggtgtcaatgcagttttgctggagccagtgtttccataccaccaagtgaagggaccatatttcccgtaccatttcttttcacctatgagcttgtatagcagtgaatgctccagtgtttcagctatcaagtctatgaaggatatggtcaaaacaatgcacagaaatggaatagaggttctcttggaggttgttttcacgcatactgctgaaggaggagcagagtgtcagatgatatcgctccgaggcattgatggttcctcgtactacattgctgacggaattgctggatgcaaggcaagtgtgttgaattgcaaccatccggtgactcagaagctgattttggacagcctccgccattgggtgctcgacttccatgttgatgggttctgcttcatcaatgcccctttccttgtcagaggtccaggtggtgagggcctttcacggcctccacttcttgaagccatagcatttgaccctgttctttcaaagactaagatcattgcagatccttggtctccacttgacatatctaatgtgcaatttccattccctcattggaaaagatgggctgagatgaacacaagattctctatggatgtgcgcaagtttcttaagggagaagcacttatcagtgatcttgctacacgtttgtgtggcagcggggatttattttcctcaaggggcccagcgttttcgttcaattatgtatccaggaattctggactcactcttgttgatctggtgagcttcagcagtgatgagcttggttctgagttcagttggaattgtggtgaagaaggaccatcagagaacaatgcagtcctccaaacgaggctaaggcagatacgcaatttattatttattctatttatttcccttggtatccctgttcttaacatgggagatgaatgtggacactctgctgttggttcaacatcatacaaggatagagggcctctgaactggaaagccctgaagaccacttttgttaaggaagtcacagggtttatttcatttctatctgcactaaggagtcgacgagcggacattttccagagaagagaatttctaaaatttgaaaatatacattggtatgggagtgatttatctgaaccacgttgggaggatcctactagcaactttctttgtatgcacataaatgcggagctggacgagaagctaccagattcaactggaggtgatttgtatatctgtttcaatgcaaacgaggagtcagcaagtgctactttaccagctattgcagaaggatccatgtggttgcgcttggttgatacatcacttgcatttccaggtttcttttcaagagggtctaatcctgaaatacacaaagtgctaggattttcctcatatcaagtaaacgcacatagttgtgttttgtttgaatcgaagagggttctttcctag

SEQ ID NO: 10760 - protein, 800 aa, Sorghum bicolor
  misc_feature: Ceres ANNOT ID no. 6115464
  misc_feature (153)..(238): Pfam Id: Isoamylase_N Pfam Desc: Isoamylase N-terminal domain
  misc_feature (303)..(663): Pfam Id: Alpha-amylase Pfam Desc: Alpha amylase, catalytic domain
  misc_feature (3)..(800): NCBI GI: 29126647 NCBI Desc: isoamylase-type starch debranching enzyme iso2 [zea mays]
  misc_feature (11)..(799): NCBI GI: 41687960 NCBI Desc: 85kda isoamylase [hordeum vulgare subsp. vulgare]
  misc_feature (4)..(738): NCBI GI: 115463713 NCBI Desc: os05g0393700 [oryza sativa (japonica cultivar-group)]
  misc_feature (101)..(798): NCBI GI: 27728147 NCBI Desc: isoamylase isoform 2 [solanum tuberosum]
  misc_feature (108)..(795): NCBI GI: 139867055 NCBI Desc: isoamylase-type starch-debranching enzyme 2 [phaseolus vulgaris]
MASSSLPAPPAPPSSSWRGLTPRRPTPRRGPLLLARAAARSCRYRFRTDDDGVVDVAVAGKDGDAGYAVAVEAPAHGRRSGGLVLRPAGSGEGVSLAPAAPGGALAAELSYDGARAPFHVSFTLADATGAEIRTHRGTSFRVPVGVGRGCPSPLGLSRSKDGAANFAVYSKSAKGMVLCLFGGGDEPALEIELDPYVHRTGDVWHVSMESVEGYASYGFRSGLFAMFGIDRPLLDPYAKVIGDFVPADSVNEDGLAVPAVRCLASLKNAPSYDWGRDKHPCLPLEKLVVYRANVALFTKDKSSGLADDVAGTFSGMAAKVKHFRHLGVNAVLLEPVFPYHQVKGPYFPYHFFSPMSLYSSECSSVSAIKSMKDMVKTMHRNGIEVLLEVVFTHTAEGGAECQMISLRGIDGSSYYIADGIAGCKASVLNCNHPVTQKLILDSLRHWVLDFHVDGFCFINAPFLVRGPGGEGLSRPPLLEAIAFDPVLSKTKIIADPWSPLDISNVQFPFPHWKRWAEMNTRFSMDVRKFLKGEALISDLATRLCGSGDLFSSRGPAFSFNYVSRNSGLTLVDLVSFSSDELGSEFSWNCGEEGPSENNAVLQTRLRQIRNLLFILFISLGIPVLNMGDECGHSAVGSTSYKDRGPLNWKALKTTFVKEVTGFISFLSALRSRRADIFQRREFLKFENIHWYGSDLSEPRWEDPTSNFLCMHINAELDEKLPDSTGGDLYICFNANEESASATLPAIAEGSMWLRLVDTSLAFPGFFSRGSNPEIHKVLGFSSYQVNAHSCVLFESKRVLS

SEQ ID NO: 10761 - DNA, 1557 bp, Sorghum bicolor
  misc_feature: Ceres ANNOT ID no. 6115480
  misc_feature: Encodes the peptide sequence at SEQ ID NO 10762
atggcggcggcggcggggagggcgcgggcggtgagcctggcggcggcggtgcgcgtggtggcggccacggcgcggccggcgtcgagcgcggccgcggcggcgggagtgggcgcgatggcgttgatcgtgcagggggaggacacggccttcgggtcgctggagtggtgggcgtacgcgggcatctcctgcttcctcgtgctcttcgccgggatcatgtccgggctcacactcgggctcatgtcgctcggcctcgtcgagctggagatcctccaacgcagcggcaccgacgccgagaaggctcaggctgctgccatccttccagttgttcaaaagcaacaccagcttcttgtcaccctgttgttgtgtaatgctgctgccatggaggcacttcctatatttcttgacagaatgtttcatcctgttgttgctgtaatattgtcagtgacatttgttcttgcctttggagaggttataccgcaagcaatctgtaccagatatggtctggcagtgggtgctaactttgtatggctcgtacgcattctcatggtcatctgctatccaatttcttaccctattgggaagatcttggactgtgctcttgggcacaatgagtctgcactttttaggcgagctcagttgaaagctcttgtttcaatccatagcaaagaggctggcaagggtggagagctcacccatgatgagactacaatcataagtggagccttggacctgaccgaaaagactgctgcagaagctatgacacctattgagtcaactttctcactagatgtggattccaagttggactgggaagctattggaaaaattcttgcccgtggtcacagtcgtgttcctgtatactcagggaaccctaaaaacatcatcggtctcctattggtgaagagtcttttgactgttcgtgctgaaactgagacgccagttagtgctgtttcaattagaaggattccaagggttccttcagacatgcctttgtatgatatactcaatgagtttcagaaaggaagtagtcatatggctgctgttgtgaaggctaaacccaaaactgaaccactccctgataaaactgaaccaaacagggaagtagttgggtcagcacagttgactgttcccttgttatctaatgctgaagaaagtgcagacaatgtggttgtggatatcgaaagaccacataacaggcaggttaatggaaacgcagtgcctaggtcatcagaggatattgaggacggtgaggtcgttggtatcatcacacttgaagatgtatttgaagaactcctacaggaggaaatagtggatgagactgatgaatatgttgatgttcataaaaggatccgagtagctgctgctgccgctgcatcatcggttgcaagggctccatccgttaggagattaacaggccaaaaggctgcaaaccttcagggagcacagaatcgccaaggacagcaacctcctggaattctcaagaaacccactgagggtgattcaaacccatcaaaacaagtgaaccttgtggagcctcttctggaaaagaggaggtaa

SEQ ID NO: 10762 - protein, 518 aa, Sorghum bicolor
  misc_feature: Ceres ANNOT ID no. 6115480
  misc_feature (253)..(369): Pfam Id: CBS Pfam Desc: CBS domain pair
  misc_feature (42)..(508): NCBI GI: 92871388 NCBI Desc: cbs [medicago truncatula]
  misc_feature (54)..(368): NCBI GI: 92882068 NCBI Desc: cbs [medicago truncatula]
  misc_feature (52)..(367): NCBI GI: 20856058 NCBI Desc: at4g33700/t16l1_190 [arabidopsis thaliana]
  misc_feature (55)..(385): NCBI GI: 42569036 NCBI Desc: cbs domain-containing protein [arabidopsis thaliana]
  misc_feature (55)..(460): NCBI GI: 42568492 NCBI Desc: cbs domain-containing protein-related [arabidopsis thaliana]
MAAAAGRARAVSLAAAVRVVAATARPASSAAAAAGVGAMALIVQGEDTAFGSLEWWAYAGISCFLVLFAGIMSGLTLGLMSLGLVELEILQRSGTDAEKAQAAAILPVVQKQHQLLVTLLLCNAAAMEALPIFLDRMFHPVVAVILSVTFVLAFGEVIPQAICTRYGLAVGANFVWLVRILMVICYPISYPIGKILDCALGHNESALFRRAQLKALVSIHSKEAGKGGELTHDETTIISGALDLTEKTAAEAMTPIESTFSLDVDSKLDWEAIGKILARGHSRVPVYSGNPKNIIGLLLVKSLLTVRAETETPVSAVSIRRIPRVPSDMPLYDILNEFQKGSSHMAAVVKAKPKTEPLPDKTEPNREVVGSAQLTVPLLSNAEESADNVVVDIERPHNRQVNGNAVPRSSEDIEDGEVVGIITLEDVFEELLQEEIVDETDEYVDVHKRIRVAAAAAASSVARAPSVRRLTGQKAANLQGAQNRQGQQPPGILKKPTEGDSNPSKQVNLVEPLLEKRR

SEQ ID NO: 10763 - DNA, 1617 bp, Sorghum bicolor
  misc_feature: Ceres ANNOT ID no. 6115487
  misc_feature: Encodes the peptide sequence at SEQ ID NO 10764
atgtccccctctctcgcgctggcgcattcctcactcccgttcccttcgcgccgcgcgctccccacccagctgccccgccgcctcgcccccaaacacccgtccccttgtgcttatggtctcctcctcgacggtacgctccagcggccgctccgcacgcctcgacgcctcgccgtcttcgccagtgcttcggcggcgtccgctgtggtcccgccgcatggagagggaggtggtggcacggcggcggggcggaagcgcacggggtaccggaaccggttcctggacctggcgcggcttggggcggtggcggagggctcggcggaggccttcttccgcagcgagatccgccgccggctggccgtcactgccgcgctcatcgtgctcagccgcgtgggctacttcatcccgctcccagggttcgaccgccgcctcatcccagactcttacctcagcttctccccgcttcctgcagatgacctaggtgatttctcctcagaattgaagctttcgtttttccagctggggatcagtcatcaaatttcagcatctattgtcatgcaggttctctgtcatgttcttccatcacttgaaaagctccgcaaggaaggattagacggacatgagaagttaaaaggctatatatggtggctttctttgtgttttgcaactgtggctgcttttactgtgtcatgctattccctgcagtattcagtatatgctgcaagttacagggttaagcatataattataacaagtcttttgcttgttcttggtgcaatgtcaatgacatggatttgtgacaccataacagaatctggatttggacatggttcatctttgattatctgtgtgggaattttgactggctacacagatacactacacaagatgataactcagttttcagggaatttttcctattgttggccttacgtcttgggagtagctggaatttttatgattctcaccatgggggctgtgctggtgactgaaggatgcaggaagataaaacttcagtactacggatttaaattagcttctggtgcagggaatgaaagcaccccagttacagaggttgagccatatatccccttcaacatcaatccgactggaatgcagcccttgcttacaacctcatacttgctagcttttccaagcatcatggccagtatttttgcctcgcccttttgggaaaacttgagggaaattttgaatccaaagacttcaactggtggtactccctgggtttattactcgacatatgcttttcttgtcttcgtcttcaatatttttgatattgctaacttacccaaagagatatctgattacctgaataagatgagtgcgagggtaccaaggataaagcctggaagagcaacagtagactaccttacaaagatacaaacatcaacgcgtttttggggaggtctactgctaagcttgcttgcaacttcctctttattgcttgaccgatatctcaggcaaataaatgaagggttttcaatagggttcacatcagtcttgattattgtgggctcaatcattgagcttagaagatcatatcaagcgtacaatgtgatgccagcactaagcaaagttctgaggagatatggtgcttaa

SEQ ID NO: 10764 - protein, 538 aa, Sorghum bicolor
  misc_feature: Ceres ANNOT ID no. 6115487
  misc_feature (169)..(519): Pfam Id: SecY Pfam Desc: eubacterial secY protein
  misc_feature (10)..(538): NCBI GI: 115463737 NCBI Desc: os05g0397700 [oryza sativa (japonica cultivar-group)]
  misc_feature (92)..(523): NCBI GI: 78780017 NCBI Desc: secy protein [prochlorococcus marinus str. mit 9312]
  misc_feature (92)..(523): NCBI GI: 126697069 NCBI Desc: preprotein translocase secy subunit [prochlorococcus marinus str. mit 9301]
  misc_feature (105)..(534): NCBI GI: 3603059 NCBI Desc: secy-type transporter protein [guillardia theta]
  misc_feature (105)..(534): NCBI GI: 81182 NCBI Desc: preprotein translocase secy - cryptomonas sp. chloroplast
MSPSLALAHSSLPFPSRRALPTQLPRRLAPKHPSPCAYGLLLDGTLQRPLRTPRRLAVFASASAASAVVPPHGEGGGGTAAGRKRTGYRNRFLDLARLGAVAEGSAEAFFRSEIRRRLAVTAALIVLSRVGYFIPLPGFDRRLIPDSYLSFSPLPADDLGDFSSELKLSFFQLGISHQISASIVMQVLCHVLPSLEKLRKEGLDGHEKLKGYIWWLSLCFATVAAFTVSCYSLQYSVYAASYRVKHIIITSLLLVLGAMSMTWICDTITESGFGHGSSLIICVGILTGYTDTLHKMITQFSGNFSYCWPYVLGVAGIFMILTMGAVLVTEGCRKIKLQYYGFKLASGAGNESTPVTEVEPYIPFNINPTGMQPLLTTSYLLAFPSIMASIFASPFWENLREILNPKTSTGGTPWVYYSTYAFLVFVFNIFDIANLPKEISDYLNKMSARVPRIKPGRATVDYLTKIQTSTRFWGGLLLSLLATSSLLLDRYLRQINEGFSIGFTSVLIIVGSIIELRRSYQAYNVMPALSKVLRRYGA

SEQ ID NO: 10765 - DNA, 714 bp, Sorghum bicolor
  misc_feature: Ceres ANNOT ID no. 6115493
  misc_feature: Encodes the peptide sequence at SEQ ID NO 10766
atgacaatggagtcacctacaactgccgctggtgatgaactcgagagctacttgtccttgggtttgacagtatcctgctcagggaaagatagtgctgagtttccaaaggttctgttgcttctctcagcgtatcttgacaagaaggttcaggagaatgaagagttattagattccagtaaaacaaaggagtcaaccactatctttcatggtcagagggtgcctgaacttagtataaagctctatgcagaacgcattttcaagtatgcaaagtgcagcccatcttgctttgtgctgggacttatctacattgagagatatctacagcaaccaaacatttacatgacgtcatttagtgtccatcgcttgcttattgcaagtgttgttgttgctgccaaattcatagatgatgcttttttcaacaatgcatactacgggagagttggaggaattaccacaagagagatgaatatgcttgaactggatttgttgttcagtctggacttcaggctcaaagtggatatagagacttttggaagctactgcttgcagttggagaaggaagctctggttcttgttttggagagaccaattcaggtccaagcagccaacgtgactaaacacctgatttgtaacagcagtgccgatgagacttgcaaacacgagctcgtgcgggaaaggtacagcagtcaggctgtccatggttgtagctggtaa

SEQ ID NO: 10766 - protein, 237 aa, Sorghum bicolor
  misc_feature: Ceres ANNOT ID no. 6115493
  misc_feature (35)..(170): Pfam Id: Cyclin Pfam Desc: Cyclin
  misc_feature (54)..(171): Pfam Id: Cyclin_N Pfam Desc: Cyclin, N-terminal domain
  misc_feature (30)..(189): NCBI GI: 2982283 NCBI Desc: preg-like protein [picea mariana]
  misc_feature (8)..(187): NCBI GI: 52627113 NCBI Desc: at3g21870 [arabidopsis thaliana]
  misc_feature (35)..(192): NCBI GI: 38566658 NCBI Desc: at5g61650 [arabidopsis thaliana]
  misc_feature (112)..(187): NCBI GI: 41053064 NCBI Desc: preg-like protein [oryza sativa (japonica cultivar-group)]
  misc_feature (25)..(224): NCBI GI: 7288003 NCBI Desc: regulatory protein-like [arabidopsis thaliana]
MTMESPTTAAGDELESYLSLGLTVSCSGKDSAEFPKVLLLLSAYLDKKVQENEELLDSSKTKESTTIFHGQRVPELSIKLYAERIFKYAKCSPSCFVLGLIYIERYLQQPNIYMTSFSVHRLLIASVVVAAKFIDDAFFNNAYYGRVGGITTREMNMLELDLLFSLDFRLKVDIETFGSYCLQLEKEALVLVLERPIQVQAANVTKHLICNSSADETCKHELVRERYSSQAVHGCSW

SEQ ID NO: 10767 - DNA, 2238 bp, Sorghum bicolor
  misc_feature: Ceres ANNOT ID no. 6115494
  misc_feature: Encodes the peptide sequence at SEQ ID NO 10768
atggaggcggagcagcaaaagcagccccagcgcccgcgccgcaaggggcagaagcggaagttggaggacgaggcatccgccgccgccgccgccgccgccgccgccgcggtagccgccgccgcgtcctcgctcggcagcgcgggcgccgacgatgacaacgaggaggaggacggctcggcgggcacccccgagatctgctgccgccactcccacgcggcgctggcccgcgaggtccgcgtgcaggttgatgtcctcgtccgctgcgcctcttcgtggcgccacgccgaccgcgccgccgccaagcgcgccacccacgtcctcgctgagctcgccaaaaacgaggaggttgtcaacgtgattgtagagggcggcgccgtggcggccttggtgtgccacctagaagagcctgctgtggcggcgccaacgcaggaggaacaacaactgcggccgtttgagcacgaggttgagaagggcgctgccttcgctctgggcctcctagctgtaaagcctgaacatcaacaacttatagttgatgctggtgcactacctcctctagtgaaactcttgaaaaggcagaaaaatactacaaattcgagggtggttaatagcgttatcaagagagcagctgatgcaattacaaatcttgcacatgagaatagcaacatcaaaactagcgtcagaatggaaggtggaatcccgccacttgttgaattgttagaatcgcaggatcttaaggtgcagagggcagctgcaggtgccttgcggactttagcctttaaaaatgatgaaaataaaactcagattgttcaatgcaatgctttgccaactttgatcttaatgctgcgatctgaagatgctgcaattcactatgaagcagttggtgtcattggaaatttggttcattcatcaccaaacatcaagaaggaggttcttaatgcaggggcactacaacctgtgattggattattaagctcatgttgtacagaaagccaaagagaggctgctttgttgctagggcaatttgcttcggccgactcagattgcaaggtccatattgtgcaaagaggtgcagtccgtccactaattgaaatgctacagtcagctgatgtccaactccgggagatgtctgcttttgcacttggcaggcttgcccaggacacacataaccaagcaggtattgcatataatggtggtttggcgcctttgttaaaacttcttgactcaaaaaatggatcgctgcaacataatgctgcatttgccctttatggagttgcagataatgaggactatgtatctgacttcattaaagttggaggtgtccaaaagttgcaagatggagaatttattgtccaggcaacaaaggactgtgtggcaaaaacattgaagaggttagaggagaagataaatggacgagtgttgaaacacttgctttatttgatgcgagtaggagagaaatctgtgcaaaggcgtgttgctctggctcttgcacacctttgtgcccctgaagatcaaagaacaatttttattgataataatggtctcgacttgcttcttgatcttctgatttccatgagctcaaaacatcaacaagatggctcagcagcattatacaaattggccaacaaagcagcagcactttctcccatggatgctgctcctccatccccaacacctcaggtttatcttggtgagcaatacgtgaatagttcaacactttcagacgttactttcttggtagaaggaaagcgcttttatgcacacagaattgctttgcttgcttcttcagatgcatttcgtgcaatgtttgatggcgggtacagggaaaaggatgcaagagacattgaaattccaaatatcaaatgggaggtctttgaactcatgatgagatttatctatacagggtcagtgcaggttaccagtgaaattgcacaggatcttcttagagctgcggatcagtatctcttagaaggcctcaaacgcctatgtgaatatactattgcgaaggatgtgaatcttgataacgtatctgacatgtatgacttgtccgaagcctttcatgccgtgtcactgagacatacatgcatcttgtacattctggaacattttaacaagatctgcaccagagccggttctccacagctgatccagcgtgtcattccagagctccgcaatttcctaaccaaggcactgagttcatcaagaagtccaagcccaagcgacaggaactcgcagatttga

SEQ ID NO: 10768 - protein, 745 aa, Sorghum bicolor
  misc_feature: Ceres ANNOT ID no. 6115494
  misc_feature (169)..(217): Pfam Id: Arm Pfam Desc: Armadillo/beta-catenin-like repeat
  misc_feature (219)..(259): Pfam Id: Arm Pfam Desc: Armadillo/beta-catenin-like repeat
  misc_feature (261)..(301): Pfam Id: Arm Pfam Desc: Armadillo/beta-catenin-like repeat
  misc_feature (345)..(385): Pfam Id: Arm Pfam Desc: Armadillo/beta-catenin-like repeat
  misc_feature (562)..(670): Pfam Id: BTB Pfam Desc: BTB/POZ domain
  misc_feature (73)..(733): NCBI GI: 30687245 NCBI Desc: armadillo/beta-catenin repeat family protein / btb/poz domain-containing protein [arabidopsis thaliana]
  misc_feature (50)..(735): NCBI GI: 140071309 NCBI Desc: btb/poz [medicago truncatula]
  misc_feature (78)..(738): NCBI GI: 30684235 NCBI Desc: armadillo/beta-catenin repeat family protein / btb/poz domain-containing protein [arabidopsis thaliana]
  misc_feature (73)..(479): NCBI GI: 15239713 NCBI Desc: armadillo/beta-catenin repeat family protein / btb/poz domain-containing protein [arabidopsis thaliana]
  misc_feature (50)..(385): NCBI GI: 144923448 NCBI Desc: armadillo [medicago truncatula]
  misc_feature: Useful for making plants with modulated drought sensitivity
  misc_feature: GREAT-hit functional homolog of the protein sequence given in SEQ ID NO 13366
  misc_feature: Useful for making plants with modulated drought sensitivity
  misc_feature: Functional homolog of the protein sequence given in SEQ ID NO 13366
  misc_feature: The sequence is a functional homolog of SEQ ID NO. 309 in the 11/188,298 US application
  misc_feature: The sequence is a functional homolog of SEQ ID NO. 528 in the 11/188,298 US application
MEAEQQKQPQRPRRKGQKRKLEDEASAAAAAAAAAAVAAAASSLGSAGADDDNEEEDGSAGTPEICCRHSHAALAREVRVQVDVLVRCASSWRHADRAAAKRATHVLAELAKNEEVVNVIVEGGAVAALVCHLEEPAVAAPTQEEQQLRPFEHEVEKGAAFALGLLAVKPEHQQLIVDAGALPPLVKLLKRQKNTTNSRVVNSVIKRAADAITNLAHENSNIKTSVRMEGGIPPLVELLESQDLKVQRAAAGALRTLAFKNDENKTQIVQCNALPTLILMLRSEDAAIHYEAVGVIGNLVHSSPNIKKEVLNAGALQPVIGLLSSCCTESQREAALLLGQFASADSDCKVHIVQRGAVRPLIEMLQSADVQLREMSAFALGRLAQDTHNQAGIAYNGGLAPLLKLLDSKNGSLQHNAAFALYGVADNEDYVSDFIKVGGVQKLQDGEFIVQATKDCVAKTLKRLEEKINGRVLKHLLYLMRVGEKSVQRRVALALAHLCAPEDQRTIFIDNNGLDLLLDLLISMSSKHQQDGSAALYKLANKAAALSPMDAAPPSPTPQVYLGEQYVNSSTLSDVTFLVEGKRFYAHRIALLASSDAFRAMFDGGYREKDARDIEIPNIKWEVFELMMRFIYTGSVQVTSEIAQDLLRAADQYLLEGLKRLCEYTIAKDVNLDNVSDMYDLSEAFHAVSLRHTCILYILEHFNKICTRAGSPQLIQRVIPELRNFLTKALSSSRSPSPSDRNSQI

SEQ ID NO: 10769 - DNA, 1149 bp, Sorghum bicolor
  misc_feature: Ceres ANNOT ID no. 6115511
  misc_feature: Encodes the peptide sequence at SEQ ID NO 10770
atgcgtttcacggtgctgctcctcggcgtggccgcgctgctctgcctcggcggtggcggccgtgcggcggcgtccacggacttcaacttcccggcggtgttcaacttcggggactccaactccgacaccggcggccgcgtggccgccggcttcgaggccatcttcccgccctacggctccaccttcttcggcggtcccgccggccgcttctgcgacggccgcctcatcatcgacttcctcatggaggcaatagatatgccactcctcaatgcgtatttggattctcttggtacaccaagctttcggaccggtgttaattttgctcaagctggatgttcaatcacaccagcaaagccaacatcagtcagcccattttcatttggtctccagattaagcaattctttgccttcaaggataaagttactaagctcctgtctaaaggagatatgtacaggaaatatattcctcaggaagattacttttcagagggactctacatgtttgatattgggcaaaatgatcttgctggtcaattctattcaaaaacagaggaccaagtcattgcatccattccaactattttgttggaatttgaaaatggtctcaagaaactatatgaccaaggtgctaggaaattctggattcacaacacaggtcccctcggctgcttacctcaaaacatagccttgtttggcaaagacccatcccaattggatgagcttcactgtgtagcaaagcacaaccgtgctgcaaaacttttcaacatccagctgcatgcgctttgcacaaagttgagaggagaattcgctggagccagcataacttatgtggacatccacacaatcaaatacaacctgatcgccaactactctcgatatgggttcgagcatgccactcaagcatgctgtggatatggaggtccacccctgaactatgatggtaacgtaccatgtggacagacagtgtctgtgaatggtaagctggtaactgcaaaagggtgcagtgacactactgaattcgtcaattgggatggaatacactacacagaagctgcaaacttccatattgcatcgcagatcctgaccgggaaatactctgatcctccgtttgtggataagatgccattcgtcctaaaacctagattctga

SEQ ID NO: 10770 - protein, 382 aa, Sorghum bicolor
  misc_feature: Ceres ANNOT ID no. 6115511
  misc_feature (33)..(360): Pfam Id: Lipase_GDSL Pfam Desc: GDSL-like Lipase/Acylhydrolase
  misc_feature (6)..(382): NCBI GI: 115463771 NCBI Desc: os05g0401000 [oryza sativa (japonica cultivar-group)]
  misc_feature (23)..(382): NCBI GI: 87240518 NCBI Desc: lipolytic enzyme, g-d-s-l [medicago truncatula]
  misc_feature (30)..(382): NCBI GI: 3776573 NCBI Desc: similar to nodulins and lipase homolog f14j9.5 gi3482914 from arabidopsis thaliana bac gbac003970. alternate first exon from 72258 to 72509
  misc_feature (2)..(367): NCBI GI: 140071480 NCBI Desc: lipolytic enzyme, g-d-s-l [medicago truncatula]
  misc_feature (25)..(300): NCBI GI: 42571877 NCBI Desc: gdsl-motif lipase/hydrolase family protein [arabidopsis thaliana]
  misc_feature: Useful for making plants with altered carbohydrate content
  misc_feature: Functional homolog of the protein sequence given in SEQ ID NO 13638
MRFTVLLLGVAALLCLGGGGRAAASTDFNFPAVFNFGDSNSDTGGRVAAGFEAIFPPYGSTFFGGPAGRFCDGRLIIDFLMEAIDMPLLNAYLDSLGTPSFRTGVNFAQAGCSITPAKPTSVSPFSFGLQIKQFFAFKDKVTKLLSKGDMYRKYIPQEDYFSEGLYMFDIGQNDLAGQFYSKTEDQVIASIPTILLEFENGLKKLYDQGARKFWIHNTGPLGCLPQNIALFGKDPSQLDELHCVAKHNRAAKLFNIQLHALCTKLRGEFAGASITYVDIHTIKYNLIANYSRYGFEHATQACCGYGGPPLNYDGNVPCGQTVSVNGKLVTAKGCSDTTEFVNWDGIHYTEAANFHIASQILTGKYSDPPFVDKMPFVLKPRF

SEQ ID NO: 10771 - DNA, 1359 bp, Sorghum bicolor
  misc_feature: Ceres ANNOT ID no. 6115552
  misc_feature: Encodes the peptide sequence at SEQ ID NO 10772
  misc_feature: Up-regulated in shoot tissues in response to salicylic acid treatment
atggtgctgcagcgcttctcgtggccgtacggcggccggagagcctccttctgcggcagcttcaccgggtggagggagtgtcccatggggctggtcggggccgagttccaggtcgtcttcgatctgcctcccggggtttaccagtaccggtttttggttgatggtgtctggaggtgtgatgaggcgaaaccctttgtacgtgatgaatatggattgatcagcaatgaagtgcttgtggaaaacaatgtacaacctgttgtgcagccagagccttctatcagaggaaccaatgtggatgagggtatcattttgacaacaatgcccccggagccatcatctcagaacccaggcgtgcaaatagcagttttccgccatgtggtctctgaaatattattacacaataccatatatgacgttgttcctatttctagcaagttagcagttttggacactcagcttcctgttaaacaagcatttaaaataatgcatgatgagggtcttgctctggttcctctttgggatgaccatcagggaactataacaggcatgctcactgcatcagattttgtattaatgttgagaaagttgcagagaaacattcgagttattggcaatgaagagcttgaaatgcatcccatttctgcttggaaagaagcaaagctacagttttatggtgggcctgatggtgctgccatgcagagaaggccattaatccatgttaaggattcagataatttagtggatgtggcattgactataatcagaaatgaaatatcttcagttcctatctttaagtgcgtgccagattcaacagggatgcctttccttagtcttgcaaccctccaggggattttgaaatttctttgctcgaagctacaagaacaggctgagggctgttcccttctgcacaatcagcttctcagtattcctattggcacatggtctccacatacgggaaggtcaagtagcaggcaactcagaactttgctactgagttctcctctaaatacctgcctggattttctgcttcaagatagagtaagctcaattcctatagttgatgacaatggatccctccgtgacgtctactcactcagtgatatcatggctctggcgaagaatgatgtttatgctcgcatcgaacttgaacaagtgactgtgcaaaatgctttggatgtgcaataccaggtgcatggccgaagacagtgtcatacttgtttacagacgagtaccttgctggaagtcttggagggattgtctgttccaggagtgcgacggcttgttgttattgaacaaagtaccagatttgtggaaggaatcatctcattgagagacatttttacatttctccttggatag

SEQ ID NO: 10772 - protein, 452 aa, Sorghum bicolor
  misc_feature: Ceres ANNOT ID no. 6115552
  misc_feature (140)..(289): Pfam Id: CBS Pfam Desc: CBS domain pair
  misc_feature (320)..(451): Pfam Id: CBS Pfam Desc: CBS domain pair
  misc_feature (1)..(452): NCBI GI: 115458174 NCBI Desc: os04g0401300 [oryza sativa (japonica cultivar-group)]
  misc_feature (1)..(452): NCBI GI: 116309315 NCBI Desc: osigba0155k12.5 [oryza sativa (indica cultivar-group)]
  misc_feature (99)..(343): NCBI GI: 46367680 NCBI Desc: nf protein [oryza sativa (japonica cultivar-group)]
  misc_feature (5)..(451): NCBI GI: 11139548 NCBI Desc: protein kinase akinbetagamma-2 [zea mays]
  misc_feature (5)..(451): NCBI GI: 92877083 NCBI Desc: cbs [medicago truncatula]
  misc_feature: Up-regulated in shoot tissues in response to salicylic acid treatment
  misc_feature: The sequence is a functional homolog of SEQ ID NO. 473 in the 11/188,298 US application
MVLQRFSWPYGGRRASFCGSFTGWRECPMGLVGAEFQVVFDLPPGVYQYRFLVDGVWRCDEAKPFVRDEYGLISNEVLVENNVQPVVQPEPSIRGTNVDEGIILTTMPPEPSSQNPGVQIAVFRHVVSEILLHNTIYDVVPISSKLAVLDTQLPVKQAFKIMHDEGLALVPLWDDHQGTITGMLTASDFVLMLRKLQRNIRVIGNEELEMHPISAWKEAKLQFYGGPDGAAMQRRPLIHVKDSDNLVDVALTIIRNEISSVPIFKCVPDSTGMPFLSLATLQGILKFLCSKLQEQAEGCSLLHNQLLSIPIGTWSPHTGRSSSRQLRTLLLSSPLNTCLDFLLQDRVSSIPIVDDNGSLRDVYSLSDIMALAKNDVYARIELEQVTVQNALDVQYQVHGRRQCHTCLQTSTLLEVLEGLSVPGVRRLVVIEQSTRFVEGIISLRDIFTFLLG

SEQ ID NO: 10773 - DNA, 615 bp, Sorghum bicolor
  misc_feature: Ceres ANNOT ID no. 6115600
  misc_feature: Encodes the peptide sequence at SEQ ID NO 10774
atgccgtcagtttatctgtacatccctaacatcattgggtatttcaggatcatcataaatttcattgcgtttgctgtttgctattccaacaggctcctctttgctatgctgtacttcttcagttttgtcctggatggcgtggatggttggtttgcacggaagtttaatcaagcatctacattcggagctgtgttggacatggttacagatagggttagcactgcttgtttgttggcccttctctcacagtgttacagacctggtttagttttcttgatgctgcttgggttggatattacaagccactggtttcaaatgtacagttctttcctgtcaggtaagactagccacaaggatgtaaagaacacaggcaattggcttctgaaattatattatgggtataggccatttatggcattctgttgtgtttcttgtgaggttttatatattatcctctttctctttgctgatgagaaatcgacaagcttgcttggtacatgcagaggtgtcctgaagcaaggtcccctcactctcttggtgtttatttcaactctagttggttgggcagtgaaacaagttaccaacatcatccagcttctatcaactaaaacttag

SEQ ID NO: 10774 - protein, 204 aa, Sorghum bicolor
  misc_feature: Ceres ANNOT ID no. 6115600
  misc_feature (35)..(157): Pfam Id: CDP-OH_P_transf Pfam Desc: CDP-alcohol phosphatidyltransferase
  misc_feature (1)..(199): NCBI GI: 34577127 NCBI Desc: phosphatidylinositol synthase [zea mays]
  misc_feature (2)..(201): NCBI GI: 41053023 NCBI Desc: phosphatidylinositol synthase [oryza sativa (japonica cultivar-group)]
  misc_feature (2)..(201): NCBI GI: 13661020 NCBI Desc: phosphatidylinositol synthase [oryza sativa]
  misc_feature (3)..(199): NCBI GI: 21745398 NCBI Desc: phosphatidylinositol synthase [brassica napus]
  misc_feature (3)..(199): NCBI GI: 21592927 NCBI Desc: phosphatidylinositol synthase pis1 [arabidopsis thaliana]
  misc_feature (3)..(199): SWISSPROT Homolog: EC 2.7.8.11 CDP-diacylglycerol--inositol 3-phosphatidyltransferase 1
  misc_feature: The plant produces a reduced number of seeds.
  misc_feature: Useful for biocontainment applications
  misc_feature: GREAT-hit functional homolog of the protein sequence given in SEQ ID NO 13111
  misc_feature: Useful for biocontainment applications
  misc_feature: Functional homolog of the protein sequence given in SEQ ID NO 13111
MPSVYLYIPNIIGYFRIIINFIAFAVCYSNRLLFAMLYFFSFVLDGVDGWFARKFNQASTFGAVLDMVTDRVSTACLLALLSQCYRPGLVFLMLLGLDITSHWFQMYSSFLSGKTSHKDVKNTGNWLLKLYYGYRPFMAFCCVSCEVLYIILFLFADEKSTSLLGTCRGVLKQGPLTLLVFISTLVGWAVKQVTNIIQLLSTKT

SEQ ID NO: 10775 - DNA, 1023 bp, Sorghum bicolor
  misc_feature: Ceres ANNOT ID no. 6115613
  misc_feature: Encodes the peptide sequence at SEQ ID NO 10776
atggagcacggtgtcaccgccaccgccgccggtaagcccaaggtggtctttgtgctcggcgccacagccaccgggaagtcgaagctcgccatcgccctcgcccagcgcttcaacggtgaggttatcaacgctgacaaaatccaggtccacgaaggcgtgcccatcctcaccaacaaggtcacagaggaagagcaggccggggtgccccaccacctgctcagcgtgcgcgaccccgacgccgagtttcccccggaggagttccgacgggaggcggccggcgccatcgccggcgtgctctcggcgggccgcctgcccatcgtggcaggcgggtccaacacctacatcgaggcgctggtggacggcgacggcgccgccttccgcgcggcgcacgacctcctattcgtctgggtggacgccgagcgggagctgctggagtggtacgccgcgctgcgcgtggacgagatggtggcccgcggtctggtcgccgaggctcgcgcggcgttcgccggcgccggggctgactacacccgcggcgtgcgccgcgccatcggcctgccggagatgcacgcgtacctgatggcggagcgcgacgtcgtcggcgccgccggggaggccgatctcgcggccatgctggaacgcgcggtgcgcgagatcaaggacaacaccttccgccttgcgcgcacgcagacggagaagatccggcgcctcagcacgctcgacggctgggacgtccgccgcatcgacgtcacccccgtgtttgcgcgcaaggccgatgggaaggagtgccacgagcagacgtggaagaagctggtgtgggagccgtgcgaggagatggttagggctttcctcgagccggcgccgtccctggctgccgttccaggtgttgcagcaactgaagatggggacgaaggccgtgatgccggcgtcgtcgccgccgccgccattgctgcccccgctgccaatgtcgcccccactggagatgtcgccaacgccgtcgttgctgatgcagcggagaccatataa

SEQ ID NO: 10776 - protein, 340 aa, Sorghum bicolor
  misc_feature: Ceres ANNOT ID no. 6115613
  misc_feature (47)..(245): Pfam Id: IPPT Pfam Desc: IPP transferase
  misc_feature (12)..(314): NCBI GI: 108708247 NCBI Desc: ipp transferase family protein [oryza sativa (japonica cultivar-group)]
  misc_feature (1)..(322): NCBI GI: 78483658 NCBI Desc: adenylate isopentenyltransferase [oryza sativa (japonica cultivar-group)]
  misc_feature (12)..(288): NCBI GI: 90421410 NCBI Desc: adenylate isopentenyltransferase [lotus japonicus]
  misc_feature (12)..(283): NCBI GI: 74038589 NCBI Desc: isopentenyltransferase [brassica rapa subsp. pekinensis]
  misc_feature (12)..(283): NCBI GI: 92867006 NCBI Desc: trna isopentenyltransferase [medicago truncatula]
MEHGVTATAAGKPKVVFVLGATATGKSKLAIALAQRFNGEVINADKIQVHEGVPILTNKVTEEEQAGVPHHLLSVRDPDAEFPPEEFRREAAGAIAGVLSAGRLPIVAGGSNTYIEALVDGDGAAFRAAHDLLFVWVDAERELLEWYAALRVDEMVARGLVAEARAAFAGAGADYTRGVRRAIGLPEMHAYLMAERDVVGAAGEADLAAMLERAVREIKDNTFRLARTQTEKIRRLSTLDGWDVRRIDVTPVFARKADGKECHEQTWKKLVWEPCEEMVRAFLEPAPSLAAVPGVAATEDGDEGRDAGVVAAAAIAAPAANVAPTGDVANAVVADAAETI

SEQ ID NO: 10777 - DNA, 1293 bp, Sorghum bicolor
  misc_feature: Ceres ANNOT ID no. 6115641
  misc_feature: Encodes the peptide sequence at SEQ ID NO 10778
atgggatcacgaaagaggtggctccccgtggccctcctgctcttggccgcctctgccctctggccgccggtcgcagcagcagccgcagccggcggcggcggcggagaggccgaacacgccgttcagcagcatagcgagcgcatctcagggagtgctggtgatgtgttagaggataatcctgtggggaggttgaaggtcttcatttatgacttaccaaggaagtacaacaagaagatggtcactaaagatccacggtgcctcagtcacatgtttgccgccgaaattttcatgcaccgtttcttgctctcaagtgctgtccggacactaaatcccaaggaagctgattggttctatacaccagtttacactacttgtgatttaactaatgctggtctgcccttgccatttaagtcaccacgggtgatgaggagtgcaatccaatatatttcaaacaaatggcccttctggaataggactgatggagcggatcacttctttgttgttcctcatgattttgcagcatgcttccactatcaggaagaaaaggctattgagcgtggaattcttccattgctgcgacgtgctacattggtccaaacttttggacaggagaatcatgtttgtctgaaggagggttccatcattattccaccctttgctccaccgcagaaaatgcaagctcacttgatttcccctgacactccacgctcaatctttgtttacttccggggacttttctatgacactgggaacgaccctgagggcgggtactatgcaagaggtgcgcgagcttcgctatgggagaacttcaagagcaaccctctatttgacatttccacggaccaccctgccacttactacgaagacatgcaacgtgctgtcttctgcctctgcccattgggctgggcaccatggagccctcggttggttgaggctgtggtctttggctgcattccagtcatcatagctgatgatattgtgcttccatttgcggatgcaatcccatgggaggaaattggtgtctttgtcgaggagaaggatgtcccaaagctagacacaatcctcacgtcgatgcctatagatgacatcttaagaaagcaaaggttacttgcaaatccatcaatgaagcaggccatgctgttcccgcagccagcgcaaccaagggatgcgttccaccaaatcctgaacggccttgctcggaagctccctcacccggagggtacgtacttacaacctggcgatcagcatctcaactggactgccggacctgtgggagatctgaagccgtggtag

SEQ ID NO: 10778 - protein, 430 aa, Sorghum bicolor
  misc_feature: Ceres ANNOT ID no. 6115641
  misc_feature (66)..(370): Pfam Id: Exostosin Pfam Desc: Exostosin family
  misc_feature (37)..(430): NCBI GI: 15223522 NCBI Desc: exostosin family protein [arabidopsis thaliana]
  misc_feature (43)..(430): NCBI GI: 17978869 NCBI Desc: at5g61840/mac9_140 [arabidopsis thaliana]
  misc_feature (45)..(430): NCBI GI: 60657598 NCBI Desc: secondary cell wall-related glycosyltransferase family 47 [populus tremula x populus tremuloides]
  misc_feature (90)..(430): NCBI GI: 23821292 NCBI Desc: pectin-glucuronyltransferase [nicotiana plumbaginifolia]
  misc_feature (90)..(404): NCBI GI: 39725600 NCBI Desc: npgut1 homolog [nicotiana tabacum]
  misc_feature: Useful for making plants with altered cell wall content and/or composition
  misc_feature: GREAT-hit functional homolog of the protein sequence encoded by LOCUS at1g27440
  misc_feature: GREAT-hit functional homolog of the protein sequence encoded by LOCUS at5g61840
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13640
MGSRKRWLPVALLLLAASALWPPVAAAAAAGGGGGEAEHAVQQHSERISGSAGDVLEDNPVGRLKVFIYDLPRKYNKKMVTKDPRCLSHMFAAEIFMHRFLLSSAVRTLNPKEADWFYTPVYTTCDLTNAGLPLPFKSPRVMRSAIQYISNKWPFWNRTDGADHFFVVPHDFAACFHYQEEKAIERGILPLLRRATLVQTFGQENHVCLKEGSIIIPPFAPPQKMQAHLISPDTPRSIFVYFRGLFYDTGNDPEGGYYARGARASLWENFKSNPLFDISTDHPATYYEDMQRAVFCLCPLGWAPWSPRLVEAVVFGCIPVIIADDIVLPFADAIPWEEIGVFVEEKDVPKLDTILTSMPIDDILRKQRLLANPSMKQAMLFPQPAQPRDAFHQILNGLARKLPHPEGTYLQPGDQHLNWTAGPVGDLKPW

SEQ ID NO: 10779 - DNA, 813 bp, Sorghum bicolor
  misc_feature: Ceres ANNOT ID no. 6115643
  misc_feature: Encodes the peptide sequence at SEQ ID NO 10780
atgctgcgggttgcggggagaaggctctcgtcttccctctcgtggcgccccgccgcggcggcggccaggggccccctcgccggcgctggcgcccccgaccgggacgacgactcggctcgcggccggagccagccgcggttctccatcgactcccccttctttgtcgcttctaggggtttctcttcaactgaaacacttgtcccaaggaaccaagatgctggctttccagcaactgtggctgctgtgaagaatcctaaccctaaggtggtttatgatgagtataaccatgaaagatatcctcctggagatcccagcaagcgtgcctttgcttactttgtcctaagtggtgggaggttcatatatgcatcactgctgcgtctcctcgtattgaagtttgtcctgagcatgtcagcaagtaaggacgtgctcgcccttgcctcacttgaggtggacctctccagcatcgagccagggaccacagtgaccgtgaagtggcgtggaaaaccagtcttcatcagacgccggacggaggacgacatcaagcttgccaacagtgtggacgtggcatccctgcgccacccagagcaggacgcagagcgtgtgaagaaccctgagtggctggtggtcattggcgtgtgcactcacctcggctgcatcccactgccgaacgcaggagacttcggtggctggttctgcccatgccacggttcccactatgacatttccgggaggatccgcaagggccctgcgccgttcaacctcgaggtcccgacctacagtttcttggaggagaacaaactgctcataggctaa

SEQ ID NO: 10780 - protein, 270 aa, Sorghum bicolor
  misc_feature: Ceres ANNOT ID no. 6115643
  misc_feature (170)..(266): Pfam Id: Rieske Pfam Desc: Rieske [2Fe-2S] domain
  misc_feature (1)..(270): NCBI GI: 1717957 NCBI Desc: ubiquinol-cytochrome c reductase iron-sulfur subunit, mitochondrial precursor (rieske iron-sulfur protein) (risp)
  misc_feature (1)..(270): NCBI GI: 38347166 NCBI Desc: osjnba0039c07.12 [oryza sativa (japonica cultivar-group)]
  misc_feature (1)..(270): NCBI GI: 1717951 NCBI Desc: ubiquinol-cytochrome c reductase iron-sulfur subunit 3, mitochondrial precursor (rieske iron-sulfur protein 3) (risp3)
  misc_feature (1)..(270): NCBI GI: 1717950 NCBI Desc: ubiquinol-cytochrome c reductase iron-sulfur subunit 2, mitochondrial precursor (rieske iron-sulfur protein 2) (risp2)
  misc_feature (1)..(270): NCBI GI: 1717953 NCBI Desc: ubiquinol-cytochrome c reductase iron-sulfur subunit 5, mitochondrial precursor (rieske iron-sulfur protein 5) (risp5)
  misc_feature (1)..(270): SWISSPROT Homolog: EC 1.10.2.2 Ubiquinol-cytochrome c reductase iron-sulfur subunit, mitochondrialprecursor
MLRVAGRRLSSSLSWRPAAAAARGPLAGAGAPDRDDDSARGRSQPRFSIDSPFFVASRGFSSTETLVPRNQDAGFPATVAAVKNPNPKVVYDEYNHERYPPGDPSKRAFAYFVLSGGRFIYASLLRLLVLKFVLSMSASKDVLALASLEVDLSSIEPGTTVTVKWRGKPVFIRRRTEDDIKLANSVDVASLRHPEQDAERVKNPEWLVVIGVCTHLGCIPLPNAGDFGGWFCPCHGSHYDISGRIRKGPAPFNLEVPTYSFLEENKLLIG

SEQ ID NO: 10781 - DNA, 1629 bp, Sorghum bicolor
  misc_feature: Ceres ANNOT ID no. 6115781
  misc_feature: Encodes the peptide sequence at SEQ ID NO 10782
atggccctgcgctcgccggagctgcggtggctcggctcgctcacgcggcccggccgcctggctccatccccactcgcggcgctcgcctccccacggcgccgccgccgcgcaccgtccccgtcccagcccccttcctcgccctcgccctcgccctccgactcctccaccccatctaccgcccccgcatccgccggtgcgccgggagcggaggggttggacgggccggagtggaagaaggtcagtgccaagcggttcgggatcaaggagtccatgatccccgcagaggcctggaacgtactacaccgcctccgcagcagaggatatgatgtgtaccttgttggtggttgtgttcgtgatcttataatgaagaagacgccaaaagatttcgacataataacaacagctgatcttaggcaggttaaagacactttctctggatcagctgttatagtaggaaggcgtttccccatatgccatgtacatgagaacaattccatcgttgaggtgtcaagtttttatactagtgcaagggggtcaagtggtagccaaatttacaattcaaagagccaaaattgtagcaagaatgattttgttcgctggaagaactgccaagggagggacttcacaattaatgggttaatgttcaacccatattcagaaaagatctatgattacttgggaggcattgaagatattaagaaagctaaggttcggactgtaattcctgctggcacttcgttccaggaggactgtgcccgtattctacgtgcaatcagaattgcagctcgtttagggtttagcttccccaaagaaacagcttattatgtgagaacgcttgcttactcagtggcaagacttgacaagggaaggatactcctggagatgaactatatgcttgcttatggttcagctgaagcttctttaaggttgctgtggaggtttggcctccttgaacatttgttgccctttcaggcagcatatttttcttcgactcgttttaagaggaaggataaaggaactaatatgctacttgtcttattttctaagctggataattttcttgcacctaataggccatgtcataatagtctatggataagccttttagcctttcatgaagcattggcacgcaaaccatgtgatcctttggtagtggctacttttgcactagccttctacctgggaggtgatatgtctttggcagtggatattggaaaatcaatcaaccggcaacatgatactggatttcgggagctcttagaacccaaagtctggactgataagcatttggcaggtgaagtacaaagctttgctgcattgatgaagcgggcattaactgaaatgactgatgagtatcatgtcggaaatgctatggcgaaaatccctcaagcaccatcgtcagatcttgtgtttataccactacaagtctacctgaaggttctcaaatctatcgagagtgttcaatatggcaagaaggagcgtggctatgaaccaaaacgcgatgggatgatcaattaccataacctgtctaatggttcacatgcagaaataacaaatctctttacactggtggttttcgacacactataccctacagacatggaggatgaagatggctgcagttcttaa

SEQ ID NO: 10782 - protein, 542 aa, Sorghum bicolor
  misc_feature: Ceres ANNOT ID no. 6115781
  misc_feature (110)..(238): Pfam Id: PolyA_pol Pfam Desc: Poly A polymerase head domain
  misc_feature (1)..(542): NCBI GI: 21742315 NCBI Desc: osjnbb0039f02.3 [oryza sativa (japonica cultivar-group)]
  misc_feature (76)..(537): NCBI GI: 22327016 NCBI Desc: polynucleotide adenylyltransferase family protein [arabidopsis thaliana]
  misc_feature (76)..(537): NCBI GI: 22137254 NCBI Desc: at5g23690/mqm1_4 [arabidopsis thaliana]
  misc_feature (64)..(531): NCBI GI: 42571667 NCBI Desc: polynucleotide adenylyltransferase family protein [arabidopsis thaliana]
  misc_feature (64)..(531): NCBI GI: 42562367 NCBI Desc: polynucleotide adenylyltransferase family protein [arabidopsis thaliana]
MALRSPELRWLGSLTRPGRLAPSPLAALASPRRRRRAPSPSQPPSSPSPSPSDSSTPSTAPASAGAPGAEGLDGPEWKKVSAKRFGIKESMIPAEAWNVLHRLRSRGYDVYLVGGCVRDLIMKKTPKDFDIITTADLRQVKDTFSGSAVIVGRRFPICHVHENNSIVEVSSFYTSARGSSGSQIYNSKSQNCSKNDFVRWKNCQGRDFTINGLMFNPYSEKIYDYLGGIEDIKKAKVRTVIPAGTSFQEDCARILRAIRIAARLGFSFPKETAYYVRTLAYSVARLDKGRILLEMNYMLAYGSAEASLRLLWRFGLLEHLLPFQAAYFSSTRFKRKDKGTNMLLVLFSKLDNFLAPNRPCHNSLWISLLAFHEALARKPCDPLVVATFALAFYLGGDMSLAVDIGKSINRQHDTGFRELLEPKVWTDKHLAGEVQSFAALMKRALTEMTDEYHVGNAMAKIPQAPSSDLVFIPLQVYLKVLKSIESVQYGKKERGYEPKRDGMINYHNLSNGSHAEITNLFTLVVFDTLYPTDMEDEDGCSS

SEQ ID NO: 10783 - DNA, 855 bp, Sorghum bicolor
  misc_feature: Ceres ANNOT ID no. 6115782
  misc_feature: Encodes the peptide sequence at SEQ ID NO 10784
  misc_feature: Down-regulated in shoot tissues in response to salicylic acid treatment
atgcgggccctcgcgcgcgccgcgtcgtcgctgctccgccgcgccgcgggatccgcgcccaccacggggtcgccgcaccacccttcgccgggcgtaggcccgtgcctcgccaagaatctgccaggtttctttttcaatgggtattctactcttttggctccaccaagtgaagtgctgattccaccagaacttctttctagcaggactgtgtggacaccagatcgggagcttgggcagtatgaagacctggtagctagggttacaaacttccataatgaggacaagggcttcatggttttggatggtgatgtttttgatgttccaattaggaaggatattgttcaccgggtagggacacactcaaccaaaacaatcagtgaagtgagtggcaccggaagaaagccttacaagcaaaaaggaactggaagagcacggcatggaacactgcgcggtccccagttccgtggtggtgcaaccatgcatgggcctaaaccacgaagccatgcaatcaagctgcagaagaaagtgcggcgtctggggcttaagattgccttgtctgctcgaactgcagaggggaagctcttggtctttgaggacttggaagtccctagccacaagacaaaaaacattgtgcaatacattaggcagatggatgatacaaagaaggttctgttggtggatggaggtgacattgataagaagctaaagctggctactcaaaaccttcactatgttaatgtacttccttccattggcctgaacgtttacagcatccttcagcatgacacccttgtaatgtctcgggctgctatcaacagaatcgtcgagcggatgcatacccccatcaaccgctag

SEQ ID NO: 10784 - protein, 284 aa, Sorghum bicolor
  misc_feature: Ceres ANNOT ID no. 6115782
  misc_feature (97)..(277): Pfam Id: Ribosomal_L4 Pfam Desc: Ribosomal protein L4/L1 family
  misc_feature (49)..(284): NCBI GI: 21553676 NCBI Desc: 50s ribosomal protein l4 [arabidopsis thaliana]
  misc_feature (49)..(284): NCBI GI: 20197568 NCBI Desc: 50s ribosomal protein l4 [arabidopsis thaliana]
  misc_feature (86)..(278): NCBI GI: 91205876 NCBI Desc: 50s ribosomal protein l4 [rickettsia bellii rml369-c]
  misc_feature (87)..(278): NCBI GI: 83576933 NCBI Desc: ribosomal protein l4/l1e [rhodospirillum rubrum atcc 11170]
  misc_feature (86)..(278): NCBI GI: 144900885 NCBI Desc: 50s ribosomal protein l4 [magnetospirillum gryphiswaldense msr-1]
  misc_feature: Down-regulated in shoot tissues in response to salicylic acid treatment
MRALARAASSLLRRAAGSAPTTGSPHHPSPGVGPCLAKNLPGFFFNGYSTLLAPPSEVLIPPELLSSRTVWTPDRELGQYEDLVARVTNFHNEDKGFMVLDGDVFDVPIRKDIVHRVGTHSTKTISEVSGTGRKPYKQKGTGRARHGTLRGPQFRGGATMHGPKPRSHAIKLQKKVRRLGLKIALSARTAEGKLLVFEDLEVPSHKTKNIVQYIRQMDDTKKVLLVDGGDIDKKLKLATQNLHYVNVLPSIGLNVYSILQHDTLVMSRAAINRIVERMHTPINR

SEQ ID NO: 10785 - DNA, 1782 bp, Sorghum bicolor
  misc_feature: Ceres ANNOT ID no. 6115804
  misc_feature: Encodes the peptide sequence at SEQ ID NO 10786
atgacctacttccctgaggaggtggtggagcacattttcagcttcttgccatcgcacagcgaccggaacacggtctccctcgtgtgcaaggtgtggtatgaggtcgagaggctgagccgacgagctgtgttcgtggggaactgctacgctgtgcgccccgagcgtgtggtgctgcggttccccaatgtgaaggcgctcacggtgaaggggaagcctcactttgcggacttcaaccttgtgccgcctgactggggtggctacgcggggccatggatcgaagcagcagcgaggagctgcgtgggtcttgaggagctgcgcatgaagcggatggttgtgtctgacgagaaccttgagctgctagctcggtcattcccaagattcaaagtcctcgttcttatcagctgcgaggggtttagcactgatggtctagctgctgttgcgagtcactgcaagctcctgagggagttagatttgcaggaaaatgacgtggaggaccgtgggcccagatggctttccttcttccctgattcctgcacttctctggtctccttgaatttcgcctgcatcaaaggggaggtgaactctggtgcattggagagacttgtcgctaggtctccgaacctacgcagtttaaggttgaatcgttctgtttcagtagacacgctctcaaagatactagcgcgaaccccaaatttggaagacttggggacaggtaatttgacagatgagttccaagctgagtcctacgccaggcttaccagtgctctggagaaatgcaaaatgctaagaagtttgtctggattttgggatgcttctcctatctgtgttccatatatctatcccctctgtcatcaactaacaggcctaaacttgagctatactcctacactggattattctgatctgactaaaatggttagccgctgtgtgaaactccagcgtctttgggtattggactgcatttcggataagggtttgcaagtggtggcctccagttgcaaggatctacaagaactcagggtgtttccatcagatttttatgttgctggtgcttcggcggtgacagaggagggacttgttgcaatatcatcaggctgcccaaaactaagctctttgctgtatttctgtcaccagatgaccaatgaagcactaattactgtagctaagaactgcccaaatttcatcagatttagactctgtatccttgagccaaagaagccggatgccatgacaggccagccgttagatgaaggctttggtgcaattgtccgtgagtgcaaagggctaagacgactgtcaatgtcaggtcttctcacagacagggttttcatgtatattggaaagtatgcaaaataccttgagatgctttctatagcatttgctggagatagtgataagggtatgatggacgtgatgaacggatgtaagaatctgaggaagcttgagattagagacagtccatttggtgatgttgcactcttgggaaatgttgccaagtatgagacaatgcgatccctttggatgtcatcatgtgatgtcacattaaaggggtgccaagtccttgcatcgaagatgccgatgctcaatgtggagatcatgaatgaactagatggaagtagtgaaatggaggagaaccacacagacatctctaaagtggataagttacatgttagtgaaatggaggagaaccacacagacctctctaaagtggataagttatatgtttaccgcacaactgctggagcgagggatgatgcaccaaattttgttaaaatcttatag

SEQ ID NO: 10786 - protein, 593 aa, Sorghum bicolor
  misc_feature: Ceres ANNOT ID no. 6115804
  misc_feature (1)..(555): NCBI GI: 110225915 NCBI Desc: auxin-responsive factor tir1-like protein [populus tomentosa]
  misc_feature (4)..(557): NCBI GI: 109729860 NCBI Desc: transport inhibitor response 1 [gossypium hirsutum]
  misc_feature (5)..(557): NCBI GI: 115462133 NCBI Desc: os05g0150500 [oryza sativa (japonica cultivar-group)]
  misc_feature (4)..(538): NCBI GI: 92887633 NCBI Desc: cyclin-like f-box [medicago truncatula]
  misc_feature (4)..(557): NCBI GI: 12658970 NCBI Desc: grr1-like protein 1 [arabidopsis thaliana]
  misc_feature: Useful for making plants with altered carbohydrate content
  misc_feature: Functional homolog of the protein sequence given in SEQ ID NO 13641
MTYFPEEVVEHIFSFLPSHSDRNTVSLVCKVWYEVERLSRRAVFVGNCYAVRPERVVLRFPNVKALTVKGKPHFADFNLVPPDWGGYAGPWIEAAARSCVGLEELRMKRMVVSDENLELLARSFPRFKVLVLISCEGFSTDGLAAVASHCKLLRELDLQENDVEDRGPRWLSFFPDSCTSLVSLNFACIKGEVNSGALERLVARSPNLRSLRLNRSVSVDTLSKILARTPNLEDLGTGNLTDEFQAESYARLTSALEKCKMLRSLSGFWDASPICVPYIYPLCHQLTGLNLSYTPTLDYSDLTKMVSRCVKLQRLWVLDCISDKGLQVVASSCKDLQELRVFPSDFYVAGASAVTEEGLVAISSGCPKLSSLLYFCHQMTNEALITVAKNCPNFIRFRLCILEPKKPDAMTGQPLDEGFGAIVRECKGLRRLSMSGLLTDRVFMYIGKYAKYLEMLSIAFAGDSDKGMMDVMNGCKNLRKLEIRDSPFGDVALLGNVAKYETMRSLWMSSCDVTLKGCQVLASKMPMLNVEIMNELDGSSEMEENHTDISKVDKLHVSEMEENHTDLSKVDKLYVYRTTAGARDDAPNFVKIL

SEQ ID NO: 10787 - DNA, 735 bp, Sorghum bicolor
  misc_feature: Ceres ANNOT ID no. 6115809
  misc_feature: Encodes the peptide sequence at SEQ ID NO 10788
atgacgccgacggcgagcctcctcctcccggctcccccattcgtctccgtctccgatgtgcgccgcctccagcttcccccgcgcggccgccatcggcctcgcctatgctggagaggtgtggagtggggttccgtacagacccggatggtctcctcttctttctttgggagcagaacacgccgcagaaacgtcatatgtgcttccctgtttggagttggagctcccgaagcactggtcatcggagtagtcgccttgttggtgttcggccccaagggtctggcagaggtagccaggaatttggggaagactttgcgtgctttccaaccaaccattagagagatacaggatgtatcaagggaattcaggagcactcttgaacgagaaatcggaattgatgagatttcccaatcgacgaattataagcccacaaccatgaacaacaaccaacaacctgctgccgacccaaatgtcaagcctgaacctgcaccttacactagcgaggaactcatgaaagtaactgaagaacaaattgctgcatcagctgctgctgcttggaatccaccagagcctgccacgtcgcaacagcaagaagcaggggccgctactccaagtgagggcgcagctacatcaggaggaagcgatggccctgctgctcctgctcctccggctcttgctgtgagtgactctgacccaagccaagcgaatcaaccggagaaggtggacacacagagatga

SEQ ID NO: 10788 - protein, 244 aa, Sorghum bicolor
  misc_feature: Ceres ANNOT ID no. 6115809
  misc_feature (72)..(154): Pfam Id: MttA_Hcf106 Pfam Desc: mttA/Hcf106 family
  misc_feature (1)..(244): NCBI GI: 2665536 NCBI Desc: hcf106 precursor protein [zea mays]
  misc_feature (1)..(244): NCBI GI: 7542516 NCBI Desc: hcf106c precursor protein [zea mays]
  misc_feature (16)..(222): NCBI GI: 92878971 NCBI Desc: bacterial sec-independent translocation protein mtta/hcf106 [medicago truncatula]
  misc_feature (4)..(209): NCBI GI: 15277532 NCBI Desc: hcf106 [pisum sativum]
  misc_feature (57)..(239): NCBI GI: 44662995 NCBI Desc: chloroplast hcf106-1 [physcomitrella patens]
MTPTASLLLPAPPFVSVSDVRRLQLPPRGRHRPRLCWRGVEWGSVQTRMVSSSFFGSRTRRRNVICASLFGVGAPEALVIGVVALLVFGPKGLAEVARNLGKTLRAFQPTIREIQDVSREFRSTLEREIGIDEISQSTNYKPTTMNNNQQPAADPNVKPEPAPYTSEELMKVTEEQIAASAAAAWNPPEPATSQQQEAGAATPSEGAATSGGSDGPAAPAPPALAVSDSDPSQANQPEKVDTQR

SEQ ID NO: 10789 - DNA, 900 bp, Sorghum bicolor
  misc_feature: Ceres ANNOT ID no. 6115840
  misc_feature: Encodes the peptide sequence at SEQ ID NO 10790
atggacgacaagaacaaagtcaagaaggaaatagatggtccccttggacccgctactcgcaaggggggacttaaattcgcaccaaaagtacctcagaagaaacctgccaaggttgtcccaaagaaggaaccagttgaggagagcaaggaggaaactgtggataaggagttattgatgaaacttaagatgtcgcagaacaagagtccctctgcaagaattaagtccggggacaagccaaaaagtggtacacaggttgcatttggacaaggaagctcttcttatgcaagatattttcccatgcccaaaaaggattcttcagcaggtgaagcttcgaagttaccaaaagaatatgcagaaccatgggactatacccatgattatcctgttactctcccactaaggaggccctactctggaaatcctgaaattctggatgagaaagaatttggagaatcttctaccagcaggtctgaagatgctcaattatctgcagcagaagagcttggattaatggattggccggcggaatcacagttcctgtacttccagtttccatcctctcttcctttaccgaggcagccacaatcagttgctaaccctaatgtagtctccaatgagagacgtgaggacatgaggccatcatcgcacattggctcaagactcaaagagattcctgaaggctatatggggagaatacttgtatataggagtggtaaagtgaagatgaagatcggagacgctctctttgatgtttcatctggctcgaattgcatgtttgtccaagaggttgcagcaatcaacaccagagaaaaacattgctgtacggtgggggagatcagcaagcgtgctgttattgccccagatattgattatatgttgggttctgtttacaaggaatag

SEQ ID NO: 10790 - protein, 299 aa, Sorghum bicolor
  misc_feature: Ceres ANNOT ID no. 6115840
  misc_feature (175)..(289): Pfam Id: RNA_pol_Rpc4 Pfam Desc: RNA polymerase III RPC4
  misc_feature (1)..(298): NCBI GI: 116309383 NCBI Desc: h0718e12.6 [oryza sativa (indica cultivar-group)]
  misc_feature (1)..(298): NCBI GI: 115458108 NCBI Desc: os04g0394500 [oryza sativa (japonica cultivar-group)]
  misc_feature (148)..(293): NCBI GI: 115441531 NCBI Desc: os01g0889200 [oryza sativa (japonica cultivar-group)]
  misc_feature (13)..(293): NCBI GI: 31981109 NCBI Desc: polymerase (rna) iii (dna directed) polypeptide d [mus musculus]
  misc_feature (221)..(292): NCBI GI: 116128542 NCBI Desc: ensangp00000029377 [anopheles gambiae str. pest]
MDDKNKVKKEIDGPLGPATRKGGLKFAPKVPQKKPAKVVPKKEPVEESKEETVDKELLMKLKMSQNKSPSARIKSGDKPKSGTQVAFGQGSSSYARYFPMPKKDSSAGEASKLPKEYAEPWDYTHDYPVTLPLRRPYSGNPEILDEKEFGESSTSRSEDAQLSAAEELGLMDWPAESQFLYFQFPSSLPLPRQPQSVANPNVVSNERREDMRPSSHIGSRLKEIPEGYMGRILVYRSGKVKMKIGDALFDVSSGSNCMFVQEVAAINTREKHCCTVGEISKRAVIAPDIDYMLGSVYKE

SEQ ID NO: 10791 - DNA, 1047 bp, Sorghum bicolor
  misc_feature: Ceres ANNOT ID no. 6115908
  misc_feature: Encodes the peptide sequence at SEQ ID NO 10792
  misc_feature: Up-regulated in root tissues in response to salicylic acid treatment
atggctttatcgtcctcatcaccagtggctgtggttgctccgtgcaggttcctgtcccccatcgccaccaccgcctcccgcgacctcctctccttcgcggccgcagcaacaaggaggcggctgctcctctccaccaccaccaccaccattgccgccgccatggccgctcctgcttcctcctgcaaggtcatcgattcccacctccacgtctgggccacgccacagcaggccaaggaggagtacccctacttcccaggccaggaacccacgctccgtggcgacgacgaattcttgctcgagtgtatgagtgaagctggagtggacggggctctcattgttcaacctattaatcatatgtttgatcattctttggtaactagtacgttgaagaaatatccatccaagttcattggttgctgtcttgcgaatcctgcagacgatgggagtgggattaaacagcttgaacacctgattgtacaagaaaaataccgtgctgtgaggttcaacccaaacttatggccagctggtcaaaagatgaccaatgaggtcggaaggtcattattttcgaaggcaggagaacttggagcgccagttgcaatactgacaatgaagggaattggtccatatattcaagaaatagaggagctctgtagggattatcctgcaactactgttattcttgatcatatgtctttctgcaagccaccaacgaacgatgaagaagagaaggcactctcttcatttctaaacttatctagattcccacaggtttatgtcaaatacagtgctcttttccgcatcacaagagaggcatatccatatgaagacactgctcagcttctttcccgtgcgatatctcactatggagccaatcgaataatgtggggaagtgactttccctatgttgttcctgaatgtggctacaaaggagcaagggaggcaatttctcttgtcgcaggcaagatacctgtttccctgtcagatttggattggatcttggggaaaacggtgagccaactattccaaggtgcatgggttactccatga

SEQ ID NO: 10792 - protein, 348 aa, Sorghum bicolor
  misc_feature: Ceres ANNOT ID no. 6115908
  misc_feature (64)..(343): Pfam Id: Amidohydro_2 Pfam Desc: Amidohydrolase
  misc_feature (19)..(347): NCBI GI: 115458092 NCBI Desc: os04g0391900 [oryza sativa (japonica cultivar-group)]
  misc_feature (52)..(347): NCBI GI: 116309369 NCBI Desc: osigba0145n07.5 [oryza sativa (indica cultivar-group)]
  misc_feature (58)..(348): NCBI GI: 34146876 NCBI Desc: at2g35450 [arabidopsis thaliana]
  misc_feature (45)..(341): NCBI GI: 116228749 NCBI Desc: amidohydrolase 2 [solibacter usitatus ellin6076]
  misc_feature (30)..(346): NCBI GI: 87309597 NCBI Desc: amidohydrolase 2 [blastopirellula marina dsm 3645]
  misc_feature: Up-regulated in root tissues in response to salicylic acid treatment
MALSSSSPVAVVAPCRFLSPIATTASRDLLSFAAAATRRRLLLSTTTTTIAAAMAAPASSCKVIDSHLHVWATPQQAKEEYPYFPGQEPTLRGDDEFLLECMSEAGVDGALIVQPINHMFDHSLVTSTLKKYPSKFIGCCLANPADDGSGIKQLEHLIVQEKYRAVRFNPNLWPAGQKMTNEVGRSLFSKAGELGAPVAILTMKGIGPYIQEIEELCRDYPATTVILDHMSFCKPPTNDEEEKALSSFLNLSRFPQVYVKYSALFRITREAYPYEDTAQLLSRAISHYGANRIMWGSDFPYVVPECGYKGAREAISLVAGKIPVSLSDLDWILGKTVSQLFQGAWVTP

SEQ ID NO: 10793 - DNA, 519 bp, Sorghum bicolor
  misc_feature: Ceres ANNOT ID no. 6115939
  misc_feature: Encodes the peptide sequence at SEQ ID NO 10794
atggagaagtacgtacgcaggagcaggagtagcacgtctctgcagcgtcgggcggcggagaagaagaagggcttcctggccaagaccctggagcgttgctggtccctgggtggtggccgccggcgtccacggtggccgacgacgacgccaccggggtgcttcgtggtgctggtcggcccggagagggagcggttcgcggtgcgcgccgagggcgccaaccacccgttgttcagggcgctgctcgacgaggcggaggccgagtacggcttcccgcgcccggcggccgagccgctgctgctgccgtgcgccgccgacgagttcctgcgggtgatgtcggaggtggagcgggatcatcatcatcaggaggacgacgacgacgtagcacgcggcggcgcagcagttgctggtgcagcagcggcactgtcgtcgttgtcgccggcgtggagcttcttcttgaaaggaggtgccgccgcccgtgcaggtttccagaggatgagccccgggcgcttcttgaattaa

SEQ ID NO: 10794 - protein, 172 aa, Sorghum bicolor
  misc_feature: Ceres ANNOT ID no. 6115939
  misc_feature (23)..(115): Pfam Id: Auxin_inducible Pfam Desc: Auxin responsive protein
  misc_feature (46)..(120): NCBI GI: 38568063 NCBI Desc: osjnba0073e02.12 [oryza sativa (japonica cultivar-group)]
  misc_feature (50)..(116): NCBI GI: 38454136 NCBI Desc: at4g34750 [arabidopsis thaliana]
  misc_feature (50)..(114): NCBI GI: 92870695 NCBI Desc: auxin responsive saur protein [medicago truncatula]
  misc_feature (50)..(119): NCBI GI: 115482888 NCBI Desc: os10g0510500 [oryza sativa (japonica cultivar-group)]
  misc_feature (50)..(114): NCBI GI: 92870690 NCBI Desc: auxin responsive saur protein [medicago truncatula]
  misc_feature: The sequence is a functional homolog of SEQ ID NO. 402 in the 11/188,298 US application
  misc_feature: The sequence is a functional homolog of SEQ ID NO. 505 in the 11/188,298 US application
MEKYVRRSRSSTSLQRRAAEKKKGFLAKTLERCWSLGGGRRRPRWPTTTPPGCFVVLVGPERERFAVRAEGANHPLFRALLDEAEAEYGFPRPAAEPLLLPCAADEFLRVMSEVERDHHHQEDDDDVARGGAAVAGAAAALSSLSPAWSFFLKGGAAARAGFQRMSPGRFLN

SEQ ID NO: 10795 - DNA, 6981 bp, Sorghum bicolor
  misc_feature: Ceres ANNOT ID no. 6116030
  misc_feature: Encodes the peptide sequence at SEQ ID NO 10796
  misc_feature: Down-regulated in shoot tissues in response to salicylic acid treatment
  misc_feature: Down-regulated in shoot tissues in response to aminocyclopropane carboxylic treatment
atgtcgcagcttggattagctgcagctgcctcaaaggcactgccactactccctaatcgccagcgaagtcctgctgggactacattctcatcatctgcattgtcgaggccctcaaaccgaaggaaaagccgtacccgttcactccgtgatggtggagatggggtatcagatgtcaaaaagcacagccagtctgttcgtcaaggtcttgctggcattattgacctcccaagcgaggcagcttcggaagtggacatttcacatggatctgaggatcctaggggtccaccagattcctatcaaatgaatgggattatcaatgaaacacataatggaagacatgcttcagtgtccaaggttgttgaattttgtgcggcactaggtggcaaaacaccaattcacagtatattagtggccaataatggaatggcagcagcaaagttcatgaggagtgtccggacatgggctaatgatacttttggatctgagaaggcaattcagctcatagctatggcaactccggaagacatgaggataaatgcagagcacattagaattgctgatcaatttgtagaggtgcctggtggaacaaacaataataactacgccaacgttcaactcatagtggaggtagcagaaagagtaggtgtttctgctgtttggcctggttggggtcatgcttctgagaatcctgaactgccggatgcattgactgcaaaaggaatcgttttccttgggccacctgcatcatcaatgaatgcattgggagataaggtcggttcagctctcattgctcaagcagctggggtcccaactcttgcttggagtggatcacatgttgaagtgccattagagtgctgcttagacgctatacctgaggagatgtatagaaaagcttgtgttactaccacagaggaagcagttgcaagttgtcaagtgattggttatcctgccatgattaaggcatcctggggaggtggtggtaaaggaataagaaaggttcataatgatgatgaggttagagcactgtttaagcaagtacaaggtgaagtccctggctccccaatatttatcatgaggcttgcagcccagagtcggcatcttgaagttcagttgctttgtgatcaatatggcaatgtagcagcacttcacagtcgtgattgcagtgtgcaacggcgacaccagaagattattgaagaaggcccagttactgttgctcctcgtgagacagttaaagcacttgagcaggcagcaaggaggcttgctaaggctgtgggttatgttggtgctgctactgttgagtatctttacagcatggaaactggagaatactattttctggagcttaatccccgactacaggtcgagcatccagtcaccgaatggatagctgaagtaaatctgcctgcagctcaagttgctgttggaatgggcatacctctttggcaaattccagaaatcagacgtttctatggaatggactatggaggagggtatgatatttggaggaaaacagcagctcttgctacaccatttaattttgatgaagtagattctcaatggccaaagggccattgtgtagcagttagaattactagtgaggaccctgatgatggtttcaaacctactggtgggaaagtgaaggagataacttttaaagccaagcctaatgtttgggcctacttctcagtaaagtctggtggaggcattcatgaatttgctgattctcagtttggacatgtttttgcatatggactctctagatcagcagcaataacaaacatggctcttgcattaaaagagattcaaattcgtggagaaattcattcaaatgttgattacactgttgacctcttaaacgcttcagacttcagagaaaacaagattcatactggttggctggataccagaatagctatgcgtgttcaagctgagaggcccccatggtatatttcagtggttggaggtgctttatacaaaacagtaaccaccaatgcagccactgtttctgactatgttagttatctcaccaagggccagattccaccaaagcatatatcccttgtcaattctacagttagcttgaatatagaagggagcaaatacacaattgaaactgtaaggactggacatggtagctacaggttgcgaatgaatgaatcgacagttgaagcgaatgtacaatctttatgtgatggtggactcttaatgcagttggatggaaacagccatgtaatttatgcagaagaagaagctggtggtacacggcttcagattgatggaaagacatgcttgttgcagaatgaccatgatccatcaaagttattagctgagacaccctgcaaacttcttcgtttcttggttgctgatggtgctcatgttgatgcggatgtaccatacgctgaagttgaggttatgaagatgtgcatgcctctcctgtcacctgcttctggtgtcgttcattgtatgatgtctgagggccaggcgttgcaggctggtgatcttatagcaaggctggatcttgatgacccttctgctgtgaaaagggctgaaccatttgatggaatatttccacaaatggcgctccctgttgctgcctctagtcaagtacacaaaagatatgctgcaagtttgaatgctgctcgaatggttcttgcaggatatgagcacaatatcaatgaagtcgttcaagatttgatatgctgcctggacaaccctgagcttcctttcctacagtgggatgaacttatgtctgttctagcaacgaggcttccaagaaatctcaagagtgagttagaggataaatacaaggaatacaagttgaatttttaccgtggaaaaaacgtggacttcccttccaagttgctaagagacatcattgaggaaaatcttgcatatggttcagagaaggaaaaggctacaaatgagaggcttgttgagcctcttacgaacctactgaagtcatatgagggtgggagagaaagtcatgcacattttattgccaagtcccttttcgaggagtatcttatggtggaagaacttttcagtgatggaattcagtctgacgttattgaaaccttgcgtcatcagcacagtaaagacctgcagaaggttgtagacattgtgttgtctcaccagggtgtgagaaacaaagctaagcttgtaacagcactcatggaaaagctggtttatccaaatccggttgcttacagggatctgttggttcgcttttcttccctcaatcataaaagatattataagttggcccttaaagcaagtgaacttcttgaacaaaccaaactaagtgaactccgtgcaagcattgcaagaagcctttcagatctggggatgcataagggagacatgactattaaggatagcatggaagatttagtctctgccccattgcctgttgaagatgctcttatttctttgtttgattacagcgatgcaactgttcagcagaaagtgattgagacatacatatcacgattgtaccagcctcatcttgtgaaggatagcatccaaatgaaattcaaggaatatggtgctattgctttttgggaattttctgaagggcatgttgatacttcaaatggacatgggactattcttggtgggaagagatggggttccatggtcgtcctcaaatcacttgaatctgcatcaacagccattgtggctgcattaaaggattcagcacagtacaacagctctgagggcaacacgatgcacattgcattattgagtgctgaaaatgaaagtaatatgagtggaacaagtgatgatcaagctcaacataggatggaaaagcttaccaagatactgaaggatactaatgttgcaagtgatctccgagctgctggtttgaaggttataagttgcattgttcaaagagatgaagctcgcatgccaatgcgccacacattcctctggttggatgaaaagagttgttatgaagaagagcaaattctccggcatgtggagcctcccctctctgcacttcttgaattggataagttgaaagtgaaaggatacaatgaaatgaagtatactccgtcacgtgatcgtcaatggcatatctacacactaagaaatactgaaaaccccaaaatgttgcatagggtatttttccgaactattgtcaggcaacccaatgcaggcaacaagtttacatcagctcaggtcagtgatactgaagtaggaggtcctgaagattctctgtcattcacatcgaatagcatcctaagatcattgatgactgctatagaagaattagagcttcatgcgattaggacaggtcattctcacatgtatttgtgcatactgaaagagcaaaagcttcttgatctcattccattttcagggagtacaattgttgatgttggccaagatgaagctactgcttgttcacttttaaaatcaatggctttgaagatacatgaccttgttggtgcaaggatgcatcatctgtctgtatgccagtgggaggtgaaactcaagttggattgtgatgggcctgcaagtggtacctggagagttgtgactacaaatgttactagtcacacctgcaccattgatatctaccgagaagtggaagatacagaatcgcagaagttagtataccattcaaccacttcggcagctggtcctggtccgttgcatggtgttgcactgaataatccatatcaacctttaagtgtgattgatctaaagcgctgctctgctaggaacaacagaacaacatattgctacgattttccgctggcatttgaaactgcactgcagaagtcatggcagtccaacggctctagtgtttctgtaggcagtggaaatagtaaatcctacgtgaaggcaactgagctggtgtttgctgaaaaacatgggtcctggggcactcctatagttcccatggaacgtcctgctgggctcaatgacattggtatggtcgcttggatcttggagatgtcaacacctgaatttcccaatggcaggcagattattgttgtagcaaatgatattactttcagagctggatcattcggcccaagggaagatgcattttttgaagctgtcaccaacctggcttgtgaaaggaaacttccccttatatacttggcagcaaactctggtgctaggattggcatagctgatgaagtaaaatcttgcttccgtgttgggtggtctgacgaaggcagccctgagcgagggtttcagtacatctatctgactgaagaagactatgcccgtattagctcttctgttatagcacataagctgcagctagatagcggtgaaattaggtggattattgactctgttgtgggcaaggaggatgggcttggtgttgagaacatacatggaagtgctgctatcgccagtgcttattctagggcatatgaggagacatttacacttacatttgtgaccggacggactgtaggaataggagcttatcttgctagacttggtatacggtgcatacagcgtcttgaccagccgattattttaacagggttttctgccctgaacaagctccttgggcgggaagtgtacagctcccacatgcagcttggtggtcctaagatcatggcgaccaatggtgttgtccacctgactgttccagatgaccttgaaggtgtttccaatatattgaggtggctcagctatgttcctgcaaacattggtggacctcttcctattaccaaacctttggaccctccagacagacctgttgcatacatccctgagaacacatgcgatccacgtgcagccatccgtggtgtagatgacagccaagggaaatggttgggtggtatgtttgacaaagacagctttgtggagacatttgaaggatgggcaaaaacagtggttactggcagagcaaagcttggaggaattcctgtgggtgtcatagctgtggagacacagaccatgatgcagcttgtccctgctgatccaggtcagcttgattcccatgagcgatccgttcctcgggctggacaagtgtggttcccagattctgcaaccaagacagctcaggcattattagacttcaaccgtgaaggattgcctctgtttatcctggctaactggagaggtttctctggtggacagagagatctctttgaaggaattcttcaggctgggtcaacaattgtcgagaaccttaggacatataatcagcctgcgtttgtctacattcctatggctggagagcttcgtggaggagcttgggttgtggtcgatagcaaaataaatccagaccgcattgagtgttatgctgagaggactgccaaaggtaatgttctcgaacctcaagggttaattgaaatcaagttcaggtcagaggaactccaagactgtatgggtaggcttgaccccgagttgataaatctgaaagcaaaactccaagatgtaaagcatggaaatggaagtctaccagacatagaatcccttcagaagagtatagaagcacgtacgaaacagttgctgcctttatatacccagattgcaatacggtttgctgaattgcatgatacttccctaagaatggcagctaaaggcgtgattaagaaagttgtagactgggaagaatcacgctctttcttctataaaaggctacggagaaggatctctgaagatgttcttgcaaaagaaataagacatatagtcggtgacaacttcactcaccaatcagcaatggagctcatcaaggaatggtacctggcttctccagccacagcaggaagcactggatgggatgacgatgatgcatttgttgcctggaaggacagtcctgaaaactacaatggatatatccaagagctaagggctcaaaaagtgtctcagtcgctctctgatctcactgactccagttcagatctacaagcattctcgcagggtctttctacgctattagataagatggatccctctcaaagagcgaagtttgttcaggaagtcaagaaggtccttggttga

SEQ ID NO: 10796 - protein, 2326 aa, Sorghum bicolor
  misc_feature: Ceres ANNOT ID no. 6116030
  misc_feature (839)..(1554): Pfam Id: ACC_central Pfam Desc: Acetyl-CoA carboxylase, central region
  misc_feature (1653)..(2211): Pfam Id: Carboxyl_trans Pfam Desc: Carboxyl transferase domain
  misc_feature (131)..(254): Pfam Id: CPSase_L_chain Pfam Desc: Carbamoyl-phosphate synthase L chain, N-terminal domain
  misc_feature (527)..(634): Pfam Id: Biotin_carb_C Pfam Desc: Biotin carboxylase C-terminal domain
  misc_feature (256)..(488): Pfam Id: CPSase_L_D2 Pfam Desc: Carbamoyl-phosphate synthase L chain, ATP binding domain
  misc_feature (772)..(838): Pfam Id: Biotin_lipoyl Pfam Desc: Biotin-requiring enzyme
  misc_feature (1)..(2325): NCBI GI: 32264940 NCBI Desc: acetyl-coenzyme a carboxylase acc1a [zea mays]
  misc_feature (1)..(2325): NCBI GI: 32264942 NCBI Desc: acetyl-coenzyme a carboxylase acc1b [zea mays]
  misc_feature (1)..(2325): NCBI GI: 854731 NCBI Desc: acetyl-coenzyme a carboxylase
  misc_feature (1)..(2326): NCBI GI: 29123370 NCBI Desc: acetyl-coenzyme a carboxylase [setaria italica]
  misc_feature (1)..(2326): NCBI GI: 15558947 NCBI Desc: acetyl-coenzyme a carboxylase [setaria italica]
  misc_feature: Described in US Patent 6,069,298
  misc_feature: Useful for making plants with altered oil content
  misc_feature: Useful for making plants with modulated herbicide sensitivity
  misc_feature: Functional homolog of the protein sequence given in SEQ ID NO 13430
  misc_feature: Useful for making plants with altered oil content
  misc_feature: Useful for making plants with modulated herbicide sensitivity
  misc_feature: Functional homolog of the protein sequence given in SEQ ID NO 13625
  misc_feature: Down-regulated in shoot tissues in response to salicylic acid treatment
  misc_feature: Down-regulated in shoot tissues in response to aminocyclopropane carboxylic treatment
MSQLGLAAAASKALPLLPNRQRSPAGTTFSSSALSRPSNRRKSRTRSLRDGGDGVSDVKKHSQSVRQGLAGIIDLPSEAASEVDISHGSEDPRGPPDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVEVAERVGVSAVWPGWGHASENPELPDALTAKGIVFLGPPASSMNALGDKVGSALIAQAAGVPTLAWSGSHVEVPLECCLDAIPEEMYRKACVTTTEEAVASCQVIGYPAMIKASWGGGGKGIRKVHNDDEVRALFKQVQGEVPGSPIFIMRLAAQSRHLEVQLLCDQYGNVAALHSRDCSVQRRHQKIIEEGPVTVAPRETVKALEQAARRLAKAVGYVGAATVEYLYSMETGEYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEITFKAKPNVWAYFSVKSGGGIHEFADSQFGHVFAYGLSRSAAITNMALALKEIQIRGEIHSNVDYTVDLLNASDFRENKIHTGWLDTRIAMRVQAERPPWYISVVGGALYKTVTTNAATVSDYVSYLTKGQIPPKHISLVNSTVSLNIEGSKYTIETVRTGHGSYRLRMNESTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVVHCMMSEGQALQAGDLIARLDLDDPSAVKRAEPFDGIFPQMALPVAASSQVHKRYAASLNAARMVLAGYEHNINEVVQDLICCLDNPELPFLQWDELMSVLATRLPRNLKSELEDKYKEYKLNFYRGKNVDFPSKLLRDIIEENLAYGSEKEKATNERLVEPLTNLLKSYEGGRESHAHFIAKSLFEEYLMVEELFSDGIQSDVIETLRHQHSKDLQKVVDIVLSHQGVRNKAKLVTALMEKLVYPNPVAYRDLLVRFSSLNHKRYYKLALKASELLEQTKLSELRASIARSLSDLGMHKGDMTIKDSMEDLVSAPLPVEDALISLFDYSDATVQQKVIETYISRLYQPHLVKDSIQMKFKEYGAIAFWEFSEGHVDTSNGHGTILGGKRWGSMVVLKSLESASTAIVAALKDSAQYNSSEGNTMHIALLSAENESNMSGTSDDQAQHRMEKLTKILKDTNVASDLRAAGLKVISCIVQRDEARMPMRHTFLWLDEKSCYEEEQILRHVEPPLSALLELDKLKVKGYNEMKYTPSRDRQWHIYTLRNTENPKMLHRVFFRTIVRQPNAGNKFTSAQVSDTEVGGPEDSLSFTSNSILRSLMTAIEELELHAIRTGHSHMYLCILKEQKLLDLIPFSGSTIVDVGQDEATACSLLKSMALKIHDLVGARMHHLSVCQWEVKLKLDCDGPASGTWRVVTTNVTSHTCTIDIYREVEDTESQKLVYHSTTSAAGPGPLHGVALNNPYQPLSVIDLKRCSARNNRTTYCYDFPLAFETALQKSWQSNGSSVSVGSGNSKSYVKATELVFAEKHGSWGTPIVPMERPAGLNDIGMVAWILEMSTPEFPNGRQIIVVANDITFRAGSFGPREDAFFEAVTNLACERKLPLIYLAANSGARIGIADEVKSCFRVGWSDEGSPERGFQYIYLTEEDYARISSSVIAHKLQLDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDDLEGVSNILRWLSYVPANIGGPLPITKPLDPPDRPVAYIPENTCDPRAAIRGVDDSQGKWLGGMFDKDSFVETFEGWAKTVVTGRAKLGGIPVGVIAVETQTMMQLVPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVKHGNGSLPDIESLQKSIEARTKQLLPLYTQIAIRFAELHDTSLRMAAKGVIKKVVDWEESRSFFYKRLRRRISEDVLAKEIRHIVGDNFTHQSAMELIKEWYLASPATAGSTGWDDDDAFVAWKDSPENYNGYIQELRAQKVSQSLSDLTDSSSDLQAFSQGLSTLLDKMDPSQRAKFVQEVKKVLG

SEQ ID NO: 10797 - DNA, 1791 bp, Sorghum bicolor
  misc_feature: Ceres ANNOT ID no. 6116052
  misc_feature: Encodes the peptide sequence at SEQ ID NO 10798
atggcgctctcctgcatgaggtgccccgcgggcgccaccggctccgcccgacgcgcgccgtttgccacggcggcggccgcggtctccttcgccagatgcggcggcctcgggaggtccgcctccgccgccgctgccgcgtgttggcgcatccacgccgtcgccccgcagggagcgaaagctcccatgactgctgatgtgaagcatgttgtcacacctcctgcctcaccaaaggtggaaaatggctctccgtcggaaatcactctggatgaatttgaagacttgagtgctctatgcaagaatggcaatgacgattctactgttagcatcactgtagttggagcatctggtgaccttgccaagaagaagatatttcctgccctttttgctctctactatgaagattgccttcccaagcatttcaccatctttggctacgcacggagcaagatgacagatgctgaactgaggaacatggttagcaaaacactgacttgcagaattgataaaagggaaaactgcagtgagaaaatggaagagttcctcaaaagatgcttctatcattcaggccaatatgattcagaagaacatttcctagatctagacaagaagctaaagcaacatgagggtcccagagtttctaaccgccttttctacttgtcaatacctcctaatatattcttggatgttgtaaaatgtgcaagcaaatcagcatcttcggtgaatggttggacaagagtaattgttgagaagcccttcggtcgagactccgaatcctctgctgcgttaacaagaggtctaaagcagtaccttgtagaggaccaaattttcaggattgaccattacttaggaaaagaactggtggagaatttgtctgtccttcgcttctcgaatctcgtttttgagccgctctggtcaagacaatatataagaaatgtgcaacttatattctcagaagacttcggtactgaaggacgtggaggatactttgatggctacggtattattcgagacataatgcagaatcatctccttcagatactagccttatttgcaatggaaactcctatcagtttggaagcagaggatataagaaatgagaaggttaaagttcttcgttccatgaagccattgcagctggaagatgtggtcgtaggacagtataaaagccacacaaaaggtggtactacataccctgggtatactgatgataagacagtgcccaaggatagtgtgactccaacttttgctgctgcggcacttttcataaataatgccagatgggatggagttccgtttcttatgaaagctgggaaagctttacacacaaaacgagctgagattagggtacagttccgacatgttcctggaaatctctacaaggggagttttggcacagatcttgatagggccactaatgagcttgtgatacgtgttcaaccggatgaagctatttacctaaagattaacaacaagattcctggtctcggtatgcgactggataggagtaacttgaatctccattatgcagcaaggtactcaaaggagataccggatgcttatgagagactcttgcttgatgccatcgaaggtgagcgcaggcttttcatccgctcggatgagttggacgctgcatggtcactcttcacacccctcctgaaggagttggaagagaagcggatagctcctgagctctacccttatggaagccgtggacctgtcggcgctcactatcttgccgcgaagtacaatgtaagatggggcgacttgagtgcagagcactacaaggcatga

SEQ ID NO: 10798 - protein, 596 aa, Sorghum bicolor
  misc_feature: Ceres ANNOT ID no. 6116052
  misc_feature (292)..(589): Pfam Id: G6PD_C Pfam Desc: Glucose-6-phosphate dehydrogenase, C-terminal domain
  misc_feature (110)..(289): Pfam Id: G6PD_N Pfam Desc: Glucose-6-phosphate dehydrogenase, NAD binding domain
  misc_feature (80)..(592): NCBI GI: 9955555 NCBI Desc: glucose-6-phosphate 1-dehydrogenase [arabidopsis thaliana]
  misc_feature (80)..(592): NCBI GI: 18086448 NCBI Desc: at5g13110/t19l5_70 [arabidopsis thaliana]
  misc_feature (69)..(589): NCBI GI: 9392607 NCBI Desc: plastidic glucose 6-phosphate dehydrogenase [nicotiana tabacum]
  misc_feature (103)..(590): NCBI GI: 5734502 NCBI Desc: glucose-6-phosphate 1-dehydrogenase [solanum tuberosum]
  misc_feature (105)..(592): NCBI GI: 1166405 NCBI Desc: glucose-6-phosphate 1-dehydrogenase [arabidopsis thaliana]
  misc_feature (80)..(592): SWISSPROT Homolog: EC 1.1.1.49 Glucose-6-phosphate 1-dehydrogenase 2, chloroplast precursor
MALSCMRCPAGATGSARRAPFATAAAAVSFARCGGLGRSASAAAAACWRIHAVAPQGAKAPMTADVKHVVTPPASPKVENGSPSEITLDEFEDLSALCKNGNDDSTVSITVVGASGDLAKKKIFPALFALYYEDCLPKHFTIFGYARSKMTDAELRNMVSKTLTCRIDKRENCSEKMEEFLKRCFYHSGQYDSEEHFLDLDKKLKQHEGPRVSNRLFYLSIPPNIFLDVVKCASKSASSVNGWTRVIVEKPFGRDSESSAALTRGLKQYLVEDQIFRIDHYLGKELVENLSVLRFSNLVFEPLWSRQYIRNVQLIFSEDFGTEGRGGYFDGYGIIRDIMQNHLLQILALFAMETPISLEAEDIRNEKVKVLRSMKPLQLEDVVVGQYKSHTKGGTTYPGYTDDKTVPKDSVTPTFAAAALFINNARWDGVPFLMKAGKALHTKRAEIRVQFRHVPGNLYKGSFGTDLDRATNELVIRVQPDEAIYLKINNKIPGLGMRLDRSNLNLHYAARYSKEIPDAYERLLLDAIEGERRLFIRSDELDAAWSLFTPLLKELEEKRIAPELYPYGSRGPVGAHYLAAKYNVRWGDLSAEHYKA

SEQ ID NO: 10799 - DNA, 5664 bp, Sorghum bicolor
  misc_feature: Ceres ANNOT ID no. 6116137
  misc_feature: Encodes the peptide sequence at SEQ ID NO 10800
  misc_feature: Up-regulated in root tissues in response to salicylic acid treatment
  misc_feature: Up-regulated in shoot tissues in response to salicylic acid treatment
atggaaacgcgcagccgcaagcgggcggaggcctcctcttcttccgcgacctcctcctcctcccgctcatccaagcgctcacggcccaaccccaaccctaaccctaaccctaaccctcccgccgcctcctcctcacccgcccccaaccctgtgccgttgccaccacgcacccgccgctcggccgctgtcaaccccctccccgcgatggactcctcgggcgacaacaactctaatcccaacccgccgccgcggcgccgcggccgcccctcgaacgcagataagggtaaggagcagcagcagccggagccctctcacagctcccgagtgcgcgaggccgagcgccttctgggcctaggtttcgagggcattgaggatgacgacgatgcggggttcggggctggggcgatcccccacagcctgacttctgcgagcaccgcgctccaggggctgcttaggaagcttggtgctggcctggacgatatactgccgtcatcagcactgtcagccgctgcagcagctgcagccgcgtcatcgtcatcagcatccggacagctgggtgggaggttgaagaagattcttgctgggttgcgtgctgatggagaggatgggcggcagatcgaggcgttgacacaactctgtgagatgctgtctattggtacagaagagtctcttggggcattctcggtggactcatttgtccctgtcctggtcgggctactcaatcacgagagcaacccagacatcatgctgctcgcagcacgagccctaactcacctctgtgatgtgctgccatcttcttgctctgcagttgtgcattatggcgctgtgccctgcttttgtgcccggcttctcaccattgaatacatggacttggcagagcagtcattgcaagctcttaaaaaaatatccctggagcatccaactgcctgcttgcgggctggtgcactaatggcagtcctatcataccttgactttttctccacaggtgttcagagagttgcattatctacagctgctaatatgtgtaggaaacttccttctgatgcatcagattttgtaatggaagcggttccacttcttactaatctactgaactaccatgattcaaaagtactggagcatgcttctgtctgccttacccgtatcgcggaagctttttcaccgtttccagaaaaattggatgagttgtgcaatcatggattggttgcacaagctgctagcttagtatctgttagcaacttagcaggacaggcatccttgagtacatcgacatatacgggtgtgattcgtctactctcaatatgcgctagtggatcacctctggcagctaaaacacttctccttcttggaattagtggcacacttaaagatatcctttcaggctctgggttggttgctggcacaactgtgtccccagctttaacaagaccagctgatcagatgaatgagattgtgaagcttgctgatgagttacttcctcctctgcctgttgggaccatttctttaccgatgtattccgatattcacatgaaaggttcttctgtaaagaaatcaacttctaataagcagggtgaacatggttcaacaggaattgaactatcaggtcgggagaaattattgcgtgatcagcctgaacttctgcagcaatttggtatggacctgttacctaccatgacacaggtgtatggctctagtgtaagtggaccaatacgccacaagtgcttatctgtcattgggaaattaatgtactttagctcagctgagatgatccagtctctccttagcacgacaaacatttccagctttttagctggcattttagcttggaaagatccacaagtgctgatccctgctcttcagatagcagaagttttaatggaaaagcttccagagatatttgtgaagatgtttgtgagggaaggcgttgttcatgctgttgagtcacttatatgcccagagttctctggtcaagtgactcctcaagtgtcgcagctggacaatcatgtggattccattacatcttcacaaaataggcgcaaccgccgtcgaaataatgccgtgagtactgaaaacaacttgcctgatggatcaaaaggttcccattctgtgattgccaattcaccaccaagcacggctgaagttccaaataatagtctccgtgctttagttagtaatcatgcaaagtcatttaaggataagtatttcccatcagagcctggctcaagtgacattgcagttactgatgatctccttaaactgagggcactttgtgcaaaactgaatacaacagctgacactatcaaaacaaaagctaaaggaaaatcaaaggctgtggtaggcaataactttgatgtgctatgcaatgttgaggagcaattggatggtataatagctgaaatgttgtctgagcttagcaagggggatggtgtatcgacatttgagttcattggaagtggagttgtttcagctttgctaacctatctgtcatgtggaacatttgggagggaaaaggtgtctgaagcaaacataccaaatttgcgtcatcaagcagtcagacgatacaaggcatttatatcgcttgcccttccaaatgataaaaatgggaataaaacccctatgacattcctagtccataaactgcaaagcgccctctcttcgttggaacgtttcccagttgtgcttagccattctggaagagcgccgactttgggaggatcccgcctgacgacaggcttaggagctctgtcacagcccttcaaattgcgactttgtcgagcgcctggtgaaaagtcacttaaggattattcatccaatattgttcttattgacccattagcaagtctggcagctgttgaagattttctttggcctagagtccagcgcactgagccagtctcgaagcctccagtctctgcaaataattctgaatctggagcagcaagttccacagcttgtgcgccttcaattccgccaggaactcaatctggccgtcgggcatcattaagatcacagtcatcagctgccactagtggtgcaattaagaaggattatcaggagggaagcataaacacatcaaagggaaaaggaaaagctgttcttaaatcgagtttggatgaacctaaaggcccacatactaggaatgctgaacgaagaaaagctgcttctgagaaagatgttgaactgaaaccatctcatgatcacagtacttcagaggatgaagatcttgatgcttctccagttgagattgatgatgctttaatgcttgatgatgacgatgaggatgtctccgaggatgaagatgatgatcatgaggcggttctccgagggtctcttccttcttgtgttcctgagggagtgcatgatgtgaaattaggagatgctgatgattctagtgttgcctcattggcaaatgataaccaggcacagccctcatctggttccagtacaaaaaatgcgtctggcaggggattggatgctgctgaatttagaagtccaagcacatttggttcacggggtgcaatgtcgtttgctgcagctgcaatggctggattaacttcagtaggtagtcgtggtattagaggtagccgagatcggagtggccttccattgggtgctcgtacaaccgagcattacaacaaattgatatttacagctggtgggaagcagcttaacaaacatttgactgtatatcaagctgttcaaaggcaagtagttcatgatgaggatgatgaagatcagttaggtggatccgatttacctgatgatggtaaccacttctggggtgatgtattcactataacatatcagaaggctgataacacagcggagaaggggtctgttggaggttcggcttcagtgccaaaaccttccaaatcagattcgtgcagaacttcatctcaaaaatcgtttacttctcttcttgatagtattttgcaaggagagcttccctgtgatttagagaaatcaaaccaaacctacaatatcttatcactattacgtgtgttggagggcttgaatcagttatctcctcgtctgaaactgcaggcaacacgtgatgattttgctgaaggaaaagttgctacattggatgggctttatgatgttggagtcaaggtaccctcagaggagtttgtcaacagtaagatgaccccaaaacttgctcggcaaattcaggatgttcttgcactgtgtagtggcagtttaccatcttggtgttatcagctgacgaaagcttgtcctttcctgtttccttttgaaacacgaagacaatacttctattccacagcttttgggttgtctcgtgcactgcatcgtcttcagcaacaaccgggtgataataacaacactgcttttgaaagagaagtccgggttggtagactgcaacgccagaaagtccgtgtttctcgtaaccgtatcttggattctgcggctaaagttatggagatgttctctaatcagaaggctgtcctagaagttgaatactttggtgaagttggaactgggcttggtccaactttggagttttatactctcttaagccgtgagctgcaaagggttgacttaggattgtggagatctcattctccagatgattctggcatgcaacttgatggaaatgctgatgatttaacaagtgaaaagcgtgaatcagaatcacttgttgagagcaggaacatagtgcaagcacctcttggtttatttcctcagccttggccacctagtgctgctgcatcagaaggtagcaagttcttcaaagttgtcgagtacttccgcttagttggtcgaacgatggcaaaagcattgcaagatggaaggcttcttgatttgcctttgtcgacagcattttacaaacttttgcttggacaagaacttgatttgtatgatatattatcttttgatactgagttcggaaagacattgcaagaactgcaaattcttgttgcacgtaaacaatttcttgagtcctgctctagtgagaaccaaaaaatagaagaattatgtttccgtggtgctcccattgaagatttatgtttggacttcactcttccgggctatcctgattatgttctcaaggaaggtggagagaatgcagtggtcaacatttataacttagaagagtatatttctttggttgtggatgctactgttaagactggaataatgcggcaagtagaggcattgaaggcaggattcaatcaggtgtttgacatatcgacactccaaatattttctcctcaagaacttgattatctgttctgtggtcgccgtgaactttgggagccggaaacactgcctgaacatataaaattcgaccatggttatacctctaagagtcctgcaattgtcaattttcttgagatcatggcagagtttactcctgagcagcaacatgctttctgccagtttgtgactggtgctcctcggcttccacctgggggtttggctgctctaaatcctaagttgactattgttaggaagcactcatctgcggcaaataatacttcaaatccaactggagcgacagagtctgcagatgatgatttgcctagtgtcatgacttgtgccaactatcttaaactaccaccatactccaccaaggctatcatgttaaagaaactgctttatgcgatcaacgaaggccaagggtcatttgatctttcgtga

SEQ ID NO: 10800 - protein, 1887 aa, Sorghum bicolor
  misc_feature: Ceres ANNOT ID no. 6116137
  misc_feature (1510)..(1887): Pfam Id: HECT Pfam Desc: HECT-domain (ubiquitin-transferase)
  misc_feature (1)..(1887): NCBI GI: 92878894 NCBI Desc: hect [medicago truncatula]
  misc_feature (1)..(1887): NCBI GI: 32965334 NCBI Desc: hect ubiquitin-protein ligase 3 [arabidopsis thaliana]
  misc_feature (663)..(1887): NCBI GI: 30692023 NCBI Desc: hect-domain-containing protein / ubiquitin-transferase family protein [arabidopsis thaliana]
  misc_feature (1171)..(1887): NCBI GI: 115443623 NCBI Desc: os02g0101700 [oryza sativa (japonica cultivar-group)]
  misc_feature (1372)..(1837): NCBI GI: 109731153 NCBI Desc: trip12 protein [homo sapiens]
  misc_feature: Up-regulated in root tissues in response to salicylic acid treatment
  misc_feature: Up-regulated in shoot tissues in response to salicylic acid treatment
  misc_feature: The sequence is a functional homolog of SEQ ID NO. 309 in the 11/188,298 US application
METRSRKRAEASSSSATSSSSRSSKRSRPNPNPNPNPNPPAASSSPAPNPVPLPPRTRRSAAVNPLPAMDSSGDNNSNPNPPPRRRGRPSNADKGKEQQQPEPSHSSRVREAERLLGLGFEGIEDDDDAGFGAGAIPHSLTSASTALQGLLRKLGAGLDDILPSSALSAAAAAAAASSSSASGQLGGRLKKILAGLRADGEDGRQIEALTQLCEMLSIGTEESLGAFSVDSFVPVLVGLLNHESNPDIMLLAARALTHLCDVLPSSCSAVVHYGAVPCFCARLLTIEYMDLAEQSLQALKKISLEHPTACLRAGALMAVLSYLDFFSTGVQRVALSTAANMCRKLPSDASDFVMEAVPLLTNLLNYHDSKVLEHASVCLTRIAEAFSPFPEKLDELCNHGLVAQAASLVSVSNLAGQASLSTSTYTGVIRLLSICASGSPLAAKTLLLLGISGTLKDILSGSGLVAGTTVSPALTRPADQMNEIVKLADELLPPLPVGTISLPMYSDIHMKGSSVKKSTSNKQGEHGSTGIELSGREKLLRDQPELLQQFGMDLLPTMTQVYGSSVSGPIRHKCLSVIGKLMYFSSAEMIQSLLSTTNISSFLAGILAWKDPQVLIPALQIAEVLMEKLPEIFVKMFVREGVVHAVESLICPEFSGQVTPQVSQLDNHVDSITSSQNRRNRRRNNAVSTENNLPDGSKGSHSVIANSPPSTAEVPNNSLRALVSNHAKSFKDKYFPSEPGSSDIAVTDDLLKLRALCAKLNTTADTIKTKAKGKSKAVVGNNFDVLCNVEEQLDGIIAEMLSELSKGDGVSTFEFIGSGVVSALLTYLSCGTFGREKVSEANIPNLRHQAVRRYKAFISLALPNDKNGNKTPMTFLVHKLQSALSSLERFPVVLSHSGRAPTLGGSRLTTGLGALSQPFKLRLCRAPGEKSLKDYSSNIVLIDPLASLAAVEDFLWPRVQRTEPVSKPPVSANNSESGAASSTACAPSIPPGTQSGRRASLRSQSSAATSGAIKKDYQEGSINTSKGKGKAVLKSSLDEPKGPHTRNAERRKAASEKDVELKPSHDHSTSEDEDLDASPVEIDDALMLDDDDEDVSEDEDDDHEAVLRGSLPSCVPEGVHDVKLGDADDSSVASLANDNQAQPSSGSSTKNASGRGLDAAEFRSPSTFGSRGAMSFAAAAMAGLTSVGSRGIRGSRDRSGLPLGARTTEHYNKLIFTAGGKQLNKHLTVYQAVQRQVVHDEDDEDQLGGSDLPDDGNHFWGDVFTITYQKADNTAEKGSVGGSASVPKPSKSDSCRTSSQKSFTSLLDSILQGELPCDLEKSNQTYNILSLLRVLEGLNQLSPRLKLQATRDDFAEGKVATLDGLYDVGVKVPSEEFVNSKMTPKLARQIQDVLALCSGSLPSWCYQLTKACPFLFPFETRRQYFYSTAFGLSRALHRLQQQPGDNNNTAFEREVRVGRLQRQKVRVSRNRILDSAAKVMEMFSNQKAVLEVEYFGEVGTGLGPTLEFYTLLSRELQRVDLGLWRSHSPDDSGMQLDGNADDLTSEKRESESLVESRNIVQAPLGLFPQPWPPSAAASEGSKFFKVVEYFRLVGRTMAKALQDGRLLDLPLSTAFYKLLLGQELDLYDILSFDTEFGKTLQELQILVARKQFLESCSSENQKIEELCFRGAPIEDLCLDFTLPGYPDYVLKEGGENAVVNIYNLEEYISLVVDATVKTGIMRQVEALKAGFNQVFDISTLQIFSPQELDYLFCGRRELWEPETLPEHIKFDHGYTSKSPAIVNFLEIMAEFTPEQQHAFCQFVTGAPRLPPGGLAALNPKLTIVRKHSSAANNTSNPTGATESADDDLPSVMTCANYLKLPPYSTKAIMLKKLLYAINEGQGSFDLS

SEQ ID NO: 10801 - DNA, 453 bp, Sorghum bicolor
  misc_feature: Ceres ANNOT ID no. 6116198
  misc_feature: Encodes the peptide sequence at SEQ ID NO 10802
atgaggccggccatcctgcttacgatctgcaccttgtccgcgctgcttctggtggcgcgcggcttggagaagccatcggtcgcgccggtggtggccgtgggggtggcggcggccagtgatctcatccgctccggtggtcaccgctacctggacgtcagaacggaggaggaattcaggaatgggcatgtggaggattctcttaacgtgccctatcttttcttcacttcacaaggaagggagaagaacccccggttcgttgcacaggtcgcagcagatttcgacaaagaggacaacatagttgtgggctgcaaaagtggagtaaggtctgaactagcatgtgctgatctcatggcagctggatttagaaatgtgaagaacatagaaggtggttacaccgcatgggtggaaaatggtcttgctgtgaagaaatctcaaggacaagatgaactatga

SEQ ID NO: 10802 - protein, 150 aa, Sorghum bicolor
  misc_feature: Ceres ANNOT ID no. 6116198
  misc_feature (34)..(137): Pfam Id: Rhodanese Pfam Desc: Rhodanese-like domain
  misc_feature (12)..(150): NCBI GI: 115457420 NCBI Desc: os04g0249600 [oryza sativa (japonica cultivar-group)]
  misc_feature (19)..(141): NCBI GI: 115443633 NCBI Desc: os02g0102300 [oryza sativa (japonica cultivar-group)]
  misc_feature (3)..(119): NCBI GI: 38346958 NCBI Desc: osjnbb0026i12.5 [oryza sativa (japonica cultivar-group)]
  misc_feature (30)..(140): NCBI GI: 92870186 NCBI Desc: rhodanese-like [medicago truncatula]
  misc_feature (23)..(139): NCBI GI: 71081904 NCBI Desc: senescence-associated protein [nicotiana tabacum]
  misc_feature (32)..(142): SWISSPROT Homolog: EC 2.8.1.1 Thiosulfate sulfurtransferase
MRPAILLTICTLSALLLVARGLEKPSVAPVVAVGVAAASDLIRSGGHRYLDVRTEEEFRNGHVEDSLNVPYLFFTSQGREKNPRFVAQVAADFDKEDNIVVGCKSGVRSELACADLMAAGFRNVKNIEGGYTAWVENGLAVKKSQGQDEL

SEQ ID NO: 10803 - DNA, 2004 bp, Sorghum bicolor
  misc_feature: Ceres ANNOT ID no. 6116326
  misc_feature: Encodes the peptide sequence at SEQ ID NO 10804
atgtcgatcgactcggacagctcgtcgcagagcggcgccgactacaggagcttccgccagataacccgagaccgtttgttagttgagatgctgagatcgactcggaagagttcaaaatcaacatggaaggttctaatcatggacaaacttacggtcaagataatgtcattttcatgcaagatggcagatatcacagaagaaggggtttcattggttgaagacctatacaaacggaggcagccattgccttcaatggatgcaatttatttcatgcagcctactaaagaaaatgttcgcatattcatgtctgacatgtcaggaaaaaattcactgtacaagaaagcttatgtttttttcagttctcccgtacagagggaattggtagctcatataaaaaaggattcgactgtactaactcgcatcagtgcactcagtgagatgaacttggaatactttgctattgatagtcagggattcataactgaccatgacaaggccttggaggagttgtttagtgaagatgcagaaggctcacacaaatacaatgcatgccttaacacaatggctacaagaattgctacagtgtttgcatcattgagggaatttcctcgtgtgcactaccgtgtagccaggacaatcgatgcatctactctgacgacactacgagatttggtcccaacaaagcttgctgcttctgtgtggaattcccttgccagatataagtcgacgatacctgaatttccacaaacagaaacatgtgaactacttattgttgaccgatcaatagatcagattgcaccaattattcatgagtggacatatgatgctatgtgccatgatctactgtatatggatggcaacaagtatgtgcaagaggttccaagtaagaatggttcagcaaatgagaaaaaggaggttttgttggaggatcatgatccagtatggcttgagctgcggcatgcgcatatagctgatgctaatgaaaggctgtatgaaaagatgaccagttttgtatcaaagaataaagcagctcaactacaacaggcaagatctggtggagagttatctaccaagcagttgcagaaaatggttcaagctcttccacaatatagtgatcaaattgacaagctcacccttcatgttgagattgcaggaaagcttaataatataatcaaagaacaacaccttaaagatgttggacagctagagcaagatcttgtgtttggtgatgctgggacaaaagaactaatcagtttcttacgaacccgcatggatgtaagtcgtgaaaataagttgcgtttgctgatgatttatgcttccatcaacccagagaagttttttgaaagtgataaaggtgcaaagctgatgcagcttgcaggattatctgctgatgacatgattgtagtaaataatatgcgctgcttacgtggacctgatactaaaaagtcttcagttggggcctttactttgaaatttgatcttcagaagaaaaagcctggtatcagaaaggagcgggttggggaagagtcaacttggatgctatctcgattttatcccatcctggaggacttgattgagaaacttagtaagggtgagctaccgaaggatgagtaccactgcatgaatgaccctagtcctagtttccgtggaattccaggaagcacatctgctcgaacaagcccagctcatcagccagcccaatccatgagatctagacgaataggtggcacatgggctagacctcggaactctgatgatggttattcgagtgactctgtactgaagcatgcatcaagtgaccttagaaagttgggcccgcgcttatttatctttgtaattgggggtgctactcggtctgagttgcgtgttgcccacaagctgtcaagcaaactgaagagagaaattatccttggctcctctagtcttgatgacccaccgcagttcatcactaaattgaagatgttatcaaccgaggagctgtcgctggatgatttgcaaatataa

SEQ ID NO: 10804 - protein, 667 aa, Sorghum bicolor
  misc_feature: Ceres ANNOT ID no. 6116326
  misc_feature (42)..(652): Pfam Id: Sec1 Pfam Desc: Sec1 family
  misc_feature (1)..(667): NCBI GI: 75145061 NCBI Desc: probable protein transport sec1a
  misc_feature (1)..(667): NCBI GI: 38345989 NCBI Desc: osjnba0032b23.7 [oryza sativa (japonica cultivar-group)]
  misc_feature (4)..(667): NCBI GI: 28201820 NCBI Desc: snare-interacting protein keule
  misc_feature (1)..(667): NCBI GI: 92884645 NCBI Desc: sec1-like protein [medicago truncatula]
  misc_feature (114)..(650): NCBI GI: 115457438 NCBI Desc: os04g0252400 [oryza sativa (japonica cultivar-group)]
MSIDSDSSSQSGADYRSFRQITRDRLLVEMLRSTRKSSKSTWKVLIMDKLTVKIMSFSCKMADITEEGVSLVEDLYKRRQPLPSMDAIYFMQPTKENVRIFMSDMSGKNSLYKKAYVFFSSPVQRELVAHIKKDSTVLTRISALSEMNLEYFAIDSQGFITDHDKALEELFSEDAEGSHKYNACLNTMATRIATVFASLREFPRVHYRVARTIDASTLTTLRDLVPTKLAASVWNSLARYKSTIPEFPQTETCELLIVDRSIDQIAPIIHEWTYDAMCHDLLYMDGNKYVQEVPSKNGSANEKKEVLLEDHDPVWLELRHAHIADANERLYEKMTSFVSKNKAAQLQQARSGGELSTKQLQKMVQALPQYSDQIDKLTLHVEIAGKLNNIIKEQHLKDVGQLEQDLVFGDAGTKELISFLRTRMDVSRENKLRLLMIYASINPEKFFESDKGAKLMQLAGLSADDMIVVNNMRCLRGPDTKKSSVGAFTLKFDLQKKKPGIRKERVGEESTWMLSRFYPILEDLIEKLSKGELPKDEYHCMNDPSPSFRGIPGSTSARTSPAHQPAQSMRSRRIGGTWARPRNSDDGYSSDSVLKHASSDLRKLGPRLFIFVIGGATRSELRVAHKLSSKLKREIILGSSSLDDPPQFITKLKMLSTEELSLDDLQI

SEQ ID NO: 10805 - DNA, 1248 bp, Sorghum bicolor
  misc_feature: Ceres ANNOT ID no. 6116493
  misc_feature: Encodes the peptide sequence at SEQ ID NO 10806
atggtcgacctggccgcgcttacggacgacgtcctggcggagatcctcctccgggtgccgtctccgcgggacctcgggcgagcttctgcgtcgtgctgctccttccgtcgcgtcatctccgacccgcacttcctccgccggttcgtcgccctccacgcggcgcctccgctcggcgtcttctgctgctaccccgccttgggcggcggggttggtggatcccagttccacgcagccctgccgtcgcacccgtcgggggccctcgcccgcgcgctcgatacttcagcagacttctgcttcaacttcctcccgccggccaccagcgactggctcgtccgcgactgccgtgacggtcgttttctactcgaccgcgtccgggacggctccacggccttcaccgaagtcgcaatctgcgaccccctgttccggaggtaccggctgctcccgcccatccctaacgacctcgccgcttccgtggaaaacccctacgtccagcgtggcggcgatggtcaattgcagtcacgcagcagcgaaatcttcctggtttctcgtagtgatgacagtgtcagtgaggaggacacggcgttcaccgtcatctggatggcatgctgtcgagggaagctggtagcgttcttctactcctcagagtcacagcaatggtctgcactttcaccgcctgaacactacgctttgagcaccagaagagtcatgggcgttcgactaggacagcgcaaccatgctcatgggtgcttctactggatggtagctctcacacataggtggcttgtgttggacacacatagaatggagttctccatcgtggacatctcacctgtcctgacaggccgtgcaatgatgttcagtaatcagattaccactctggagtcaagcgatggccggactaccgttgtggtctctgatgttttccggccagatagaagatgcattctgtatttttatacattcttgtatttcagcgaccggtggcagcttctgaacaaaatcaccttgcctgaggaatgggggtatcgatttagaggcatcataggtgctgctgagggatacttatttataaagctagatgatcctaaggagaacctcaatgatcagattgagcgacatgttgaatatttttcgcttgatgtcaagacaatgcagcttgggagtttctgtcggacaaccctttttactgtgactgatgcctacctttattgtggtttccccccatcattgtcactgccttctatatga

SEQ ID NO: 10806 - protein, 415 aa, Sorghum bicolor
  misc_feature: Ceres ANNOT ID no. 6116493
  misc_feature (1)..(415): NCBI GI: 116308909 NCBI Desc: osigba0107a02.1 [oryza sativa (indica cultivar-group)]
  misc_feature (4)..(307): NCBI GI: 115481050 NCBI Desc: os10g0135300 [oryza sativa (japonica cultivar-group)]
  misc_feature (4)..(197): NCBI GI: 115462089 NCBI Desc: os05g0147700 [oryza sativa (japonica cultivar-group)]
  misc_feature (5)..(226): NCBI GI: 38347670 NCBI Desc: osjnba0054d14.5 [oryza sativa (japonica cultivar-group)]
  misc_feature (5)..(226): NCBI GI: 21742220 NCBI Desc: osjnba0087h01.6 [oryza sativa (japonica cultivar-group)]
MVDLAALTDDVLAEILLRVPSPRDLGRASASCCSFRRVISDPHFLRRFVALHAAPPLGVFCCYPALGGGVGGSQFHAALPSHPSGALARALDTSADFCFNFLPPATSDWLVRDCRDGRFLLDRVRDGSTAFTEVAICDPLFRRYRLLPPIPNDLAASVENPYVQRGGDGQLQSRSSEIFLVSRSDDSVSEEDTAFTVIWMACCRGKLVAFFYSSESQQWSALSPPEHYALSTRRVMGVRLGQRNHAHGCFYWMVALTHRWLVLDTHRMEFSIVDISPVLTGRAMMFSNQITTLESSDGRTTVVVSDVFRPDRRCILYFYTFLYFSDRWQLLNKITLPEEWGYRFRGIIGAAEGYLFIKLDDPKENLNDQIERHVEYFSLDVKTMQLGSFCRTTLFTVTDAYLYCGFPPSLSLPSI

SEQ ID NO: 10807 - DNA, 876 bp, Sorghum bicolor
  misc_feature: Ceres ANNOT ID no. 6116524
  misc_feature: Encodes the peptide sequence at SEQ ID NO 10808
atggtttctacatgtgatatggatgtgctttgcgacactagcactgatgataatgtggagttcagtcctgatggtttaccagatggatgggtgaaagaaacaatatttagaaagtgcaatgatggaatcagaaaagacccgtattatacagatcctgttagtcgccgtgtatttcgcacgcttaagtctgtattgagctaccttggaactggagaaatatctaagcattcctatttaccaaggagaaatgtcattgacatgtattcgtttgacaagtgtgcagatctgcctaaaagcatgctgaaaagactgaaagcagaaggacaaacaaagaaaaaattcatgagagcactggttctagacaaggaattatctaatgggcagacttcaaatcactctgaaggtgctattgggctaactcaatctgacccggaaggagataagtttggatctgtggaagcgacatgggaaaagggaatcagttcagagactatgaaacgacgaagagggaggccaaagaaaatcttgaagcaaacaaatgatagcatttcagatcgtgacaagggggagcacattgaggccaaagaggatgtagatatcagtggcgggaaagacttgaggaatgtgaagacttcggagcataccgagacgcagaatagcatgatgataatcaaggaagtaaacaacaacaacacagcagaaaataaactgtcaaagacagtgggagacaaatcggatttggtaaccggcatggctttgcacaaacaagagaatgtcagattaactgaagttagtgagaaggcaacattctccacagttcacaaattttacaagaggagaaattgcaaccagacactcggttcaagaaaaagataa

SEQ ID NO: 10808 - protein, 291 aa, Sorghum bicolor
  misc_feature: Ceres ANNOT ID no. 6116524
  misc_feature (1)..(285): NCBI GI: 57791232 NCBI Desc: methyl-binding domain protein mbd113 [zea mays]
  misc_feature (2)..(182): NCBI GI: 38344598 NCBI Desc: osjnba0072d08.3 [oryza sativa (japonica cultivar-group)]
  misc_feature (2)..(182): NCBI GI: 116309153 NCBI Desc: osigba0139i12.2 [oryza sativa (indica cultivar-group)]
  misc_feature (22)..(274): NCBI GI: 6691469 NCBI Desc: ahm2 [triticum aestivum]
  misc_feature (2)..(91): NCBI GI: 115457468 NCBI Desc: os04g0266400 [oryza sativa (japonica cultivar-group)]
MVSTCDMDVLCDTSTDDNVEFSPDGLPDGWVKETIFRKCNDGIRKDPYYTDPVSRRVFRTLKSVLSYLGTGEISKHSYLPRRNVIDMYSFDKCADLPKSMLKRLKAEGQTKKKFMRALVLDKELSNGQTSNHSEGAIGLTQSDPEGDKFGSVEATWEKGISSETMKRRRGRPKKILKQTNDSISDRDKGEHIEAKEDVDISGGKDLRNVKTSEHTETQNSMMIIKEVNNNNTAENKLSKTVGDKSDLVTGMALHKQENVRLTEVSEKATFSTVHKFYKRRNCNQTLGSRKR

SEQ ID NO: 10809 - DNA, 2181 bp, Sorghum bicolor
  misc_feature: Ceres ANNOT ID no. 6116634
  misc_feature: Encodes the peptide sequence at SEQ ID NO 10810
atggtgacaccaacctccaccaccccagtgtccaccgcttccgccgccgcgccggcgcccggctccggccgcggcggcgtcctccgccttctccgctattccgcttgctccctcctcccttcggctgccgcggccaggtcaggcgcgcggctgaccaccgcgctccgcgcaagaacccagccggcggagcccgagctggtggagcagtcggtgaacacgatccggttcctggccgtggacgccgtggagaaggcgcagtccgggcacccaggcctccccatgggctgcgcgccgctgggacacgtcctgttcgacgagttcctccgcttcaacccgaagaaccccgcctggttcgaccgcgaccgcttcgtgctctccgccggccatgggtgcatgctccagtacgcgctcctccacctcgctgggtacgatgcagtcaagatggatgatctaaaagctttccgacaatggagaagcagaactcctggtcacccagagaattttgaaacacctggtgttgaagtcaccaccggtcctctggggcagggttttgcaaatgctgttggattagcacttgctgagaaacatctagcttcacgtttcaacaagactgacatgaaaatcgtggaccattacacgtatgttatacttggggatggttgccaaatggaaggtgtttcgaatgaagcggcctctcttgctggtcactggggccttggaaaattgattgctttctatgatgacaaccacatatcaattgatggtaatacagatattgcatttactgaagatgtgcttgcacgatatgaggcactagggtggcatactatctgggtgaagaatggcaacactgggtatgatgacatacgtgctgcaataaaggaagcgaagggagttaaagacaagccaactctcatcaaggtgacaaccactattggttttggatctccgaacaaggccaacacatatagtgttcatggtactgctttaggttcaaaagaagtagaggcaactagaagcaatcttggctggcttcatgagcctttccatgttccagatgaggtgaagaggcactggagtcaccatattgatgatggtgcttcacttgaagctgaatggaatgccaggtttgtagaatatgacaagaaataccaccaggaggctgctgagttaaagagcataatttcaggggaattgccttcaggatgggacaatgctcttccaacctatgctcctgaaatctctcctgatgctactaggaacttatctcaacagtgcttgaatgcacttgccaaagtaatacctggatttcttggaggcagtgctgatcttgcaacatcaaatatgacattgcttaagatgtttggtgacttccagagggatactcctgaagagagaaacattcgttttggtgtgagagagcatgggatgggtgccatttccaatggtatcgctgttcatagccctggtctgataccttattgtgcaacattctttgtgttcactgactatatgagagcttccatccgcctgtcagccttaagcgaatctggagtgatcttcgtgatgactcatgactccattggccttggggaagatggtccaacccatcagcctgttgagcagttattcagcctccgagcaatgcctaacattttaatgcttcgtccagctgatggaaacgagacatcaggggcctataagattgcagttcttaataggaaaaggccctcaatcattgccctctcacggcagaagcttccacaggtgaaaggaacatcagttgatgctgtttctaaaggaggatatattatttctgataactcatcaggcaacaaacctgatttcattctcattggcactggttcagaacttgagattgcagaaaatgcagcaggtgagctgcggaataaggggagaaccgtacgagtggtttctctagtttgctgggaattatttgaagagcagcctgaggagtataaggaaagtgttctcccaaatgaggttacttctagaattagcattgaggcaggggtcacatttggatgggagaaatatattggacaaaaaggcaaagctattggtattgaccgttttggtgtaagcgctcctgcggggaaaatatatgaggaacttggtttgacagtggaaaacgtcattgcagcagccgaggccctataa

SEQ ID NO: 10810 - protein, 726 aa, Sorghum bicolor
  misc_feature: Ceres ANNOT ID no. 6116634
  misc_feature (66)..(400): Pfam Id: Transketolase_N Pfam Desc: Transketolase, thiamine diphosphate binding domain
  misc_feature (415)..(589): Pfam Id: Transket_pyr Pfam Desc: Transketolase, pyrimidine binding domain
  misc_feature (602)..(719): Pfam Id: Transketolase_C Pfam Desc: Transketolase, C-terminal domain
  misc_feature (11)..(726): NCBI GI: 116309154 NCBI Desc: osigba0139i12.3 [oryza sativa (indica cultivar-group)]
  misc_feature (11)..(726): NCBI GI: 38344602 NCBI Desc: osjnba0072d08.7 [oryza sativa (japonica cultivar-group)]
  misc_feature (60)..(726): NCBI GI: 115466224 NCBI Desc: os06g0133800 [oryza sativa (japonica cultivar-group)]
  misc_feature (39)..(724): NCBI GI: 3559814 NCBI Desc: transketolase 1 [capsicum annuum]
  misc_feature (38)..(724): NCBI GI: 2117700 NCBI Desc: transketolase (ec 2.2.1.1) precursor - potato (fragment)
  misc_feature (38)..(724): SWISSPROT Homolog: EC 2.2.1.1 Transketolase, chloroplast precursor
  misc_feature: Useful for making plants with modulated biomass
  misc_feature: Functional homolog of the protein sequence given in SEQ ID NO 13642
MVTPTSTTPVSTASAAAPAPGSGRGGVLRLLRYSACSLLPSAAAARSGARLTTALRARTQPAEPELVEQSVNTIRFLAVDAVEKAQSGHPGLPMGCAPLGHVLFDEFLRFNPKNPAWFDRDRFVLSAGHGCMLQYALLHLAGYDAVKMDDLKAFRQWRSRTPGHPENFETPGVEVTTGPLGQGFANAVGLALAEKHLASRFNKTDMKIVDHYTYVILGDGCQMEGVSNEAASLAGHWGLGKLIAFYDDNHISIDGNTDIAFTEDVLARYEALGWHTIWVKNGNTGYDDIRAAIKEAKGVKDKPTLIKVTTTIGFGSPNKANTYSVHGTALGSKEVEATRSNLGWLHEPFHVPDEVKRHWSHHIDDGASLEAEWNARFVEYDKKYHQEAAELKSIISGELPSGWDNALPTYAPEISPDATRNLSQQCLNALAKVIPGFLGGSADLATSNMTLLKMFGDFQRDTPEERNIRFGVREHGMGAISNGIAVHSPGLIPYCATFFVFTDYMRASIRLSALSESGVIFVMTHDSIGLGEDGPTHQPVEQLFSLRAMPNILMLRPADGNETSGAYKIAVLNRKRPSIIALSRQKLPQVKGTSVDAVSKGGYIISDNSSGNKPDFILIGTGSELEIAENAAGELRNKGRTVRVVSLVCWELFEEQPEEYKESVLPNEVTSRISIEAGVTFGWEKYIGQKGKAIGIDRFGVSAPAGKIYEELGLTVENVIAAAEAL

SEQ ID NO: 10811 - DNA, 1149 bp, Sorghum bicolor
  misc_feature: Ceres ANNOT ID no. 6116874
  misc_feature: Encodes the peptide sequence at SEQ ID NO 10812
atgggcactcaagtaataggggaacgaacgagtggtgaccttagtgtcatagttgtggatgaaaatctatgccatgccaacactacaagttgcatgcttgccaacctccaatttcaagtggttgtatatgtgagtcctgttgatgcactcaagtttcttaaggatcatgaaagagatactgattttgcattagtggaagtgaacatgaaagagatgcatggttttcagttccttgacagatccagggagttgcacaaaaaccttcaagtgatcatgatgtcagctgatacgacatggcccatgatgaagagaagcgtcgagcttggtgcacgttttttgatcaaaaagcctcttgatgcaaatacgatagataacctatggcaacatcttgacctaaaatttcaacggaccgacaagattaaggacttattcccaggtattgaaggaaaaatggggaatgcatttggggaaggtaccaaacacaaggcgagtcacctgatgtggactccatttctgcagaggaagtttttgcaagctgttgaattacttggggaagccgcaactccaaagaagatacaatttctcatgaatgtaaactccgttggtcgcaaacaaatttctgctcatcttcagaaacaccgaaagaagattgagaagcaactacataattcgaatggaaacaagtccagcaatggcgccccaaattcacaacctttaaggatttgtggaataggccataacacattccaatacattccggacatccaaccagaacataaatctgatgaagttgtgtccttggaatataaagaaatcattgaggaaacacaaagcaacatgttatatgaagcaatgcggagagccttgcagcttgggactattttcgaggaatcacagttgcccattgttccttctggtaaagatacaagaaaagttaatgtagacatgatgagggatggtaattatcgagatgctgggacatatgcatttggtgataaaaatgaagtatctgaaactcaaaatgcagatgataacgcgaaggtcatgagcaaggatgattctcacaagatggattcttgtggtgatgagctgcgaccagttgttacgcttgtgacctattcggactcagaagatggtgaaacgctatag

SEQ ID NO: 10812 - protein, 382 aa, Sorghum bicolor
  misc_feature: Ceres ANNOT ID no. 6116874
  misc_feature (14)..(128): Pfam Id: Response_reg Pfam Desc: Response regulator receiver domain
  misc_feature (17)..(377): NCBI GI: 38346503 NCBI Desc: osjnba0020i02.17 [oryza sativa (japonica cultivar-group)]
  misc_feature (4)..(143): NCBI GI: 38346502 NCBI Desc: osjnba0020i02.16 [oryza sativa (japonica cultivar-group)]
  misc_feature (17)..(166): NCBI GI: 115457846 NCBI Desc: os04g0348600 [oryza sativa (japonica cultivar-group)]
  misc_feature (6)..(143): NCBI GI: 109631196 NCBI Desc: srr384 [striga asiatica]
  misc_feature (2)..(142): NCBI GI: 33330870 NCBI Desc: type-b response regulator [catharanthus roseus]
  misc_feature: The sequence is a functional homolog of SEQ ID NO 152 in the 10/374,780US patent application
  misc_feature: The sequence is a functional homolog of SEQ ID NO 26 in the 10/225,068US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 26 in the 20050120408 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
MGTQVIGERTSGDLSVIVVDENLCHANTTSCMLANLQFQVVVYVSPVDALKFLKDHERDTDFALVEVNMKEMHGFQFLDRSRELHKNLQVIMMSADTTWPMMKRSVELGARFLIKKPLDANTIDNLWQHLDLKFQRTDKIKDLFPGIEGKMGNAFGEGTKHKASHLMWTPFLQRKFLQAVELLGEAATPKKIQFLMNVNSVGRKQISAHLQKHRKKIEKQLHNSNGNKSSNGAPNSQPLRICGIGHNTFQYIPDIQPEHKSDEVVSLEYKEIIEETQSNMLYEAMRRALQLGTIFEESQLPIVPSGKDTRKVNVDMMRDGNYRDAGTYAFGDKNEVSETQNADDNAKVMSKDDSHKMDSCGDELRPVVTLVTYSDSEDGETL

SEQ ID NO: 10813 - DNA, 348 bp, Sorghum bicolor
  misc_feature: Ceres ANNOT ID no. 6117087
  misc_feature: Encodes the peptide sequence at SEQ ID NO 10814
atgagcgacctgttaacctacatttccaaggttatgtgcatcaaggcaagatcggaggcaacacaggccggcgatgacggcggttgcccagcggatgagtgccgcgtctgcctgtcaaagattcggctcgccgaggctacccggcgtctgccatgtcggcatgttttccaccgggactgcgtcgaccgatggctcttgtcctgcaagcggacctgtccgctctgccgagtttatgtgaccgatgggaacaagcagccggtggcggcgaagcacaccagccgtgaagcacaggcactcgccgacgacctggtgatctggttctccaccgtgctcgtccccggtttctga

SEQ ID NO: 10814 - protein, 115 aa, Sorghum bicolor
  misc_feature: Ceres ANNOT ID no. 6117087
  misc_feature (34)..(75): Pfam Id: zf-C3HC4 Pfam Desc: Zinc finger, C3HC4 type (RING finger)
  misc_feature (34)..(98): NCBI GI: 115445307 NCBI Desc: os02g0248200 [oryza sativa (japonica cultivar-group)]
  misc_feature (3)..(99): NCBI GI: 53793050 NCBI Desc: ring finger-like [oryza sativa (japonica cultivar-group)]
  misc_feature (29)..(88): NCBI GI: 112253247 NCBI Desc: ring-finger domain protein [pfiesteria piscicida]
  misc_feature (11)..(83): NCBI GI: 108708054 NCBI Desc: zinc finger, c3hc4 type family protein [oryza sativa (japonica cultivar-group)]
  misc_feature (29)..(88): NCBI GI: 112253249 NCBI Desc: ring finger domain protein-like [pfiesteria piscicida]
  misc_feature: Useful for making plants with altered Lignin content
  misc_feature: Useful for making plants with altered cell wall content and/or composition
  misc_feature: Functional homolog of the protein sequence given in SEQ ID NO 13206
  misc_feature: Useful for making plants with altered cell wall content and/or composition
  misc_feature: Useful for making plants with altered lignin content
  misc_feature: Functional homolog of the protein sequence given in SEQ ID NO 13206
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
MSDLLTYISKVMCIKARSEATQAGDDGGCPADECRVCLSKIRLAEATRRLPCRHVFHRDCVDRWLLSCKRTCPLCRVYVTDGNKQPVAAKHTSREAQALADDLVIWFSTVLVPGF

SEQ ID NO: 10815 - DNA, 1182 bp, Sorghum bicolor
  misc_feature: Ceres ANNOT ID no. 6117385
  misc_feature: Encodes the peptide sequence at SEQ ID NO 10816
atgcctcccaaggccaagaaggacgccgcgccggctgagcgccccatcctcggccgcttctcctcccacctcaagatcgggatcgttgggttgccaaatgttggcaaatcaacttttttcaacatagtaacaaagttggcaatcccagctgagaatttccctttctgtaccatcgaaccaaatgaggcgcgtgtgaatgttccagatgaacggtttgattggctttgcaaactttacaagccaaagagtgaggtgcctgcatatctggaagtaactgacatagctgggcttattaggggtgctcacgctggggatggtctgggcaatgcattcctctcacatatacgtgctgttgatggaatctttcatgtcctaagagcatttgaagacccagaaattacacatgttgatgacacagtagatcctgttagagacatggaaactattagtgaagaactcagactaaaggatatagagttcatgaaaaagaaacttgaggaccttgataagtcaatgaagagaagtaatgataagcagctcaaagttgagcatgaattatgtgagagggtcgtagcccatcttgaggaagggaaagatgtccgtttaggagattggaaagctgctgacattgagatcttgaatactttccagctactttcagctaagccagttgtatatttggtgaatatgagtgagaaggacttccagagaaaaaagaacaagtttctacccaagatacatgcctgggtgcaggaacatggtggtgaaaccatacttcctttcagctgtgcttttgaacagaaactagtggatatgccagaagatgaagctgccaaatattgtgccgaaaaccagataacaagcatgatcccaaaaatcatcaagactggttttgcagcaattcatctgatatactttttcaccgctggtcctgatgaggtaaagtgttggcagatcagacgtcagactaaagctcctcaagctgctggtgcaattcacactgatttcgaaaggggctttatatgtgctgaggtaatgaagtttgaagatctgaaagaactgggaagtgaatctgctgttaaggctgctggaaaatacaagcaggaggggaaaacctatgtggttcaggacggggacatcatctttttcaaattcaacgtgtctggtggcgggaagaagtaa

SEQ ID NO: 10816 - protein, 393 aa, Sorghum bicolor
  misc_feature: Ceres ANNOT ID no. 6117385
  misc_feature (24)..(183): Pfam Id: MMR_HSR1 Pfam Desc: GTPase of unknown function
  misc_feature (1)..(393): NCBI GI: 115475219 NCBI Desc: os08g0199300 [oryza sativa (japonica cultivar-group)]
  misc_feature (1)..(393): NCBI GI: 7643796 NCBI Desc: gtp-binding protein [capsicum annuum]
  misc_feature (1)..(392): NCBI GI: 55243004 NCBI Desc: ensangp00000019083 [anopheles gambiae str. pest]
  misc_feature (1)..(392): NCBI GI: 108882448 NCBI Desc: gtp-binding protein [aedes aegypti]
  misc_feature (1)..(392): NCBI GI: 95102558 NCBI Desc: gtp binding protein [bombyx mori]
MPPKAKKDAAPAERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSHIRAVDGIFHVLRAFEDPEITHVDDTVDPVRDMETISEELRLKDIEFMKKKLEDLDKSMKRSNDKQLKVEHELCERVVAHLEEGKDVRLGDWKAADIEILNTFQLLSAKPVVYLVNMSEKDFQRKKNKFLPKIHAWVQEHGGETILPFSCAFEQKLVDMPEDEAAKYCAENQITSMIPKIIKTGFAAIHLIYFFTAGPDEVKCWQIRRQTKAPQAAGAIHTDFERGFICAEVMKFEDLKELGSESAVKAAGKYKQEGKTYVVQDGDIIFFKFNVSGGGKK

SEQ ID NO: 10817 - DNA, 399 bp, Sorghum bicolor
  misc_feature: Ceres ANNOT ID no. 6117402
  misc_feature: Encodes the peptide sequence at SEQ ID NO 10818
atggcggcctccatgatctcgtcgtcagctctggtggcgccgccgtccagggcgcagggcctgccgtccctcggccgccgcgcctcctccttcgccgtcgtctgcggcaccggcaagaagatcaagaccgacaagcccttcgggattggaggtggcctgaccgtcgataaggatgcctccgggaggaaggtcaagggcaagggcgtgtaccagttcgtcgacaagtacggcgctaacgtcgacggatacagcccaatctacaacgagaatgagtggtctcccagcggcaacgtctacgtcggtggaacgactgggcttctgatctgggccatcaccctcgctgggctcctcggcggcggcgccctcctcgtctacaacaccagcgccctctccggctaa

SEQ ID NO: 10818 - protein, 132 aa, Sorghum bicolor
  misc_feature: Ceres ANNOT ID no. 6117402
  misc_feature (36)..(132): Pfam Id: PsbR Pfam Desc: Photosystem II 10 kDa polypeptide PsbR
  misc_feature (1)..(132): NCBI GI: 83317160 NCBI Desc: ps ii 10 kda protein [phyllostachys pubescens]
  misc_feature (8)..(132): NCBI GI: 1835731 NCBI Desc: photosystem ii 10 kda polypeptide [oryza sativa]
  misc_feature (1)..(131): NCBI GI: 25989650 NCBI Desc: photosystem ii 10 kda protein [xerophyta humilis]
  misc_feature (1)..(131): NCBI GI: 112292665 NCBI Desc: chloroplast photosystem ii light-inducible protein [pachysandra terminalis]
  misc_feature (6)..(131): NCBI GI: 83776786 NCBI Desc: chloroplast photosystem ii 10 kda protein [arachis hypogaea]
MAASMISSSALVAPPSRAQGLPSLGRRASSFAVVCGTGKKIKTDKPFGIGGGLTVDKDASGRKVKGKGVYQFVDKYGANVDGYSPIYNENEWSPSGNVYVGGTTGLLIWAITLAGLLGGGALLVYNTSALSG

SEQ ID NO: 10819 - DNA, 441 bp, Sorghum bicolor
  misc_feature: Ceres ANNOT ID no. 6117409
  misc_feature: Encodes the peptide sequence at SEQ ID NO 10820
atggcattgtcatcagtgtttaggagaataaatgtgaaagatttgacctccaaggtttcagtctataccagtgctacagagttatctggtggactaaacatgatatttaggcgctgggccacaaaaaagactgctgggtcaacaaaaaatggccgtgattccaatccaaagtatttgggtgtaaagaagtttggtggagagaaagtgctaccaggaaacatcatcgtccgccaaagagggacccgcttccatcctggaaactatgttggcatgggcaaggaccatacacttttctgcctgaaagaaggccatgtccgctttgagcgcaacaagctctcaggcaggaaatgggttcatgttgatccagttgctggtcatgatcttcaccccatttatgcagatagttttgctactacagccgacactgagcctttgcaataa

SEQ ID NO: 10820 - protein, 146 aa, Sorghum bicolor
  misc_feature: Ceres ANNOT ID no. 6117409
  misc_feature (40)..(121): Pfam Id: Ribosomal_L27 Pfam Desc: Ribosomal L27 protein
  misc_feature (4)..(145): NCBI GI: 7671491 NCBI Desc: ribosomal protein l27-like [arabidopsis thaliana]
  misc_feature (4)..(137): NCBI GI: 18958058 NCBI Desc: at5g15220/f8m21_110 [arabidopsis thaliana]
  misc_feature (40)..(124): NCBI GI: 23011813 NCBI Desc: cog0211: ribosomal protein l27 [magnetospirillum magnetotacticum ms-1]
  misc_feature (40)..(123): NCBI GI: 29653733 NCBI Desc: ribosomal protein l27 [coxiella burnetii rsa 493]
  misc_feature (40)..(123): NCBI GI: 39931905 NCBI Desc: 50s ribosomal protein l27
  misc_feature: Useful for making plants with modulated biomass
  misc_feature: Functional homolog of the protein sequence given in SEQ ID NO 13646
MALSSVFRRINVKDLTSKVSVYTSATELSGGLNMIFRRWATKKTAGSTKNGRDSNPKYLGVKKFGGEKVLPGNIIVRQRGTRFHPGNYVGMGKDHTLFCLKEGHVRFERNKLSGRKWVHVDPVAGHDLHPIYADSFATTADTEPLQ

SEQ ID NO: 10821 - DNA, 870 bp, Sorghum bicolor
  misc_feature: Ceres ANNOT ID no. 6117413
  misc_feature: Encodes the peptide sequence at SEQ ID NO 10822
atgagctcgtcgatcagcatgatggaggcgagaatgcccccggggttcaggttccatcccagggacgacgagctcgtgctggactacctcctcgacaagctctccggccatggccatggcggcggcgcagccatcgtcgacgtcgacctcaacaagtgcgagccatgggaccttccagaatctgcgtgcgtcggtggaaaggagtggtacttcttcaacctgcgcgaccgcaagtacgcgacggggcagcgcaccaaccgcgccacgcgctccggctactggaaggccaccggcaaggaccgcgccgtcgtcgccggcggcgacggcggcgaggatgcggcggcggtggtggggatgcgcaagacgctggtgttctaccggggccgagcgcccaaggggaggaagacggagtgggtgatgcacgagttccgcctccatccacacgccgcgccgtcgctaccagctgcggcaacgaaggaggactgggtgctatgcagggtgttctacaagagcagaacaaccaccccaaggccagcatctgacgatgcccaggacggcaccccatcagctgagccacaactgtctgctgccctgccgcttgggccgctggctgacacatacactgccttcggtggtgccccaacggtttttgagcaggtgtcctgcttctccggtctgccagcactgccgttcaagagaccagtgagccttggggaccttctggcgttcgacacctctgagaaggaatccatcgggacagtgatgagcagtgtctcaaacaacagtagttcagtactggagctgactccaaattgcaactggaaccaggaaaatgacatgttacagatgtggaaccccctagggatatga

SEQ ID NO: 10822 - protein, 289 aa, Sorghum bicolor
  misc_feature: Ceres ANNOT ID no. 6117413
  misc_feature (12)..(146): Pfam Id: NAM Pfam Desc: No apical meristem (NAM) protein
  misc_feature (3)..(224): NCBI GI: 15148912 NCBI Desc: nac domain protein nac1 [phaseolus vulgaris]
  misc_feature (3)..(226): NCBI GI: 21554126 NCBI Desc: nac1 [arabidopsis thaliana]
  misc_feature (1)..(224): NCBI GI: 138753444 NCBI Desc: nac transcription factor [hordeum vulgare subsp. vulgare]
  misc_feature (2)..(224): NCBI GI: 34558777 NCBI Desc: salicylic acid-induced protein 19 [capsicum annuum]
  misc_feature (4)..(190): NCBI GI: 15795128 NCBI Desc: nam (no apical meristem) protein-like [arabidopsis thaliana]
  misc_feature: The sequence is a functional homolog of SEQ ID NO 2470 in the 10/374,780US patent application
  misc_feature: The sequence is a functional homolog of SEQ ID NO 798 in the 10/225,066US patent application
  misc_feature: Useful for making plants with altered Lignin content
  misc_feature: Useful for making plants with modulated growth and phenotype characteristics
  misc_feature: GREAT-hit functional homolog of the protein sequence given in SEQ ID NO 12985
  misc_feature: The sequence is a functional homolog of SEQ ID NO 798 in the 20050160493 US patent application
  misc_feature: Useful for making plants with altered lignin content
  misc_feature: Functional homolog of the protein sequence given in SEQ ID NO 12985
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MSSSISMMEARMPPGFRFHPRDDELVLDYLLDKLSGHGHGGGAAIVDVDLNKCEPWDLPESACVGGKEWYFFNLRDRKYATGQRTNRATRSGYWKATGKDRAVVAGGDGGEDAAAVVGMRKTLVFYRGRAPKGRKTEWVMHEFRLHPHAAPSLPAAATKEDWVLCRVFYKSRTTTPRPASDDAQDGTPSAEPQLSAALPLGPLADTYTAFGGAPTVFEQVSCFSGLPALPFKRPVSLGDLLAFDTSEKESIGTVMSSVSNNSSSVLELTPNCNWNQENDMLQMWNPLGI

SEQ ID NO: 10823 - DNA, 954 bp, Sorghum bicolor
  misc_feature: Ceres ANNOT ID no. 6117454
  misc_feature: Encodes the peptide sequence at SEQ ID NO 10824
atggccgccagcccgcctggtcgcctactcgcctggatggctggccgcgccgccgctcctcctgctcgaatggcaactggtagtgaagcctcgaagccagctgaggtgccagctgagactgtgcttgactggcataaacaggacaacaagaggatgctccacgcggtttaccgtgtcggggatctggaccgcacaatcaaatactacacggaatgctttgggatgaaactgctgaggaaaagggatattcctgaagagaagtacaccaacgccttccttggctttggaccagaggacaccaactttgcagttgaattgacttacaactatggcgttgacaagtatgacattggaacgggctttgggcattttgcaatcgctaatgaggatgtgtacaagttggctgagaatattaaatccaagggtggcaagatcacccgcgaacctggtcctgtcaagggaggatccactgttattgccttcgcacaggaccctgatggctacatgtttgagcttatccagagggctgagacacccgagcctctttgccaggtcatgcttcgtgttggtgaccttgagcgttctatcaagttttatgagaaggccctaggtttgaagctcctaaggaagaaggatgtacctgattacaagtataccattgccatgttgggctatgctgatgaggacaagacaactgttctggagttgacatacaactatggggtcacagaatacagcaagggcaatgcatatgctcaggttgccattggcaccaacgatgtgtacaagagtgctgaggcggttgagctggcgaccaaagaactaggtggcaagattttgcggcagccagggccgctacctgggatcaacactaagatagcctcttttgttgatccagatggctggaaagtggttctggttgacaacaccgacttcctcagggaactccactga

SEQ ID NO: 10824 - protein, 317 aa, Sorghum bicolor
  misc_feature: Ceres ANNOT ID no. 6117454
  misc_feature (51)..(172): Pfam Id: Glyoxalase Pfam Desc: Glyoxalase/Bleomycin resistance protein/Dioxygenase superfamily
  misc_feature (181)..(306): Pfam Id: Glyoxalase Pfam Desc: Glyoxalase/Bleomycin resistance protein/Dioxygenase superfamily
  misc_feature (24)..(316): NCBI GI: 37932483 NCBI Desc: glyoxalase i [zea mays]
  misc_feature (24)..(316): NCBI GI: 84029333 NCBI Desc: lactoylglutathione lyase (methylglyoxalase) (aldoketomutase) (glyoxalase i) (glx i) (ketone-aldehyde mutase) (s-d-lactoylglutathione methylglyoxal lyase) (allergen ory s ?)
  misc_feature (24)..(316): NCBI GI: 84029333 (continued) (allergen glb33) (pp33)
  misc_feature (24)..(316): NCBI GI: 119395226 NCBI Desc: glyoxalase [oryza sativa (japonica cultivar-group)]
  misc_feature (24)..(316): NCBI GI: 16580747 NCBI Desc: glyoxalase i [oryza sativa (japonica cultivar-group)]
  misc_feature (24)..(316): NCBI GI: 144924819 NCBI Desc: glyoxalase/bleomycin resistance protein/dioxygenase [medicago truncatula]
  misc_feature (24)..(316): SWISSPROT Homolog: EC 4.4.1.5 Lactoylglutathione lyase
  misc_feature: Useful for making plants with modulated nitrogen use efficiency
  misc_feature: GREAT-hit functional homolog of the protein sequence given in SEQ ID NO 13155
  misc_feature: Useful for making plants with modulated nitrogen use efficiency
  misc_feature: Functional homolog of the protein sequence given in SEQ ID NO 13155
MAASPPGRLLAWMAGRAAAPPARMATGSEASKPAEVPAETVLDWHKQDNKRMLHAVYRVGDLDRTIKYYTECFGMKLLRKRDIPEEKYTNAFLGFGPEDTNFAVELTYNYGVDKYDIGTGFGHFAIANEDVYKLAENIKSKGGKITREPGPVKGGSTVIAFAQDPDGYMFELIQRAETPEPLCQVMLRVGDLERSIKFYEKALGLKLLRKKDVPDYKYTIAMLGYADEDKTTVLELTYNYGVTEYSKGNAYAQVAIGTNDVYKSAEAVELATKELGGKILRQPGPLPGINTKIASFVDPDGWKVVLVDNTDFLRELH

SEQ ID NO: 10825 - DNA, 861 bp, Sorghum bicolor
  misc_feature: Ceres ANNOT ID no. 6117456
  misc_feature: Encodes the peptide sequence at SEQ ID NO 10826
atggcaactggtagtgaagccgtaaagccagctgaggctgtgcttgggtggcataaacaggacagcaagaggatgctccatgcggtttaccgtgtcggggatctggatcgcccgattaaaatgctttgggatgaagctgctgaggaaaagagatgtcctgatgagaagtacaccaacgccttccttggctttggaccagaggacaccaacttcgcacttgaattgacatacaactatggtgttgacaagtatgacattggagagggctttgggcatttcggaatcgctaatgaggatgtgtacaagttggccgaccatattaaatccaagggtggcaatatcactcgtgaacctggtcctgtcaagggaggatccactgttattgcctttgcacaggaccctgatggctacaggtttgcccttatccagagggctgagatacatgaccctctttgccaagtcatgcttcgtgttggtgatcttgagcgttctatcaagttctatgagaaggcccttgggatgaagctactaacgaagaaggatgtacctgattataagcataccattgccaaattgggttatgccgaagaggacaagacaactgctctggagttgatatacaactatggagtcacagaatatagcaagggcaatgcatatgctcagattgccattggcaccaacgatgtgtacaagagtgcagaggcagttgatttggcaaccaaagaactaggtggcaagattttgcggcagccaggacctctacctgggatcaacactaagatcgcctcttttgttgatccagatggctggaaagtggttctggttgaccatgctgacttcctcaaggaacttcagtga

SEQ ID NO: 10826 - protein, 286 aa, Sorghum bicolor
  misc_feature: Ceres ANNOT ID no. 6117456
  misc_feature (24)..(141): Pfam Id: Glyoxalase Pfam Desc: Glyoxalase/Bleomycin resistance protein/Dioxygenase superfamily
  misc_feature (150)..(275): Pfam Id: Glyoxalase Pfam Desc: Glyoxalase/Bleomycin resistance protein/Dioxygenase superfamily
  misc_feature (1)..(286): NCBI GI: 37932483 NCBI Desc: glyoxalase i [zea mays]
  misc_feature (1)..(286): NCBI GI: 84029333 NCBI Desc: lactoylglutathione lyase (methylglyoxalase) (aldoketomutase) (glyoxalase i) (glx i) (ketone-aldehyde mutase) (s-d-lactoylglutathione methylglyoxal lyase) (allergen ory s ?)
  misc_feature (1)..(286): NCBI GI: 84029333 (continued) (allergen glb33) (pp33)
  misc_feature (1)..(286): NCBI GI: 119395226 NCBI Desc: glyoxalase [oryza sativa (japonica cultivar-group)]
  misc_feature (1)..(286): NCBI GI: 16580747 NCBI Desc: glyoxalase i [oryza sativa (japonica cultivar-group)]
  misc_feature (11)..(286): NCBI GI: 92887944 NCBI Desc: glyoxalase/bleomycin resistance protein/dioxygenase [medicago truncatula]
  misc_feature (1)..(286): SWISSPROT Homolog: EC 4.4.1.5 Lactoylglutathione lyase
  misc_feature: Useful for making plants with modulated nitrogen use efficiency
  misc_feature: GREAT-hit functional homolog of the protein sequence given in SEQ ID NO 13155
  misc_feature: Useful for making plants with modulated nitrogen use efficiency
  misc_feature: Functional homolog of the protein sequence given in SEQ ID NO 13155
MATGSEAVKPAEAVLGWHKQDSKRMLHAVYRVGDLDRPIKMLWDEAAEEKRCPDEKYTNAFLGFGPEDTNFALELTYNYGVDKYDIGEGFGHFGIANEDVYKLADHIKSKGGNITREPGPVKGGSTVIAFAQDPDGYRFALIQRAEIHDPLCQVMLRVGDLERSIKFYEKALGMKLLTKKDVPDYKHTIAKLGYAEEDKTTALELIYNYGVTEYSKGNAYAQIAIGTNDVYKSAEAVDLATKELGGKILRQPGPLPGINTKIASFVDPDGWKVVLVDHADFLKELQ

SEQ ID NO: 10827 - DNA, 213 bp, Sorghum bicolor
  misc_feature: Ceres ANNOT ID no. 6117458
  misc_feature: Encodes the peptide sequence at SEQ ID NO 10828
atggaccctcagcagccggaacccgtcagctacctgtgcggagattgtggagctgagaacacgctgaagccgggagatgttatccagtgccgggagtgcggctaccgcatcctctacaagaagcggacccgccgaagtacggctacttttaccccttctctcttcaattcctatgcgacttgtctgaagtggttgcttgtgttttaccagtga

SEQ ID NO: 10828 - protein, 70 aa, Sorghum bicolor
  misc_feature: Ceres ANNOT ID no. 6117458
  misc_feature (11)..(42): Pfam Id: DNA_RNApol_7kD Pfam Desc: DNA directed RNA polymerase, 7 kDa subunit
  misc_feature (9)..(45): NCBI GI: 119358854 NCBI Desc: rpc10 rpc10 subunit of rna polymerases i, ii, and iii, probable (ic) [ostreococcus tauri]
  misc_feature (9)..(45): NCBI GI: 145342466 NCBI Desc: rpc10 subunit of rna polymerases i, ii, and iii, probable [ostreococcus lucimarinus cce9901]
  misc_feature (1)..(45): NCBI GI: 8248885 NCBI Desc: metallothionein-i gene transcription activator [mus sp.]
  misc_feature (1)..(45): NCBI GI: 4826924 NCBI Desc: dna directed rna polymerase ii polypeptide k [homo sapiens]
  misc_feature (1)..(45): NCBI GI: 119612204 NCBI Desc: polymerase (rna) ii (dna directed) polypeptide k, 7.0kda, isoform cra_a [homo sapiens]
  misc_feature (1)..(45): SWISSPROT Homolog: EC 2.7.7.6 DNA-directed RNA polymerases I, II, and III 7.0 kDa polypeptide
MDPQQPEPVSYLCGDCGAENTLKPGDVIQCRECGYRILYKKRTRRSTATFTPSLFNSYATCLKWLLVFYQ

SEQ ID NO: 10829 - DNA, 1860 bp, Sorghum bicolor
  misc_feature: Ceres ANNOT ID no. 6117460
  misc_feature: Encodes the peptide sequence at SEQ ID NO 10830
atggcgagcgcctgcgccacctccagtcccctcgtctcggcgccctctgcatgcccgtccaagaagaccgccgccaggttccggcggcgccgcacggtctcgtgcagggccaccggcggcgacaatgacggcctcctctggctgccccggcgggacgtgatgctcagcggcctgtccggtgtcgccgccgggctcgcctgttacccgggcctcgcggatgctgccgagtgcaccaggtccgacaaggtgaacgagaacaccgtgcagtgcacggacacggaaggggcgttgccgtgccctctggtatcaacgacggcccccgtggtggacttcacgccggagacgaaggtgacgcgcgtccggcagccggtgcatctcctgagccaggagtaccaggagaagtacaaggaggccacctcgaagatgaaggcgctgccggagtcgaacccgctgagcttcgcggcgcaggcggccatccaccaggcctactgcgacagctactacagctaccaccgctcgtcgtcgtccggcggctcgacgacggcggcggccaaggacgacccgacgttcgacgtccacttctcgtggatcttcgcgccgtggcaccgcatgtacatctacttctacgagcgcgccctcggcgacctcatcggcgacgacaccttcgcgctgccgttctggaactgggaccaccccgccggcatggtggtgccgccgctcttccgcgacgccggcgccgccggctccacggccagcaacccgctgtacgacgccaaccggaaccctgccaacctcgacgccctgatcgacctagactacctcaacgacaaggataacgagcccatccctttcagtggcccaaaggacgaagaatacaagaaacttgtcaacaagaacctgtgcacggtgtacacccagcaagtacgcaagggagcagagtcgttcctgggcgagaagtactgcaccgacctgggatcaagcacgagcagcatgggctcgctggagcggatggcgcacaccgccgtgcacgtctgggtcggcaaggcggggccgacgccggcgacggcgacttgcagcgaagcttccggcggcgtcccgaaccacagcaaaggcggcgtgtacagctgcaacaacgacatggggttcctgggcacggcggggcgggacccgctcttctactcgcaccacgccaacgtcgaccggatgtggcacctctggtccaccaggctcggcggcgggcagggcttcacggacacggactggctcgacgccagcttcgtcttctacgacgacgtcgagagcccccggaaggtccgggtcaagttccgcgacgtcctggacacgcgcgacctcgggtacacgtacgacgccgaggccgacaaggacctgccgtggctgcgccccaagatcacgtcgctggtgccccacggcacggatgacagcggcgcggcgaaggcggcggcggcgccggtgttcccgctcgcgctgaccaagggccaggtcgtggaggtgccggccgtggctgtgccggccagggaggccgggaaggagcagctgctggtgatcgacggcatcgagttcgacccgcaggcgaacaacaagttcgacgtcgccatcaacgtgcccgcggacaaggcgtcgcaggtggggccgcagtacaaggagtacgccgggagcttcgccgtcgtgccgggctccggcggcggcgggacgcggaaggggaaggtcaccctctgcatcaccgacgtgctgtacgacctcgacgctgaggacgacagctccgtcgacgtcgttatcgtgccgcgcacagatgccaaggtgaccatcaacgctcgccccaccatcaagaatcgaaactag

SEQ ID NO: 10830 - protein, 619 aa, Sorghum bicolor
  misc_feature: Ceres ANNOT ID no. 6117460
  misc_feature (95)..(465): Pfam Id: Tyrosinase Pfam Desc: Common central domain of tyrosinase
  misc_feature (1)..(618): NCBI GI: 2737882 NCBI Desc: polyphenol oxidase
  misc_feature (88)..(347): NCBI GI: 20978316 NCBI Desc: polyphenol oxidase [triticum aestivum]
  misc_feature (377)..(602): NCBI GI: 37359228 NCBI Desc: polyphenol oxidase [ananas comosus]
  misc_feature (31)..(347): NCBI GI: 1172584 NCBI Desc: polyphenol oxidase, chloroplast precursor (ppo) (catechol oxidase)
  misc_feature (7)..(351): NCBI GI: 7209776 NCBI Desc: polyphenol oxidase i [ipomoea batatas]
MASACATSSPLVSAPSACPSKKTAARFRRRRTVSCRATGGDNDGLLWLPRRDVMLSGLSGVAAGLACYPGLADAAECTRSDKVNENTVQCTDTEGALPCPLVSTTAPVVDFTPETKVTRVRQPVHLLSQEYQEKYKEATSKMKALPESNPLSFAAQAAIHQAYCDSYYSYHRSSSSGGSTTAAAKDDPTFDVHFSWIFAPWHRMYIYFYERALGDLIGDDTFALPFWNWDHPAGMVVPPLFRDAGAAGSTASNPLYDANRNPANLDALIDLDYLNDKDNEPIPFSGPKDEEYKKLVNKNLCTVYTQQVRKGAESFLGEKYCTDLGSSTSSMGSLERMAHTAVHVWVGKAGPTPATATCSEASGGVPNHSKGGVYSCNNDMGFLGTAGRDPLFYSHHANVDRMWHLWSTRLGGGQGFTDTDWLDASFVFYDDVESPRKVRVKFRDVLDTRDLGYTYDAEADKDLPWLRPKITSLVPHGTDDSGAAKAAAAPVFPLALTKGQVVEVPAVAVPAREAGKEQLLVIDGIEFDPQANNKFDVAINVPADKASQVGPQYKEYAGSFAVVPGSGGGGTRKGKVTLCITDVLYDLDAEDDSSVDVVIVPRTDAKVTINARPTIKNRN

SEQ ID NO: 10831 - DNA, 2991 bp, Sorghum bicolor
  misc_feature: Ceres ANNOT ID no. 6117473
  misc_feature: Encodes the peptide sequence at SEQ ID NO 10832
atgtataaagccgccaacgcccgcctcctcctcagatccctctcctccaactcagctgcgtcagcctccgtgcccgtcaacaacccgcgcctcgccgccgcatcctcctcctcctccgccgcccgcctcgcgctctcgctgccgtgcggcgcgtgggtcggccgcagcagcgggctcgtccgcgccgccggttggtccgggacccgaccgcgctttgccggcgccagggcgcagatcggcgccgccgccgtgcccgccgtcgagcggttccagcgcaggatggcaacccaagctactgagcatgccttcaaggatattctgaccagcctccctaagcctggaggtggtgaatatggaaagttctacagtcttcctgcactaaatgatccaaggattgataagctgccctactccatccgtattcttcttgagtcagctatccgtaactgtgataacttccaagttaccaagaatgatgttgagaaaataattgactgggaaaacacatctccaaagctggctgagataccattcaagccagcacgagttcttcttcaggacttcactggagttccagcagtcgttgatcttgcagctatgcgtgatgcgatggccaagttgggaagtgatgccaacaagatcaacccattggtcccggtggatcttgttattgatcactcagtgcaggtggatgtagcaaggtcgcagaacgccgtacaagcaaacatggaactcgaatttagtcgcaacaaggaaagatttggtttccttaaatggggttctagtgctttccaaaatatgctggttgtcccccctggttctggtattgttcaccaggtcaatcttgagtatcttggcagagttgttttcaacacagatggcattctctatcctgacagcgtagttggtactgactctcacaccactatgattgatggtttgggtgttgctggctggggggtcggtggtatagaagctgaggctacaatgcttggtcagccaatgagcatggttttgcctggtgtcgttggcttcaaattaactgggaagttacggagtggtgtcacggccactgatcttgttcttacagtgacacaaatgctaaggaaacatggtgttgtcggcaaatttgttgaattctacggtgaaggtatgggtaagctgtctttagctgacagggccacaattgcgaacatgtcaccggaatatggagctaccatgggcttctttcctgtggaccatgtgacattggattaccttaaactgacaggccggagtgatgaaacagtgtcaatgattgaagcatatctgagagccaacaaaatgtttgtggactacaatgagcctccaacagagagaatatactcatcttatcttgagctggaccttgatgaggtggagcctagcatgtctggaccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcacgggcagccggcagaaatgaagcatggtagtgttgttatagcagcaataactagctgcacaaacacctcaaatcctagtgttatgcttggtgctggtcttgtagctaagaaagcctgcgagttgggtcttgaggttaaaccatgggtgaagacaagccttgcccctggatcaggagttgtcacgaagtacttgcttcagagtggccttcaagaatacttgaaccagcaaggatttcatattgttggctatggctgtaccacttgcattggaaactctggtgatctcgatgaatctgtatcagctgccattacagaaaatgatgttgttgctgctgctgttttgtcgggtaaccgtaactttgagggtcgtgtgcaccctttaactcgggctaactatcttgcttcgccacctcttgttgttgcttatgcacttgctggaactgttgatattgattttgagaaagagcccattggacttggaaaggatggcaaggaagtctacttcagggatatatggccctcgacggaagaaattgcacaggttgtccaatccagtgtgctgcctgacatgttcaagggcacctatgaggctatcacaaaaggcaacccaatgtggaaccagttaactgtcccagaagcgtcactgtattcatgggattccaaatccacttacattcatgaacccccgtactttaaggacatgaccatgtccccacccggtccctctgcagtgaaagatgcatactgcttgctgaacttcggggacagcattactacagatcacatttcacctgcaggaagcatacacaaagacagtcctgctgccaagtatttgatggagcgtggtgtggaccggaaggacttcaactcttatggtagccgtcgtggtaatgatgaaataatggcgaggggaacatttgcaaacattaggatcgtgaacaagtttttgaatggagaagttggacccaagaccattcatgtccctactggggagaagctttacgtttttgatgcggccatgagatacaaatctgagggccatgctactataattctcgctggcgctgagtatggaagcggcagttctcgtgattgggctgccaagggtccgatgctcctgggagttaaagctgtgattgccaagagcttcgagcgtatccacagaagcaacttggtggggatgggaatcattcctctctgcttcaaagctggtgaggatgctgattcgcttggcctcactggacatgagcggtacagcatcgatctccctgccaacctcagtgagatccgtcccggccaggatgtgactgttattaccgacaatgggaaatctttcacttgcacccttcgctttgacactgaggtggagctggcgtacttcaaccatggaggcatcctcccctatgtcatccgcaacttggctggtgcgcagaactaa

SEQ ID NO: 10832 - protein, 996 aa, Sorghum bicolor
  misc_feature: Ceres ANNOT ID no. 6117473
  misc_feature (154)..(664): Pfam Id: Aconitase Pfam Desc: Aconitase family (aconitate hydratase)
  misc_feature (792)..(922): Pfam Id: Aconitase_C Pfam Desc: Aconitase C-terminal domain
  misc_feature (98)..(991): NCBI GI: 7437043 NCBI Desc: aconitate hydratase (ec 4.2.1.3) - cucurbit
  misc_feature (98)..(991): NCBI GI: 868003 NCBI Desc: aconitase [cucurbita cv. kurokawa amakuri]
  misc_feature (98)..(991): NCBI GI: 1351856 NCBI Desc: aconitate hydratase, cytoplasmic (citrate hydro-lyase) (aconitase)
  misc_feature (98)..(991): NCBI GI: 11066033 NCBI Desc: cytosolic aconitase [nicotiana tabacum]
  misc_feature (98)..(992): NCBI GI: 4586021 NCBI Desc: cytoplasmic aconitate hydratase [arabidopsis thaliana]
  misc_feature (15)..(992): SWISSPROT Homolog: EC 4.2.1.3 Aconitate hydratase 2, mitochondrial precursor
MYKAANARLLLRSLSSNSAASASVPVNNPRLAAASSSSSAARLALSLPCGAWVGRSSGLVRAAGWSGTRPRFAGARAQIGAAAVPAVERFQRRMATQATEHAFKDILTSLPKPGGGEYGKFYSLPALNDPRIDKLPYSIRILLESAIRNCDNFQVTKNDVEKIIDWENTSPKLAEIPFKPARVLLQDFTGVPAVVDLAAMRDAMAKLGSDANKINPLVPVDLVIDHSVQVDVARSQNAVQANMELEFSRNKERFGFLKWGSSAFQNMLVVPPGSGIVHQVNLEYLGRVVFNTDGILYPDSVVGTDSHTTMIDGLGVAGWGVGGIEAEATMLGQPMSMVLPGVVGFKLTGKLRSGVTATDLVLTVTQMLRKHGVVGKFVEFYGEGMGKLSLADRATIANMSPEYGATMGFFPVDHVTLDYLKLTGRSDETVSMIEAYLRANKMFVDYNEPPTERIYSSYLELDLDEVEPSMSGPKRPHDRVPLKEMKSDWHACLDNKVGFKGFAVPKEQQDKVVKFDFHGQPAEMKHGSVVIAAITSCTNTSNPSVMLGAGLVAKKACELGLEVKPWVKTSLAPGSGVVTKYLLQSGLQEYLNQQGFHIVGYGCTTCIGNSGDLDESVSAAITENDVVAAAVLSGNRNFEGRVHPLTRANYLASPPLVVAYALAGTVDIDFEKEPIGLGKDGKEVYFRDIWPSTEEIAQVVQSSVLPDMFKGTYEAITKGNPMWNQLTVPEASLYSWDSKSTYIHEPPYFKDMTMSPPGPSAVKDAYCLLNFGDSITTDHISPAGSIHKDSPAAKYLMERGVDRKDFNSYGSRRGNDEIMARGTFANIRIVNKFLNGEVGPKTIHVPTGEKLYVFDAAMRYKSEGHATIILAGAEYGSGSSRDWAAKGPMLLGVKAVIAKSFERIHRSNLVGMGIIPLCFKAGEDADSLGLTGHERYSIDLPANLSEIRPGQDVTVITDNGKSFTCTLRFDTEVELAYFNHGGILPYVIRNLAGAQN

SEQ ID NO: 10833 - DNA, 1068 bp, Sorghum bicolor
  misc_feature: Ceres ANNOT ID no. 6117537
  misc_feature: Encodes the peptide sequence at SEQ ID NO 10834
atgcttcttcctcgtaagcgtctcccatggcggcgcccggctctggatgcccaggccctggcaggccgcctcctgcgctcctcctcgtccctctccgaccccgacgacgaccctccgttcaggcggatccctaaacacccacctcgggctccatcgacgccgccgccgccgccgccgccgaagcccaaggccgtggcgggcaagatcaggcccgacgagcctgcgcactccgaccttcccttcgacttccggtactcgtactccgagacggacccggcgtggaggcccatcgggttccgcgagcccacccggttctcgcccttcggccccggccgcctcgaccgcccatgggacggcgcagccgcagcacgcgtcggcgaggatgctagtggcgacgagaggagccgggaggaggttctcggggaaccgctttcggaggaggaggtggcggcgcttgtggagaagtaccggcacagtgattgctcacggcagatcaatttggggaaaggtggggtaacgcacaatatgcttgatgacatccacaaccattggaaacgtgcagaagctgtaaggatcaaatgtctgggagtgccaacactcgacatggacaacatttgcttccatcttgaggataaaacaggtggcaaagtcatataccgcagcataaacatcattatcctgtaccgtggtcggaactatgaccccaaaagaaggcctggcataccattgatgttgtggaaaccattagctcctatctatcctaagcttgtgcaaaatgttgctgaagggctgactttcgaggaaacaaaagaattgaggaatagaggattaaattctccagcccttacaaaactgaccaggaatggtgtctatgttaatgttgttgataaagtgagagaagcatttaaaactgtggaagttgtccggctagattgcactcatgttgggactagtgactgcaagaaaattggtgtaaagctgagggatttggttccatgtattcccatattatttaaagatgaacaaattatactatggagagggaagtgcagttccagaccacaatga

SEQ ID NO: 10834 - protein, 355 aa, Sorghum bicolor
  misc_feature: Ceres ANNOT ID no. 6117537
  misc_feature (144)..(229): Pfam Id: CRS1_YhbY Pfam Desc: CRS1 / YhbY domain
  misc_feature (264)..(347): Pfam Id: CRS1_YhbY Pfam Desc: CRS1 / YhbY domain
  misc_feature (1)..(349): NCBI GI: 143955290 NCBI Desc: crs2-associated factor 2, mitochondrial precursor
  misc_feature (8)..(349): NCBI GI: 115475115 NCBI Desc: os08g0188000 [oryza sativa (japonica cultivar-group)]
  misc_feature (96)..(348): NCBI GI: 30349367 NCBI Desc: crs2-associated factor 1 [zea mays]
  misc_feature (40)..(349): NCBI GI: 30349369 NCBI Desc: crs2-associated factor 2 [zea mays]
  misc_feature (113)..(233): NCBI GI: 21741981 NCBI Desc: osjnba0060p14.12 [oryza sativa (japonica cultivar-group)]
MLLPRKRLPWRRPALDAQALAGRLLRSSSSLSDPDDDPPFRRIPKHPPRAPSTPPPPPPPKPKAVAGKIRPDEPAHSDLPFDFRYSYSETDPAWRPIGFREPTRFSPFGPGRLDRPWDGAAAARVGEDASGDERSREEVLGEPLSEEEVAALVEKYRHSDCSRQINLGKGGVTHNMLDDIHNHWKRAEAVRIKCLGVPTLDMDNICFHLEDKTGGKVIYRSINIIILYRGRNYDPKRRPGIPLMLWKPLAPIYPKLVQNVAEGLTFEETKELRNRGLNSPALTKLTRNGVYVNVVDKVREAFKTVEVVRLDCTHVGTSDCKKIGVKLRDLVPCIPILFKDEQIILWRGKCSSRPQ

SEQ ID NO: 10835 - DNA, 1230 bp, Sorghum bicolor
  misc_feature: Ceres ANNOT ID no. 6117539
  misc_feature: Encodes the peptide sequence at SEQ ID NO 10836
  misc_feature: Up-regulated in shoot tissues in response to salicylic acid treatment
atgataccttccgtgaggctctctcctggtcctgcagccttctcaggctccagcctacgctcaaaattaccgtcaattccatccatctctagtcttaaaccctccaaatatgtggtctcctcgctgaaaccactctacctagcaccgctagatggtccacgcactgcagagcttaagtctcggagacagccactcgagttccgttgcgctgcttctgctgccgatgacaaggagtcaaagactaaggcggtgccagttcagtcagaaggcgcgcagaggctaaagatttccatctatttcgcgacctggtgggcgcttaatgtgatatttaacatttataacaagaaggttctcaatgctttcccttacccttggctcacctccacactctccctcgcctgtggctctgcgatgatgcttttctcttgggccacccgccttgttgaggcccccaagactgatctagacttctggaaagtccttttcccggtcgctgtggcacatacaattggccatgttgctgcgacagtgagcatgtctaaggtggcagtgtcatttacacacataattaaaagcgcagaacctgcattcagtgttttggtgtcaagattcatccttggggagacgtttccagtcccagtctatctttctctccttcctatcattggtggttgtgctctagctgctgtcacagagctgaactttaatatggttggatttatgggtgccatgatatccaaccttgcattcgttttccgcaacatcttctcgaagaggggcatgaaggggaagtctgtcagtggcatgaattactatgcttgcctgtcaataatgtccctggtcatactgactccatttgctatagctatggaaggccctcaaatgtgggctgctggttggcaaaaggctcttgcagaagttggacccaatgttatctggtggattgctgcacaaagcgtgttctaccacttatataaccaggtgtcctacatgtctctcgatcagatttctccattgacgtttagcattggcaatacaatgaagcgtatatcagtgattgtttcatcgatcattatcttccacacacctgtacgccctgtcaatgcactgggagctgccattgccatccttggcacattcctgtactctcagagcgagacagtccagacttcagagcctgtgggcggtggggctccgtggctgctactgcagcaccgatgtcgcaactga

SEQ ID NO: 10836 - protein, 409 aa, Sorghum bicolor
  misc_feature: Ceres ANNOT ID no. 6117539
  misc_feature (239)..(384): Pfam Id: TPT Pfam Desc: Triose-phosphate Transporter family
  misc_feature (96)..(390): Pfam Id: UAA Pfam Desc: UAA transporter family
  misc_feature (1)..(386): NCBI GI: 2997589 NCBI Desc: glucose-6-phosphate/phosphate-translocator precursor [zea mays]
  misc_feature (1)..(386): NCBI GI: 40253818 NCBI Desc: glucose-6-phosphate/phosphate translocator [oryza sativa (japonica cultivar-group)]
  misc_feature (1)..(386): NCBI GI: 14150753 NCBI Desc: glucose-6-phosphate/phosphate translocator [oryza sativa]
  misc_feature (1)..(386): NCBI GI: 32401390 NCBI Desc: glucose-6-phosphate/phosphate translocator [triticum aestivum]
  misc_feature (27)..(386): NCBI GI: 2997591 NCBI Desc: glucose-6-phosphate/phosphate-translocator precursor [pisum sativum]
  misc_feature: Up-regulated in shoot tissues in response to salicylic acid treatment
  misc_feature: The sequence is a functional homolog of SEQ ID NO. 360 in the 11/188,298 US application
  misc_feature: The sequence is a functional homolog of SEQ ID NO. 484 in the 11/188,298 US application
MIPSVRLSPGPAAFSGSSLRSKLPSIPSISSLKPSKYVVSSLKPLYLAPLDGPRTAELKSRRQPLEFRCAASAADDKESKTKAVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFILGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVIWWIAAQSVFYHLYNQVSYMSLDQISPLTFSIGNTMKRISVIVSSIIIFHTPVRPVNALGAAIAILGTFLYSQSETVQTSEPVGGGAPWLLLQHRCRN

SEQ ID NO: 10837 - DNA, 1641 bp, Sorghum bicolor
  misc_feature: Ceres ANNOT ID no. 6117561
  misc_feature: Encodes the peptide sequence at SEQ ID NO 10838
atggcaactgaggcaaagatacagattcatcaagctcagcagattgaggacgtgcatcccaagttccactcctccctatggggtgacttcttccttcatcatgtcccatgccctccagtacaatatttgatgatgaaggataaggtcgaaataatgaaggaggaggtgaagaaaatgttactggatgttgattcttttgatttgtctgataaattagagtgtattgatacactagaacggcttggattggattatcactataccaaggagattgataaattaatgtgcaatatcttcaaagctagcgatcaagatcttgatcttcctacaacatcacatcttttctatttgcttaggaagcatggatatcatatttcttctgatgtatttttgaagttcagagatgacaaaggaaatattgtaacagatgatgcaagatgtttattattaatgtatgaagcggcacatcttagagtgaaaggggaagaaatacttgacaatattcttattttcaccaagagtcagcttcagtgtattgtagatgatctcgaaccacaattgaaagaggaagtgaaatatgcattggaaacaccacttttcagaaggctcaaaagagtacaaacgaggcaatatatctcaatatacgagaaaaatactgcacataataatatgctcctagagttttcaaagttagacttcaacattctgctaaccctatattgtgaggagctaaaagatcttacactatggtggacagagttccaaacacaggctaacacgtcaatctacgcacgagataggatggtggagatgcatttctggatgatgggagtattctttgagccccaatattcctattcacgaaagatgcttacgcaactatttatgattgtgtctatactcgatgacttgtatgacaatcattgcaccacagaagaaggcaatgtcttcactgcagcactagaaaggtgggatgaagaagcagtggagcaatgcccaacatacttgaggactttatatgtaaatatacttaccaccgtaaaagccatcgaggagtggttgaatcttcaaaacaacaaacatgcgaagttggtaaaaagactgataatcgacatggccaaatgctataatgctgagaccgaatggcgtgacaagaaatatgtgccagccacggttgatgagcatctaaaaatttcagcacgtagtagcggttgtatgcacttggtgagccagggattcatttcaatgggagatgtggcaactagcgaggctattaagtgggcttctacctatccgaaaatcattcaagctgtctgcattattgcacgcctcgctaatgatataatgtcatacaagcgagaagaaacatcacagaatatggtatctacagtgaaaacatgtgcaaaagaatatggtaccacagttgcacaagccatagaaaagcttagagagctgatcgaggaagcatggatggacatcaccgaagagtgcctgaggcagcaacaaccaaaggttcttctagagagggtggccaacctggctcgtacaatggattttctatacaaagatgtggatggatacactgattcacggagtattaaaggcatattggattcattgtatgtggatctaatcaactaa

SEQ ID NO: 10838 - protein, 546 aa, Sorghum bicolor
  misc_feature: Ceres ANNOT ID no. 6117561
  misc_feature (224)..(494): Pfam Id: Terpene_synth_C Pfam Desc: Terpene synthase family, metal binding domain
  misc_feature (27)..(219): Pfam Id: Terpene_synth Pfam Desc: Terpene synthase, N-terminal domain
  misc_feature (32)..(542): NCBI GI: 115474741 NCBI Desc: os08g0139700 [oryza sativa (japonica cultivar-group)]
  misc_feature (22)..(546): NCBI GI: 62754276 NCBI Desc: terpene synthase 10 [zea mays]
  misc_feature (22)..(546): NCBI GI: 62754278 NCBI Desc: terpene synthase 10 [zea mays]
  misc_feature (13)..(542): NCBI GI: 46358533 NCBI Desc: terpene synthase 6 [zea mays]
  misc_feature (13)..(545): NCBI GI: 46358529 NCBI Desc: terpene synthase 5 [zea mays]
MATEAKIQIHQAQQIEDVHPKFHSSLWGDFFLHHVPCPPVQYLMMKDKVEIMKEEVKKMLLDVDSFDLSDKLECIDTLERLGLDYHYTKEIDKLMCNIFKASDQDLDLPTTSHLFYLLRKHGYHISSDVFLKFRDDKGNIVTDDARCLLLMYEAAHLRVKGEEILDNILIFTKSQLQCIVDDLEPQLKEEVKYALETPLFRRLKRVQTRQYISIYEKNTAHNNMLLEFSKLDFNILLTLYCEELKDLTLWWTEFQTQANTSIYARDRMVEMHFWMMGVFFEPQYSYSRKMLTQLFMIVSILDDLYDNHCTTEEGNVFTAALERWDEEAVEQCPTYLRTLYVNILTTVKAIEEWLNLQNNKHAKLVKRLIIDMAKCYNAETEWRDKKYVPATVDEHLKISARSSGCMHLVSQGFISMGDVATSEAIKWASTYPKIIQAVCIIARLANDIMSYKREETSQNMVSTVKTCAKEYGTTVAQAIEKLRELIEEAWMDITEECLRQQQPKVLLERVANLARTMDFLYKDVDGYTDSRSIKGILDSLYVDLIN

SEQ ID NO: 10839 - DNA, 978 bp, Sorghum bicolor
  misc_feature: Ceres ANNOT ID no. 6117599
  misc_feature: Encodes the peptide sequence at SEQ ID NO 10840
atggaggcggcggcggagaggggcaccgtcgtcaccgcctgcgtgaccggcgcggggggcttcctggcgtcgtggctcgtcaagctcttgctctccaccggccgctacgccgtccgcggcaccgtgcgggatctcggtgatggcaagaatgcccatcttatgacactcgaagacgccggcgagaggttgcagttggtcaaggctgacatgctggactacggcagcgttgcgtccgcggtcgccggctgtgagggtgtcttccatgtcgcgagccctgtcccctccggtcaactctccaaccctgaggcagatgtcatagctcctgctgtaactggtacactgaatgtgttgaaagcttgccacgaggcaaaagtgaagagagttgttgtggtatcttcagtggctgctgtgttcaataatcctaactggcctaagggcgaggcctttaccgaggatagctggtcagatgcagagtattgcagaaaaaatgaggaatggtatttcctttctaaaacactggcagaacatgaggcttttgcttatgcagcaaaaactgggctagacattgtaactatttgcccatcattggtgattggacctttgttgcaacccacagtaaatgcaagtgttaaaatcttcctcggttatatcaaaggagatcaggagacagtcaataatggatccatgaatctagtggatgttcgtgatgtcgctgacgcccttctgttggcttacgaaaatcctcaggcatctggacggtacctctgctgttcaccagcaataagagtctctgatattgtaaacacactaaagacctcatatccaacacacacttatccccaaaaattcgttgaagtggaaggtagcaacacatatatcacggagaagcttcggaagctagggtggacctctaggcctatggaggaaaccctgcgggacagcgtcgattgctaccgagctttggggatcctgaactga

SEQ ID NO: 10840 - protein, 325 aa, Sorghum bicolor
  misc_feature: Ceres ANNOT ID no. 6117599
  misc_feature (13)..(257): Pfam Id: Epimerase Pfam Desc: NAD dependent epimerase/dehydratase family
  misc_feature (15)..(241): Pfam Id: NAD_binding_4 Pfam Desc: Male sterility protein
  misc_feature (14)..(284): Pfam Id: 3Beta_HSD Pfam Desc: 3-beta hydroxysteroid dehydrogenase/isomerase family
  misc_feature (11)..(159): Pfam Id: adh_short Pfam Desc: short chain dehydrogenase
  misc_feature (14)..(324): NCBI GI: 145337634 NCBI Desc: cinnamoyl-coa reductase [arabidopsis thaliana]
  misc_feature (1)..(324): NCBI GI: 9998901 NCBI Desc: cinnamoyl-coa reductase [populus balsamifera subsp. trichocarpa]
  misc_feature (1)..(324): NCBI GI: 40233135 NCBI Desc: cinnamoyl coa reductase [populus tomentosa]
  misc_feature (12)..(315): NCBI GI: 17978649 NCBI Desc: cinnamoyl-coa reductase [pinus taeda]
  misc_feature (1)..(324): NCBI GI: 2960364 NCBI Desc: cinnamoyl coa reductase [populus balsamifera subsp. trichocarpa]
  misc_feature: Useful for making plants with altered Lignin content
  misc_feature: Useful for making plants with altered cell wall content and/or composition
  misc_feature: Functional homolog of the protein sequence given in SEQ ID NO 13345
  misc_feature: Functional homolog of the protein sequence encoded by LOCUS at2g33600
  misc_feature: Useful for making plants with altered carbohydrate content
  misc_feature: Functional homolog of the protein sequence given in SEQ ID NO 13643
  misc_feature: Useful for making plants with altered cell wall content and/or composition
  misc_feature: Functional homolog of the protein sequence given in SEQ ID NO 13644
  misc_feature: Useful for making plants with altered lignin content
  misc_feature: Functional homolog of the protein sequence given in SEQ ID NO 13345
MEAAAERGTVVTACVTGAGGFLASWLVKLLLSTGRYAVRGTVRDLGDGKNAHLMTLEDAGERLQLVKADMLDYGSVASAVAGCEGVFHVASPVPSGQLSNPEADVIAPAVTGTLNVLKACHEAKVKRVVVVSSVAAVFNNPNWPKGEAFTEDSWSDAEYCRKNEEWYFLSKTLAEHEAFAYAAKTGLDIVTICPSLVIGPLLQPTVNASVKIFLGYIKGDQETVNNGSMNLVDVRDVADALLLAYENPQASGRYLCCSPAIRVSDIVNTLKTSYPTHTYPQKFVEVEGSNTYITEKLRKLGWTSRPMEETLRDSVDCYRALGILN

SEQ ID NO: 10841 - DNA, 762 bp, Sorghum bicolor
  misc_feature: Ceres ANNOT ID no. 6117600
  misc_feature: Encodes the peptide sequence at SEQ ID NO 10842
atggaaccatcctcacagcctcagccagtgatgggtgttgggtcacaaccttatcctgctgctgcttcctatgcagcacccacaatggtagctggagctcctgctgttcctcctggctcacagccagcagcacaattccccaatccagctcaactcagtgctcagcaccagatggtctaccagcaggctcagcaatttcaccatcaacttcagcaacagcagcaacagcagctcagggagttctggactacccagatggatgagattgaacaaacaactgacttcaagaaccacaccttgccacttgcaaggataaagaagataatgaaggctgatgaggacgtgcggatgatctctgcagaagctcctgttgtctttgcgaaggcatgcgaggtattcatattagagctgacattgaggtcatggatgcacacagaggagaacaagcgccggaccttgcagaagaacgacattgcagctgccatcaccaggactgacatatatgacttcctggtggacataatcccaagggatgaaatgaaagaggagggactcgggcttccaagagttggcctgccgcctgctatgggggccccagctgatcatagttcttatccatattactatgtgccagcacagcaggtgccaggagcaggtatgatgtatggtggccagcagggtcagccaatgacgtatatgtggcagaagccacaagtgccagaggaagaaccctccgaagagcagcagcagcagtctccctga

SEQ ID NO: 10842 - protein, 253 aa, Sorghum bicolor
  misc_feature: Ceres ANNOT ID no. 6117600
  misc_feature (98)..(162): Pfam Id: CBFD_NFYB_HMF Pfam Desc: Histone-like transcription factor (CBF/NF-Y) and archaealhistone
  misc_feature (92)..(165): Pfam Id: Histone Pfam Desc: Core histone H2A/H2B/H3/H4
  misc_feature (1)..(248): NCBI GI: 115444499 NCBI Desc: os02g0170500 [oryza sativa (japonica cultivar-group)]
  misc_feature (2)..(247): NCBI GI: 46250703 NCBI Desc: ccaat-box binding factor hap5 homolog [daucus carota]
  misc_feature (9)..(253): NCBI GI: 140047231 NCBI Desc: histone-fold/tfiid-taf/nf-y [medicago truncatula]
  misc_feature (23)..(247): NCBI GI: 46250701 NCBI Desc: ccaat-box binding factor hap5 homolog [daucus carota]
  misc_feature (11)..(253): NCBI GI: 87240537 NCBI Desc: at1g08970/f7g19_16 [medicago truncatula]
  misc_feature: The sequence is a functional homolog of SEQ ID NO 1105 in the 10/374,780US patent application
  misc_feature: The sequence is a functional homolog of SEQ ID NO 1106 in the 10/374,780US patent application
  misc_feature: The sequence is a functional homolog of SEQ ID NO 1107 in the 10/374,780US patent application
  misc_feature: The sequence is a functional homolog of SEQ ID NO 1108 in the 10/374,780US patent application
  misc_feature: The sequence is a functional homolog of SEQ ID NO 1109 in the 10/374,780US patent application
  misc_feature: The sequence is a functional homolog of SEQ ID NO 1110 in the 10/374,780US patent application
  misc_feature: The sequence is a functional homolog of SEQ ID NO 118 in the 10/412,699US patent application
  misc_feature: The sequence is a functional homolog of SEQ ID NO 1188 in the 10/412,699US patent application
  misc_feature: The sequence is a functional homolog of SEQ ID NO 1190 in the 10/412,699US patent application
  misc_feature: The sequence is a functional homolog of SEQ ID NO 188 in the 10/225,068US patent application
  misc_feature: The sequence is a functional homolog of SEQ ID NO 2256 in the 10/374,780US patent application
  misc_feature: The sequence is a functional homolog of SEQ ID NO 2732 in the 10/374,780US patent application
  misc_feature: The sequence is a functional homolog of SEQ ID NO 284 in the 11/479,226US patent application
  misc_feature: The sequence is a functional homolog of SEQ ID NO 2874 in the 10/374,780US patent application
  misc_feature: The sequence is a functional homolog of SEQ ID NO 42 in the 11/375,241US patent application
  misc_feature: The sequence is a functional homolog of SEQ ID NO 712 in the 11/479,226US patent application
  misc_feature: The sequence is a functional homolog of SEQ ID NO 772 in the 10/225,066US patent application
  misc_feature: The sequence is a functional homolog of SEQ ID NO 835 in the 10/374,780US patent application
  misc_feature: The sequence is a functional homolog of SEQ ID NO 837 in the 10/374,780US patent application
  misc_feature: The sequence is a functional homolog of SEQ ID NO 890 in the 11/435,388US patent application
  misc_feature: The sequence is a functional homolog of SEQ ID NO 910 in the 11/435,388US patent application
  misc_feature: The sequence is a functional homolog of SEQ ID NO 96 in the 10/374,780US patent application
  misc_feature: The sequence is a functional homolog of SEQ ID NO 98 in the 10/225,066US patent application
  misc_feature: The sequence is a functional homolog of SEQ ID NO 986 in the 10/225,066US patent application
  misc_feature: Useful for making plants with altered Lignin content
  misc_feature: Useful for making plants with altered terpenoid content
  misc_feature: Useful for making plants with modulated growth and phenotype characteristics
  misc_feature: Functional homolog of the protein sequence given in SEQ ID NO 13125
  misc_feature: The sequence is a functional homolog of SEQ ID NO 118 in the 20040045049 US patent application
  misc_feature: The sequence is a functional homolog of SEQ ID NO 118 in the 20040045049 US patent application
  misc_feature: The sequence is a functional homolog of SEQ ID NO 1188 in the 20040045049 US patent application
  misc_feature: The sequence is a functional homolog of SEQ ID NO 1190 in the 20040045049 US patent application
  misc_feature: The sequence is a functional homolog of SEQ ID NO 98 in the 20050160493 US patent application
  misc_feature: The sequence is a functional homolog of SEQ ID NO 986 in the 20050160493 US patent application
  misc_feature: The sequence is a functional homolog of SEQ ID NO 1105 in the 20060162006 US patent application
  misc_feature: The sequence is a functional homolog of SEQ ID NO 1106 in the 20060162006 US patent application
  misc_feature: The sequence is a functional homolog of SEQ ID NO 1107 in the 20060162006 US patent application
  misc_feature: The sequence is a functional homolog of SEQ ID NO 1108 in the 20060162006 US patent application
  misc_feature: The sequence is a functional homolog of SEQ ID NO 1109 in the 20060162006 US patent application
  misc_feature: The sequence is a functional homolog of SEQ ID NO 1110 in the 20060162006 US patent application
  misc_feature: The sequence is a functional homolog of SEQ ID NO 96 in the 20060162006 US patent application
  misc_feature: The sequence is a functional homolog of SEQ ID NO 712 in the 20070022495 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 13648
  misc_feature: The sequence is a functional homolog of SEQ ID NO 712 in the 11/479,226 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1109 in the 10/374,780 US patent application
  misc_feature: Useful for making plants with altered terpenoid content
  misc_feature: Functional homolog of the protein sequence given in SEQ ID NO 13125
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1108 in the 10/374,780 US patent application
  misc_feature: The sequence is a functional homolog of SEQ ID NO 1107 in the 10/374,780 US patent application
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: Useful for making plants with modulated cold sensitivity
  misc_feature: Functional homolog of the protein sequence given in SEQ ID NO 13649
  misc_feature: The sequence is a functional homolog of SEQ ID NO 122 in the 10/225,068 US patent application
  misc_feature: The sequence is a functional homolog of SEQ ID NO 1957 in the 11/479,226 US patent application
  misc_feature: The sequence is a functional homolog of SEQ ID NO 344 in the 10/374,780 US patent application
  misc_feature: The sequence is a functional homolog of SEQ ID NO 380 in the 10/225,066 US patent application
  misc_feature: The sequence is a functional homolog of SEQ ID NO 670 in the 11/435,388 US patent application
MEPSSQPQPVMGVGSQPYPAAASYAAPTMVAGAPAVPPGSQPAAQFPNPAQLSAQHQMVYQQAQQFHHQLQQQQQQQLREFWTTQMDEIEQTTDFKNHTLPLARIKKIMKADEDVRMISAEAPVVFAKACEVFILELTLRSWMHTEENKRRTLQKNDIAAAITRTDIYDFLVDIIPRDEMKEEGLGLPRVGLPPAMGAPADHSSYPYYYVPAQQVPGAGMMYGGQQGQPMTYMWQKPQVPEEEPSEEQQQQSP

SEQ ID NO: 10843 - DNA, 1284 bp, Sorghum bicolor
  misc_feature: Ceres ANNOT ID no. 6117612
  misc_feature: Encodes the peptide sequence at SEQ ID NO 10844
atggcagatcaccaggagatgatccatccaccggcggctgccactacaggcagcacgggtcacgggcacggcggcgattggtggaccacggcggtgtcgtgctcgccggatcagctatctgctgggtttggcgccgccggctggtcgtctgctgaaggcaacaacaagtcgaggtccggcaacgcggcggcctcctcggagtctcccgggtccaaccactcgctcgccaccggcggcagctccataaccttccaagacaacgcaggcgccgtcgccgatcacggcgtggtcgccgtgccgtcgcaccccgcggtgtctggtggtctcaccgccagctgctggaaccagccttcttactacttggatggatctgtagctggtaatttccatggctacatgagcccaagaagcgaccaggctcatcacgtaggtctgaggagcccatcatcgaatcacaacaacagcttgatgctacaggacgcccatgatcccaaccaacagttcctgtccaaccttgggctggagctgctctcgtcgccgacttcttcttccggcgggttccggacctcctcactgctcagaagcctcacggagccatcggcggcagcagccaagacttcctcgccgggcttcatgcagcagtaccaccagcagcagacgatgaaccaagtgccagctggaagcatcagggaggctctgcagttcagcaatagtacgccgttttggaacccttctgccggcagctttgcttcggcggcggagggggccacaagcttattaccaccgtcagggaaatctaggccggcaaattttggagtcaagagtgcattagacgaaggtgccggagactctagcaatatcattgcaaagaggacgaacaccgctccaacgccgccaccactcaagaaatcgagaacagggacaccatcaccattgcctaccttcaaggtgaggaaagagaagcttggtgacagaatcacagcacttcagcaactagtctccccttttggaaagacggatacggcatcggtgctccacgagaccatcgagtacatcaaattcctgcatgagcaagttggttctctcagtgctccttacctaaagaacaggcagcaagtgccccatcacaaggtcttgagggatggaggtgaggcggcggcggcaaacggagaactcaccggccgagggctgtgcctagtcccgatatcgagcaccttcgcggtggccagcgagacgcctctcgatttctggacaccgtttggaggccctgcagccttccggtag

SEQ ID NO: 10844 - protein, 427 aa, Sorghum bicolor
  misc_feature: Ceres ANNOT ID no. 6117612
  misc_feature (12)..(283): NCBI GI: 45735905 NCBI Desc: bhlh transcription factor (bhlh123)-like protein [oryza sativa (japonica cultivar-group)]
  misc_feature (1)..(421): NCBI GI: 90399269 NCBI Desc: h0105c05.9 [oryza sativa (indica cultivar-group)]
  misc_feature (26)..(422): NCBI GI: 53792455 NCBI Desc: bhlh transcription factor-like protein [oryza sativa (japonica cultivar-group)]
  misc_feature (154)..(422): NCBI GI: 21360529 NCBI Desc: at1g61660/t13m11_21 [arabidopsis thaliana]
  misc_feature (143)..(422): NCBI GI: 4508068
  misc_feature: The sequence is a functional homolog of SEQ ID NO 560 in the 10/666,642US patent application
  misc_feature: Useful for making plants with modulated growth and phenotype characteristics
  misc_feature: The sequence is a functional homolog of SEQ ID NO 560 in the 20070033671 US patent application
  misc_feature: Useful for making plants with altered lignin content
  misc_feature: Useful for making plants with modulated nitrogen use efficiency
  misc_feature: Functional homolog of the protein sequence given in SEQ ID NO 13645
  misc_feature: The sequence is a functional homolog of SEQ ID NO. 414 in the 11/188,298 US application
MADHQEMIHPPAAATTGSTGHGHGGDWWTTAVSCSPDQLSAGFGAAGWSSAEGNNKSRSGNAAASSESPGSNHSLATGGSSITFQDNAGAVADHGVVAVPSHPAVSGGLTASCWNQPSYYLDGSVAGNFHGYMSPRSDQAHHVGLRSPSSNHNNSLMLQDAHDPNQQFLSNLGLELLSSPTSSSGGFRTSSLLRSLTEPSAAAAKTSSPGFMQQYHQQQTMNQVPAGSIREALQFSNSTPFWNPSAGSFASAAEGATSLLPPSGKSRPANFGVKSALDEGAGDSSNIIAKRTNTAPTPPPLKKSRTGTPSPLPTFKVRKEKLGDRITALQQLVSPFGKTDTASVLHETIEYIKFLHEQVGSLSAPYLKNRQQVPHHKVLRDGGEAAAANGELTGRGLCLVPISSTFAVASETPLDFWTPFGGPAAFR

SEQ ID NO: 10845 - DNA, 1509 bp, Sorghum bicolor
  misc_feature: Ceres ANNOT ID no. 6117615
  misc_feature: Encodes the peptide sequence at SEQ ID NO 10846
atggaaggggaggcagagactgtcgttggttcgagttctaaaccatgtgggcagctggaggactactacattccagattacattctgaagccaggtgtcgaacaagtacttgttgatcatgcgccaccctgccccattgtagtgttcatcaactcaagatctggaggtcaacttggaagtagtttaatcaaaacataccgtgagcttctcaatgaagcacaggtttttgatctctcagaagagactccagataaggttttgcatcgtttgtatgccaatgttgaaaggctaaagatggaaggagacattcttgcagttcaaatttggaggaagctgaggttaattgttgcaggcggtgatggtacagctagctggctgcttggggtagtcagtgatcttaagctttcccacccacctccagttgcaactgtgcctctgggaaccggaaataacctccccttttcatttggatggggaaagaagaatccttctactgaccaagaggctgtaaaatctttccttggactagtgaagcatgcaagagaaattaagatcgatagttggcacatcatgttgaggatgcgagttccagaagaaggcccatgcgatcctattgctccattagagttgcctcattcattgcatgcgtttcatcgtgtctcaagtagtgactccctcaatatggaaggttaccacacattccgtggaggattttggaattactttagtatggggatggatgcagaagtgtcttatgcatttcattctgaaagaaagaggaatccagagaagttcaagaaccagctgacaaatcagggtcaatatgccaagcttggacttaaacaaggatggttttgtgcttctctaagtcagccatcatcaaagaaccttgctcaacttgcaaaagttaaggtcatgaaaagagctggtggcctctgggaggaacttcatgttcatcacagcattcggtccatcgtctgtctgaatctgcctagcttttctggaggtttgaatccttggggcacacctggcacgaggagagcagcagatagggagttcactccaccttttgtcgatgatggacttattgaggttgttggcttccgtgacgcctggcacgggctggtcctgctggccccaaatggacacggcactcgcattgcacaggcccataggatccggtttgagttccacaaaggcgcggcagagcacacgttcatgagggtcgacggagagccatggaagcagccccttccgaaggacgatgacacggtcgtcgtggagatctctcacctccggcaggtcaccatgctggcaaacgagccctgcaggtccaagagcgtcaacgatccatcatccccgtcgctggcccacgacagcagccatggcgatgacaaggatatggcggccgaggaggacgaagacgagtgggaggacggcaggaggaagtttggggccgcggatacgttcaagctccctgacgagattgacattgctcacctcagttga

SEQ ID NO: 10846 - protein, 502 aa, Sorghum bicolor
  misc_feature: Ceres ANNOT ID no. 6117615
  misc_feature (45)..(188): Pfam Id: DAGK_cat Pfam Desc: Diacylglycerol kinase catalytic domain
  misc_feature (240)..(413): Pfam Id: DAGK_acc Pfam Desc: Diacylglycerol kinase accessory domain
  misc_feature (1)..(502): NCBI GI: 115475067 NCBI Desc: os08g0178700 [oryza sativa (japonica cultivar-group)]
  misc_feature (1)..(502): NCBI GI: 38344795 NCBI Desc: osjnba0043l09.15 [oryza sativa (japonica cultivar-group)]
  misc_feature (1)..(502): NCBI GI: 78498844 NCBI Desc: diacylglycerol kinase 1 [oryza sativa (indica cultivar-group)]
  misc_feature (1)..(502): NCBI GI: 90265221 NCBI Desc: h0315f07.7 [oryza sativa (indica cultivar-group)]
  misc_feature (21)..(502): NCBI GI: 10798894 NCBI Desc: diacylglycerol kinase variant a [lycopersicon esculentum]
MEGEAETVVGSSSKPCGQLEDYYIPDYILKPGVEQVLVDHAPPCPIVVFINSRSGGQLGSSLIKTYRELLNEAQVFDLSEETPDKVLHRLYANVERLKMEGDILAVQIWRKLRLIVAGGDGTASWLLGVVSDLKLSHPPPVATVPLGTGNNLPFSFGWGKKNPSTDQEAVKSFLGLVKHAREIKIDSWHIMLRMRVPEEGPCDPIAPLELPHSLHAFHRVSSSDSLNMEGYHTFRGGFWNYFSMGMDAEVSYAFHSERKRNPEKFKNQLTNQGQYAKLGLKQGWFCASLSQPSSKNLAQLAKVKVMKRAGGLWEELHVHHSIRSIVCLNLPSFSGGLNPWGTPGTRRAADREFTPPFVDDGLIEVVGFRDAWHGLVLLAPNGHGTRIAQAHRIRFEFHKGAAEHTFMRVDGEPWKQPLPKDDDTVVVEISHLRQVTMLANEPCRSKSVNDPSSPSLAHDSSHGDDKDMAAEEDEDEWEDGRRKFGAADTFKLPDEIDIAHLS

SEQ ID NO: 10847 - DNA, 2955 bp, Sorghum bicolor
  misc_feature: Ceres ANNOT ID no. 6117620
  misc_feature: Encodes the peptide sequence at SEQ ID NO 10848
atggaagccggcggaggcggaggccagctcttctccgtggaccccttggagcgccaggccgcgcggggccacggcgtcgtcacctccatggctgccggaagcgacgtcatcgtcctcggcacctcccgcggctggctcgtccgccacgacttctcctttgaggacgcccacgatctcgacctcgggagcggccgctccggcgaccactccgtgcaccgggtgttcctggaccccggcggcaagcactgcgtcgccacggtggtccacccggggggcgtcgagacgtactaccaccacgcgaggtggccgcgacccaagccgctcccccgcctccggggcctcctcgtcaatgccgtcgcctggaaccgccagtccatcacggaagcgtcgaccaaggaggtgatcctgggcaccgagagcggccagatcttcgagatggccgtcgatgaggctgacaagagggagaagtatgtcaagccgctcttcgagctcactgagcaaagggagggcatcaaggacctgcagatggagactgctgtggttggaaattccacaagatactatgtcatggctgtcactccgacacggctctactcttttactggcattggttcactagaaactgtttttgctagttattccgatcgtgccatacacttcatggagctcccaggagaaatacctaatagaagggctaaacactttggatggctttctggatctggaatttatcatggtgaactgaattttggggcacaacacagctctactagtggagatgagaactttgtggagaataagggtttttttgactattcaaaattgggggattccggaattaaaccaaggtcatttgcattgtctgaattccattttttgcttctgattggggacaagattaaggtagtgaacagaataagtcagcagatggtggaggaacttgtagttgatgatacacctgaaacttcaagaggaataattggcctctgtagtgatccatctacaggacttttctatgcatatgatgaaagttctatattccaggtttccacttcagatgagggtcgtgacatgtggcaagtttacttggatatgaatcattatgctgctgctttagcccattgccgtaacccttaccagcgtgaccaagtctacctagttcaggctgattctgcatttgctgcaaaagagtattacatagcagcatccttctatgcaaagataaattacatcctgtcgtttgaggagatcagcctgaaatttatatcaataggtgagcaggatgctctcagaactttcttattgagaaggctcgataacctcaccaaagatgacaagatgcagattacgatgatctcaacttgggctactgagctatacttagacaagattaatcgcctcctgttggaggataccactgtcaccactacaaattcagtagcagaacctaatagctcggagtatcgttcgatagtaaatgaattccgtgcttttcttagtgacagcaaagatgtattagatgaagcaacaacaatgagactactggaaagttacggaagagtggatgaactagtgtactttgctggtttgaaggagcagtatgaaattgtggttcatcattacattcagcaaggagaagcaagaaaagcattggaagtgcttcaacggcgcaatgttcctgtagaccttgtgtataaatttgccccagatttgatcatgttagatgcttatgagactgttgaatcatggatgatggtgagaaacaagttgaatccagggaaactcataccagcaatgatgcgttatgtgagcgaaccacatgcgaagaatgaaacacacgaggttattaaatacttagagttttgtgtgaaagatttgaacaatgaggaccctggagtgcataatctgttgctatcactatatgccaagaaggaggatgaatcccagcttttgcaatttctcgacacaaaatttggtaaaggacaaacaaatggccctgacttcttttacgatcccaagtatgctctccgcctatgtcttcaagagaagagaatgcgtgcttgtgttcgtatttacagcatgatgtccatgcatgaggaagctgtggcacttgctttgaaggtggacttagaacttgctaaggcagaagctgacaaagtagaagatgatgaagagcttaggaagaagctgtggcttaaggttgctaagcatgtcattgagcaagagaaaggagtcaagagagagaatataaagaaagcaatagagttcctttctgagaccaataacttgttaaagattgaggatatcttaccatttttcccagacttcgtattgattgacgatttcaaggaggaaatatgcaaatctctcaaggactacaacagccagattgagcagctgaaacaggagatggacgatgccacacgtggggcagacaatatcagaagtgatattggtgccctcgctcagagatatacagtaattgatcgtgagcaggattgtggggtttgccggcgcaaaatattgactgttggagggttacaccaggtaggaagaagttatacatctgttggacacatggcccccttttatgtgtttccctgtggacatgccttccatgcaaattgcttgattggacatgtaactcgttgcagtaaccaggccgagagaatattggaccttcagaaacggcttagcttgatggacaggaaagcggcaaaagagaatggggcaagtgttaatggtgaatctattacgagcacaaccccagttgataagctgagatcacagttggatgatgctgtagcaagcgagtgccccttctgtggtgatctgatgatcaaggagatttcacagccgtttattctcccccaagagtcggatgaaaaggcatcatgggaaatcaaaccacaaccaacgcctcagaagattctcccgatgaccatgtctatatga

SEQ ID NO: 10848 - protein, 984 aa, Sorghum bicolor
  misc_feature: Ceres ANNOT ID no. 6117620
  misc_feature (248)..(395): Pfam Id: Pep3_Vps18 Pfam Desc: Pep3/Vps18/deep orange family
  misc_feature (7)..(971): NCBI GI: 15221363 NCBI Desc: pep3/vps18/deep orange family protein [arabidopsis thaliana]
  misc_feature (238)..(971): NCBI GI: 9502367 NCBI Desc: t12c24.2 [arabidopsis thaliana]
  misc_feature (222)..(783): NCBI GI: 8778633 NCBI Desc: f5o11.22 [arabidopsis thaliana]
  misc_feature (227)..(843): NCBI GI: 12641617 NCBI Desc: diga protein [emericella nidulans]
  misc_feature (10)..(843): NCBI GI: 119402134 NCBI Desc: vacuolar protein sorting protein diga [aspergillus clavatus nrrl 1]
MEAGGGGGQLFSVDPLERQAARGHGVVTSMAAGSDVIVLGTSRGWLVRHDFSFEDAHDLDLGSGRSGDHSVHRVFLDPGGKHCVATVVHPGGVETYYHHARWPRPKPLPRLRGLLVNAVAWNRQSITEASTKEVILGTESGQIFEMAVDEADKREKYVKPLFELTEQREGIKDLQMETAVVGNSTRYYVMAVTPTRLYSFTGIGSLETVFASYSDRAIHFMELPGEIPNRRAKHFGWLSGSGIYHGELNFGAQHSSTSGDENFVENKGFFDYSKLGDSGIKPRSFALSEFHFLLLIGDKIKVVNRISQQMVEELVVDDTPETSRGIIGLCSDPSTGLFYAYDESSIFQVSTSDEGRDMWQVYLDMNHYAAALAHCRNPYQRDQVYLVQADSAFAAKEYYIAASFYAKINYILSFEEISLKFISIGEQDALRTFLLRRLDNLTKDDKMQITMISTWATELYLDKINRLLLEDTTVTTTNSVAEPNSSEYRSIVNEFRAFLSDSKDVLDEATTMRLLESYGRVDELVYFAGLKEQYEIVVHHYIQQGEARKALEVLQRRNVPVDLVYKFAPDLIMLDAYETVESWMMVRNKLNPGKLIPAMMRYVSEPHAKNETHEVIKYLEFCVKDLNNEDPGVHNLLLSLYAKKEDESQLLQFLDTKFGKGQTNGPDFFYDPKYALRLCLQEKRMRACVRIYSMMSMHEEAVALALKVDLELAKAEADKVEDDEELRKKLWLKVAKHVIEQEKGVKRENIKKAIEFLSETNNLLKIEDILPFFPDFVLIDDFKEEICKSLKDYNSQIEQLKQEMDDATRGADNIRSDIGALAQRYTVIDREQDCGVCRRKILTVGGLHQVGRSYTSVGHMAPFYVFPCGHAFHANCLIGHVTRCSNQAERILDLQKRLSLMDRKAAKENGASVNGESITSTTPVDKLRSQLDDAVASECPFCGDLMIKEISQPFILPQESDEKASWEIKPQPTPQKILPMTMSI

SEQ ID NO: 10849 - DNA, 1032 bp, Sorghum bicolor
  misc_feature: Ceres ANNOT ID no. 6117636
  misc_feature: Encodes the peptide sequence at SEQ ID NO 10850
atggcgagtctaaccggcctcgccgcgaaccctaatccgaacaagtcattcgagatactgccgaacccgggtgactccgtctccagcctcagctttagtcccaagagtaatctgcttgtggcaacctcctgggataaccaggtgaggtgttgggagattgttggtggcaacagtcagccaaaggcatccatatcacatgaccagccggtcctctgctccgcttggaaagatgatggaactactgtcttctctggaggctgtgacaagcaggtcaaaatgtggcctctgctgtcaggtgggcagcctcagacagttgcgatgcatgacgcgcctgtcaaggaggtcgcctggattcctcagatgaatcttcttgtctctggaagctgggataagactttaaggtactgggatacaagacaagcaaatcctgtgcatatccagcaacttcctgagcgttgctatgctcttactgtgaattatccccttatgattgtgggaactgctgatcgtcatcttgttgtcttcaatttgcagaatcctcagacggagttcaagcgtatccaatcaccactaaaataccagacacggtgccttgctgcattccctgatcaacaggggtttctggtgggttcaatagaaggaagagttggtgttcatcatattgatgatgcacagcaaagcaagaacttcacattcaaatgtcacagggaaggaaatgatatattctctgtcaattcactcaacttccaccctgtccatcacacatttgcaactgctggatctgacggcgctttcaacttctgggataaggatagcaagcagaggctaaaggctttcagtagatgcccccttcccattccttgcagtaccttcaacagtgatggttccatatttgcttatgcggtttgctatgactggagccgtggggctgaaaatcacaaccctgcagctgcaaagacatctatctatctccacagtccacaggaaaccgaggtgaaaggaaagccacgcctcacgacaggcaggaagtga

SEQ ID NO: 10850 - protein, 343 aa, Sorghum bicolor
  misc_feature: Ceres ANNOT ID no. 6117636
  misc_feature (14)..(52): Pfam Id: WD40 Pfam Desc: WD domain, G-beta repeat
  misc_feature (57)..(95): Pfam Id: WD40 Pfam Desc: WD domain, G-beta repeat
  misc_feature (99)..(137): Pfam Id: WD40 Pfam Desc: WD domain, G-beta repeat
  misc_feature (1)..(338): NCBI GI: 55296031 NCBI Desc: mrna-associated protein mrnp41-like [oryza sativa (japonica cultivar-group)]
  misc_feature (8)..(343): NCBI GI: 109390024 NCBI Desc: rna export 1 [nicotiana benthamiana]
  misc_feature (9)..(208): NCBI GI: 6503278 NCBI Desc: f23a5.2(form1) [arabidopsis thaliana]
  misc_feature (3)..(337): NCBI GI: 119595929 NCBI Desc: rae1 rna export 1 homolog (s. pombe), isoform cra_a [homo sapiens]
  misc_feature (10)..(337): NCBI GI: 38570361 NCBI Desc: migration-inducing gene 14 [homo sapiens]
  misc_feature: The sequence is a functional homolog of SEQ ID NO. 502 in the 11/188,298 US application
MASLTGLAANPNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRHLVVFNLQNPQTEFKRIQSPLKYQTRCLAAFPDQQGFLVGSIEGRVGVHHIDDAQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQETEVKGKPRLTTGRK

SEQ ID NO: 10851 - DNA, 852 bp, Sorghum bicolor
  misc_feature: Ceres ANNOT ID no. 6117658
  misc_feature: Encodes the peptide sequence at SEQ ID NO 10852
atgaagagcaggaaggggtacgggcaccagggccacctgctgagcccggtgggcagcccgccgtcggacaacgagtccggtgccgtggcagcggcggccacggccggcggcggcggcgggtgcgggagcagcgtgggttactgcggcggtggcggcggcgagtcgccggccaaggagcaggaccggttcctccccatcgccaacgtgtcgcgcatcatgaagcgctccctccccgcgaacgccaagatctccaaggaggccaaggagacggtgcaggagtgcgtgtccgagttcatcagcttcgtcaccggcgaggcctccgacaagtgccagcgcgagaagcgcaagaccatcaacggcgacgacctgctctgggccatgaccacgctcggcttcgaggcctacgtctccccgctcaagtcctacctcaaccgctaccgcgaggccgagggcgagaaggccgccgtgctcggcggcgcccgccacggcgacggcgcggtggacgacggcccgctcgccgcgggcggcgccgttccgccgtccggggccgccggtggtgaccgcgcgggccacgacggcgccgccgacgctgacgcgcacgtcgggctcatgatgggaggggccagcagcgtcgtcgggttcggcgccggcggcggtgcggcagcgtcgtactacacggccacggcagcacggaaggcgtacggcgcgggggaagggtcgacgaaggtgatggagttcgaaggcatcgccggcgaggaggagaacggcggcggcagaggggagagggtttgccaacaaccatctccacggcgccgtgcaatggtgaaaagggcgcgcgtagctagggtgtag

SEQ ID NO: 10852 - protein, 283 aa, Sorghum bicolor
  misc_feature: Ceres ANNOT ID no. 6117658
  misc_feature (62)..(127): Pfam Id: CBFD_NFYB_HMF Pfam Desc: Histone-like transcription factor (CBF/NF-Y) and archaealhistone
  misc_feature (1)..(260): NCBI GI: 37542675 NCBI Desc: hap3-like transcriptional-activator [oryza sativa (indica cultivar-group)]
  misc_feature (1)..(260): NCBI GI: 116013394 NCBI Desc: heading date 5 [oryza sativa (indica cultivar-group)]
  misc_feature (1)..(260): NCBI GI: 115475021 NCBI Desc: os08g0174500 [oryza sativa (japonica cultivar-group)]
  misc_feature (31)..(194): NCBI GI: 22380 NCBI Desc: caat-box dna binding protein subunit b (nf-yb) [zea mays]
  misc_feature (31)..(194): NCBI GI: 115840 NCBI Desc: ccaat-binding transcription factor subunit a (cbf-a) (nf-y protein chain b) (nf-yb) (caat-box dna binding protein subunit b)
  misc_feature: The sequence is a functional homolog of SEQ ID NO 106 in the 10/666,642US patent application
  misc_feature: The sequence is a functional homolog of SEQ ID NO 116 in the 10/412,699US patent application
  misc_feature: The sequence is a functional homolog of SEQ ID NO 1164 in the 10/412,699US patent application
  misc_feature: The sequence is a functional homolog of SEQ ID NO 1166 in the 10/412,699US patent application
  misc_feature: The sequence is a functional homolog of SEQ ID NO 1168 in the 10/412,699US patent application
  misc_feature: The sequence is a functional homolog of SEQ ID NO 178 in the 10/412,699US patent application
  misc_feature: The sequence is a functional homolog of SEQ ID NO 1784 in the 10/412,699US patent application
  misc_feature: The sequence is a functional homolog of SEQ ID NO 2010 in the 10/374,780US patent application
  misc_feature: The sequence is a functional homolog of SEQ ID NO 2135 in the 10/666,642US patent application
  misc_feature: The sequence is a functional homolog of SEQ ID NO 2141 in the 10/666,642US patent application
  misc_feature: The sequence is a functional homolog of SEQ ID NO 2143 in the 10/666,642US patent application
  misc_feature: The sequence is a functional homolog of SEQ ID NO 2151 in the 10/666,642US patent application
  misc_feature: The sequence is a functional homolog of SEQ ID NO 2155 in the 10/666,642US patent application
  misc_feature: The sequence is a functional homolog of SEQ ID NO 28 in the 10/675,852US patent application
  misc_feature: The sequence is a functional homolog of SEQ ID NO 280 in the 11/479,226US patent application
  misc_feature: The sequence is a functional homolog of SEQ ID NO 29 in the 10/675,852US patent application
  misc_feature: The sequence is a functional homolog of SEQ ID NO 292 in the 11/435,388US patent application
  misc_feature: The sequence is a functional homolog of SEQ ID NO 294 in the 10/714,887US patent application
  misc_feature: The sequence is a functional homolog of SEQ ID NO 306 in the 11/435,388US patent application
  misc_feature: The sequence is a functional homolog of SEQ ID NO 308 in the 10/714,887US patent application
  misc_feature: The sequence is a functional homolog of SEQ ID NO 31 in the 10/675,852US patent application
  misc_feature: The sequence is a functional homolog of SEQ ID NO 310 in the 11/435,388US patent application
  misc_feature: The sequence is a functional homolog of SEQ ID NO 312 in the 10/714,887US patent application
  misc_feature: The sequence is a functional homolog of SEQ ID NO 32 in the 10/675,852US patent application
  misc_feature: The sequence is a functional homolog of SEQ ID NO 330 in the 11/435,388US patent application
  misc_feature: The sequence is a functional homolog of SEQ ID NO 332 in the 10/714,887US patent application
  misc_feature: The sequence is a functional homolog of SEQ ID NO 336 in the 11/435,388US patent application
  misc_feature: The sequence is a functional homolog of SEQ ID NO 338 in the 10/714,887US patent application
  misc_feature: The sequence is a functional homolog of SEQ ID NO 338 in the 11/435,388US patent application
  misc_feature: The sequence is a functional homolog of SEQ ID NO 34 in the 10/675,852US patent application
  misc_feature: The sequence is a functional homolog of SEQ ID NO 340 in the 10/714,887US patent application
  misc_feature: The sequence is a functional homolog of SEQ ID NO 364 in the 11/435,388US patent application
  misc_feature: The sequence is a functional homolog of SEQ ID NO 366 in the 10/714,887US patent application
  misc_feature: The sequence is a functional homolog of SEQ ID NO 368 in the 11/435,388US patent application
  misc_feature: The sequence is a functional homolog of SEQ ID NO 370 in the 10/714,887US patent application
  misc_feature: The sequence is a functional homolog of SEQ ID NO 389 in the 11/479,226US patent application
  misc_feature: The sequence is a functional homolog of SEQ ID NO 48 in the 10/675,852US patent application
  misc_feature: The sequence is a functional homolog of SEQ ID NO 6 in the 10/675,852US patent application
  misc_feature: The sequence is a functional homolog of SEQ ID NO 60 in the 10/675,852US patent application
  misc_feature: The sequence is a functional homolog of SEQ ID NO 62 in the 10/675,852US patent application
  misc_feature: The sequence is a functional homolog of SEQ ID NO 64 in the 10/675,852US patent application
  misc_feature: The sequence is a functional homolog of SEQ ID NO 66 in the 10/675,852US patent application
  misc_feature: The sequence is a functional homolog of SEQ ID NO 70 in the 10/675,852US patent application
  misc_feature: The sequence is a functional homolog of SEQ ID NO 719 in the 11/479,226US patent application
  misc_feature: The sequence is a functional homolog of SEQ ID NO 72 in the 10/675,852US patent application
  misc_feature: The sequence is a functional homolog of SEQ ID NO 76 in the 10/675,852US patent application
  misc_feature: The sequence is a functional homolog of SEQ ID NO 780 in the 10/374,780US patent application
  misc_feature: The sequence is a functional homolog of SEQ ID NO 782 in the 10/374,780US patent application
  misc_feature: The sequence is a functional homolog of SEQ ID NO 784 in the 10/374,780US patent application
  misc_feature: The sequence is a functional homolog of SEQ ID NO 787 in the 10/374,780US patent application
  misc_feature: The sequence is a functional homolog of SEQ ID NO 791 in the 10/374,780US patent application
  misc_feature: The sequence is a functional homolog of SEQ ID NO 792 in the 10/374,780US patent application
  misc_feature: The sequence is a functional homolog of SEQ ID NO 794 in the 10/374,780US patent application
  misc_feature: The sequence is a functional homolog of SEQ ID NO 796 in the 10/374,780US patent application
  misc_feature: The sequence is a functional homolog of SEQ ID NO 804 in the 10/374,780US patent application
  misc_feature: The sequence is a functional homolog of SEQ ID NO 807 in the 10/374,780US patent application
  misc_feature: The sequence is a functional homolog of SEQ ID NO 807 in the 10/666,642US patent application
  misc_feature: The sequence is a functional homolog of SEQ ID NO 809 in the 10/666,642US patent application
  misc_feature: The sequence is a functional homolog of SEQ ID NO 811 in the 10/666,642US patent application
  misc_feature: The sequence is a functional homolog of SEQ ID NO 88 in the 10/675,852US patent application
  misc_feature: The sequence is a functional homolog of SEQ ID NO 92 in the 10/675,852US patent application
  misc_feature: The sequence is a functional homolog of SEQ ID NO 94 in the 10/675,852US patent application
  misc_feature: Useful for making plants with modulated growth and phenotype characteristics
  misc_feature: The sequence is a functional homolog of SEQ ID NO 116 in the 20040045049 US patent application
  misc_feature: The sequence is a functional homolog of SEQ ID NO 116 in the 20040045049 US patent application
  misc_feature: The sequence is a functional homolog of SEQ ID NO 1164 in the 20040045049 US patent application
  misc_feature: The sequence is a functional homolog of SEQ ID NO 1166 in the 20040045049 US patent application
  misc_feature: The sequence is a functional homolog of SEQ ID NO 1168 in the 20040045049 US patent application
  misc_feature: The sequence is a functional homolog of SEQ ID NO 178 in the 20040045049 US patent application
  misc_feature: The sequence is a functional homolog of SEQ ID NO 1784 in the 20040045049 US patent application
  misc_feature: The sequence is a functional homolog of SEQ ID NO 28 in the 20050086718 US patent application
  misc_feature: The sequence is a functional homolog of SEQ ID NO 34 in the 20050086718 US patent application
  misc_feature: The sequence is a functional homolog of SEQ ID NO 48 in the 20050086718 US patent application
  misc_feature: The sequence is a functional homolog of SEQ ID NO 60 in the 20050086718 US patent application
  misc_feature: The sequence is a functional homolog of SEQ ID NO 62 in the 20050086718 US patent application
  misc_feature: The sequence is a functional homolog of SEQ ID NO 64 in the 20050086718 US patent application
  misc_feature: The sequence is a functional homolog of SEQ ID NO 66 in the 20050086718 US patent application
  misc_feature: The sequence is a functional homolog of SEQ ID NO 70 in the 20050086718 US patent application
  misc_feature: The sequence is a functional homolog of SEQ ID NO 72 in the 20050086718 US patent application
  misc_feature: The sequence is a functional homolog of SEQ ID NO 76 in the 20050086718 US patent application
  misc_feature: The sequence is a functional homolog of SEQ ID NO 92 in the 20050086718 US patent application
  misc_feature: The sequence is a functional homolog of SEQ ID NO 94 in the 20050086718 US patent application
  misc_feature: The sequence is a functional homolog of SEQ ID NO 787 in the 20060162006 US patent application
  misc_feature: The sequence is a functional homolog of SEQ ID NO 791 in the 20060162006 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 66 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 12 in the 10/675,852 US patent application
  misc_feature: The sequence is a functional homolog of SEQ ID NO 64 in the 10/675,852 US patent application
  misc_feature: The sequence is a functional homolog of SEQ ID NO 14 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 60 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 38 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 44 in the 10/675,852 US patent application
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 42 in the 10/675,852 US patent application
  misc_feature: The sequence is a functional homolog of SEQ ID NO 803 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO. 318 in the 11/188,298 US application
MKSRKGYGHQGHLLSPVGSPPSDNESGAVAAAATAGGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVSPLKSYLNRYREAEGEKAAVLGGARHGDGAVDDGPLAAGGAVPPSGAAGGDRAGHDGAADADAHVGLMMGGASSVVGFGAGGGAAASYYTATAARKAYGAGEGSTKVMEFEGIAGEEENGGGRGERVCQQPSPRRRAMVKRARVARV

SEQ ID NO: 10853 - DNA, 1044 bp, Sorghum bicolor
  misc_feature: Ceres ANNOT ID no. 6117673
  misc_feature: Encodes the peptide sequence at SEQ ID NO 10854
  misc_feature: Up-regulated in root tissues in response to salicylic acid treatment
atgggcagctatactaccagagtccacgccgtagagaaagcagctaacaaccaagatgatgagacgtgcatgcatgctttgatgctccttggcggattggccgtaccttgtaccatcaaggcggtcatcgagctcggcatcatggaccttctcctcgccgcggaccgcgccatgaccgcggaggagctcacggcaaggttgccatgtcctgctgctgctactgctgctgctatggtcgaccgcatgctccgcttcctagcttcgcacggcgtggtcaggtgcgccgccgccaccaaggagtcgtcggagctgggctccgatggtggcaagagctgccggcgctacgcggcggcgccggtgtgcaggtggtttacaaggagcggcggcgtggagtcggtggttccaatggggttgtggatgaccggcaagaccgtcttggagacctggtacaacataaaagaagcagtgttagagggagaaacaccatttgacagagcatacggccagccattttttgaataccttggtgaaaacgggacagtgaacacgttgttcgatgaggcaatggcgaaccattcgacaatcataacgaagaggctggtcgaggtcttccgtggctttgagaattacagtgtgctcgtcgatgtcggtggcaacaaaggcaccacgttgcaaatgattagaagtcagtatgagaatattagtggcatcaactacgaccttcctcgtgtaattgcgcagtggattcttcacgattggggcgacaaggactgcgtcaagatcctaaagaattgctatgcagctctcccggtgaacgggacgatgatcattctggagtacatcctcccagagacaccagaagaaacactaacatcgcaactagcgttcaacttcgatttcgggatgatgctcatgtacggcgccaaaggtaaggagagaacagagaaagagttgtcggagctcgccagagaggccggcttctctggagactgcacggctacatacatcttcgccagcatctgggcccttgaattcacaaagtaa

SEQ ID NO: 10854 - protein, 347 aa, Sorghum bicolor
  misc_feature: Ceres ANNOT ID no. 6117673
  misc_feature (103)..(323): Pfam Id: Methyltransf_2 Pfam Desc: O-methyltransferase
  misc_feature (37)..(87): Pfam Id: Dimerisation Pfam Desc: Dimerisation domain
  misc_feature (14)..(347): NCBI GI: 115487980 NCBI Desc: os12g0240900 [oryza sativa (japonica cultivar-group)]
  misc_feature (10)..(247): NCBI GI: 14578617 NCBI Desc: caffeic acid o-methyltransferase [festuca arundinacea]
  misc_feature (10)..(247): NCBI GI: 14578613 NCBI Desc: caffeic acid o-methyltransferase [festuca arundinacea]
  misc_feature (10)..(247): NCBI GI: 14578615 NCBI Desc: caffeic acid o-methyltransferase [festuca arundinacea]
  misc_feature (10)..(247): NCBI GI: 14578611 NCBI Desc: caffeic acid o-methyltransferase [festuca arundinacea]
  misc_feature: Useful for making plants with altered cell wall content and/or composition
  misc_feature: Functional homolog of the protein sequence encoded by LOCUS at5g54160
  misc_feature: Up-regulated in root tissues in response to salicylic acid treatment
  misc_feature: The sequence is a functional homolog of SEQ ID NO. 413 in the 11/188,298 US application
MGSYTTRVHAVEKAANNQDDETCMHALMLLGGLAVPCTIKAVIELGIMDLLLAADRAMTAEELTARLPCPAAATAAAMVDRMLRFLASHGVVRCAAATKESSELGSDGGKSCRRYAAAPVCRWFTRSGGVESVVPMGLWMTGKTVLETWYNIKEAVLEGETPFDRAYGQPFFEYLGENGTVNTLFDEAMANHSTIITKRLVEVFRGFENYSVLVDVGGNKGTTLQMIRSQYENISGINYDLPRVIAQWILHDWGDKDCVKILKNCYAALPVNGTMIILEYILPETPEETLTSQLAFNFDFGMMLMYGAKGKERTEKELSELAREAGFSGDCTATYIFASIWALEFTK

SEQ ID NO: 10855 - DNA, 1029 bp, Sorghum bicolor
  misc_feature: Ceres ANNOT ID no. 6117676
  misc_feature: Encodes the peptide sequence at SEQ ID NO 10856
atggccagctatactagtagtcacgccgtagggaaagcagggaaccaagatgatgagacgtgcatgcatgctatgaagctccttggcggattggccgtaccttttaccatcaaggcggtcatcaagctcggcatcatggaccgtctcctgaccgcggaacgcgccatgagcgcacaggagctcacggcagggttgccatgtcgtgctcctgctcctgctgctgctatggtagaccgcatgctccggttcctagcttcgcacggcgtggtcaggtgcgccgccaccgagtcggagttgggctccgatgatggcaagagctgccggcgctacgcagcggcaccggtgtgcaagtggtttgcaaggggcagcggcgtggagtcggtggttccaatgttgttctggatgacaagcaagaccgccatggagccctggtacaacataaaagatggagtgttagagggagaaacaccatttgacaaagcatacggcatgccattttttgagttccttggtgcaaacgggacaaagaacacgttgttcaatgaggcaatggcgagccattcgatgatcacaacaaagaggctactcgaggtcttccgtggctttgaaaattacaatgtgcttgtcgatgtcggcggcggcaaaggcaccacgatgcaaatgattagaagtcagtatgagaatattagtggcatcaactacgaccttcctcatgtaattgcacagtggattctccacgattggggcgacaaagactgcgtcaagatcctaaagaattgctatgcagctctcccggtgaacgggacgatgatcattctggagtacatcctcccggagacaccagaagaaacactagcagcgcaaatagcgtacgacctcgatctcgggatggtgctcatgttcggcgccagcggtaaggagagaacagagaaagagttgtcggagctcgccagagaggccggcttctctggagactgcacggctacatacatcttcgccaatgtctgggcccttgaattcacaaagtaa

SEQ ID NO: 10856 - protein, 342 aa, Sorghum bicolor
  misc_feature: Ceres ANNOT ID no. 6117676
  misc_feature (98)..(318): Pfam Id: Methyltransf_2 Pfam Desc: O-methyltransferase
  misc_feature (35)..(85): Pfam Id: Dimerisation Pfam Desc: Dimerisation domain
  misc_feature (8)..(342): NCBI GI: 115487980 NCBI Desc: os12g0240900 [oryza sativa (japonica cultivar-group)]
  misc_feature (7)..(242): NCBI GI: 4104224 NCBI Desc: caffeic acid o-methyltransferase; lpomt3 [lolium perenne]
  misc_feature (7)..(242): NCBI GI: 14578617 NCBI Desc: caffeic acid o-methyltransferase [festuca arundinacea]
  misc_feature (7)..(242): NCBI GI: 14578613 NCBI Desc: caffeic acid o-methyltransferase [festuca arundinacea]
  misc_feature (7)..(242): NCBI GI: 14578615 NCBI Desc: caffeic acid o-methyltransferase [festuca arundinacea]
  misc_feature: Useful for making plants with altered cell wall content and/or composition
  misc_feature: Functional homolog of the protein sequence encoded by LOCUS at5g54160
  misc_feature: The sequence is a functional homolog of SEQ ID NO. 413 in the 11/188,298 US application
MASYTSSHAVGKAGNQDDETCMHAMKLLGGLAVPFTIKAVIKLGIMDRLLTAERAMSAQELTAGLPCRAPAPAAAMVDRMLRFLASHGVVRCAATESELGSDDGKSCRRYAAAPVCKWFARGSGVESVVPMLFWMTSKTAMEPWYNIKDGVLEGETPFDKAYGMPFFEFLGANGTKNTLFNEAMASHSMITTKRLLEVFRGFENYNVLVDVGGGKGTTMQMIRSQYENISGINYDLPHVIAQWILHDWGDKDCVKILKNCYAALPVNGTMIILEYILPETPEETLAAQIAYDLDLGMVLMFGASGKERTEKELSELAREAGFSGDCTATYIFANVWALEFTK

SEQ ID NO: 10857 - DNA, 786 bp, Sorghum bicolor
  misc_feature: Ceres ANNOT ID no. 6117724
  misc_feature: Encodes the peptide sequence at SEQ ID NO 10858
atgccgcccgccgcggcgacgctcctccggcgggccccagcggtcccattcacggcacgccgtaccgctgtttcccgctcgggcatggcgcggcgtctggtgacagcgagcgctggggccggcgggcgggcgccggcgtacggtgggctgctgctcgacgccggcggcacgctgctgcaggtcgcgcagccggtcgccgagacgtacgcctccatcggccgacgctacggtgtgatgaagcctgagaaaagaatcatggaggggttcaagcgggcattctcggcgccatggcccaagacactcaggtaccagggagatgggcggccattctggagaattgtcgtggcagaagctaccgattgcaccgatgacgattactttgaggaagtgtatcagtattatgcacatggagatgcttggcgtttgcctgttggagcagacacagcactgcgtgagctgaaggatgctggagttaagctagctgttgtatctaactttgatacaaggttacggaaattacttaaggaccttaatgtctctgatatgtttgatgccattgtggtatcatcagaggtcggatatgagaaacctgctccagagatattcaagatagcattagataacattggtgtggaagccagcaaggcagtgcatgtaggagatgatgaagctgcagacaaggcgggtgccaatgctataggacttgaatgctggctgtggggtgatgatgtgaagacattttcagaaatacaggacaggattctgacaacagatgatcctcaatga

SEQ ID NO: 10858 - protein, 261 aa, Sorghum bicolor
  misc_feature: Ceres ANNOT ID no. 6117724
  misc_feature (47)..(243): Pfam Id: Hydrolase Pfam Desc: haloacid dehalogenase-like hydrolase
  misc_feature (46)..(258): NCBI GI: 50897254 NCBI Desc: at1g14310 [arabidopsis thaliana]
  misc_feature (50)..(254): NCBI GI: 92898439 NCBI Desc: haloacid dehalogenase/epoxide hydrolase [medicago truncatula]
  misc_feature (50)..(254): NCBI GI: 70927822 NCBI Desc: dt-related protein [oryza sativa (japonica cultivar-group)]
  misc_feature (50)..(254): NCBI GI: 86609760 NCBI Desc: haloacid dehalogenase, ia family protein [cyanobacteria bacterium yellowstone b-prime]
  misc_feature (50)..(254): NCBI GI: 86605887 NCBI Desc: haloacid dehalogenase, ia family protein [cyanobacteria bacterium yellowstone a-prime]
MPPAAATLLRRAPAVPFTARRTAVSRSGMARRLVTASAGAGGRAPAYGGLLLDAGGTLLQVAQPVAETYASIGRRYGVMKPEKRIMEGFKRAFSAPWPKTLRYQGDGRPFWRIVVAEATDCTDDDYFEEVYQYYAHGDAWRLPVGADTALRELKDAGVKLAVVSNFDTRLRKLLKDLNVSDMFDAIVVSSEVGYEKPAPEIFKIALDNIGVEASKAVHVGDDEAADKAGANAIGLECWLWGDDVKTFSEIQDRILTTDDPQ

SEQ ID NO: 10859 - DNA, 6369 bp, Sorghum bicolor
  misc_feature: Ceres ANNOT ID no. 6117725
  misc_feature: Encodes the peptide sequence at SEQ ID NO 10860
atgtctgcgaagtggcggtcactgcagcataggcaccggtacacctacacctcgattgtgttcccgaaacactaccatgatgccctagccgtcgtgccggctgaggtctcctcgtccgatttctttgtccgattgaacgacttgatttccctgacctccacttactcgcaagttgttgcggtcaaggatcttgcctcggcatatgtgcagtttctgtccactacagggattcctgatgatgcagtgctcgctgccacaaagctttatttggagatcctcttccttgagaactccctccctctccaccgcacgctcatatcggtgctcgccaagtgcaagaaattctccacagcgatcagtgggtgttttgccttgctctgtgaggagtatggtggctctggtagtaaggcaaagaagagatttatggtatctcgggcagccttgtcgcttattgggtacccaaagttgggatttttggatgaggcagtagagaggtgtgcagagatcatggcactggatgttgttgatgggcttgatggagtgactaatgacattgatgaagggtcacgaccatctcctgtcgtgatggagcagtgccaagaggccatgtcttgcatgtactacttgctgcagcggtacccgtctaagtttacgggccttgacaaggcatcaagtgtcttcaagagtgctgtcaggacaatactatctgttcttaagtcatctgccttttcaagggattgcctggtggcctctggagtgagcttctgtgctgcaattcaggttttcatgagctcagaggagatttcctggtttatttatcaaggtctatttgacatctgtgcaaatcacgaagatagaaaaaatcaatctgtgcacaatgtattttcagactttgatctgtgtgaacaaatcagagatctttcagttttgagtagactttgtttgctaagagggattttgacatctattccaaggacagtactcaacatgcgccaacttcattcaagtggacctttatggactattttgtatgatggaattttacctgagctttgcaagcattgtgagaacccagttgatagccacttcaatttccatgctcttacagtgacacaaatatgtttgcagcagataaagacatcgatttcatctgatttcactgacttctctggggactataagcctttttcaagagatgttgtcaaccgtatattaggaatcatatggcgcaacctggaagatcctttgagtcagacagtaaaacaggtgcatttgatctttgatctcctattagatattgaattgtgtattgcatcagaagaccatgaacataacaacaaattgttcctttgcaatattgcaaatgatttacttcgcctaggtccgcgatgcaaagggagatacgtccctttagcttctttgacaaagcgattgggtgccaaatctcttctaatattgaaatcatatctgctttcagaaacagcttatgcgtacatagatgatgatgtttgttgtgctgccacaacatttttaaaatccttcctggagactttaagaggtgaatgttggaatgatgatggtgttgagctaggatatgatgccttcagagatttgtgcttgcctcctttcatgcggggacttgtatctggaaattcaaaactacgttctaacttaaatacttatgctttacctgctctaattgaagttgatgcagagagcatattcacaatgcttggattcatctccattggtcctagcacaaaggaaactaaactagatgttgttttgaaaaatgaccagtgtatagctgcactggtttctctgcttaaggtctcacgaaatctggctcttgttgaaggggacattgatttggatcctgatgaattgtcacagcctcagcagatggatagtaagggtgctgctgttatatctattaaagggattaaggttacagttcctgttaattggtttgctttggcactgacacacagtgatgaaagtctccgtatagatgcagctgaatccctctttctaaatccaaagacatcaagtcttccatcctccttggaattgagcttgctcaaagaggctgttccattgaatatgcgttgtagctcaacggcatttcaaatgaaatggacaagtttatttcggaagttttttgctagggtgcgaactgcacttgacagacaggtaaagcaggggtcatggattccatcattaacgtctagtgttaaagcagctgactctattgatacttctgaggccacagttgtcaagagggctgaagatctcttccgattcatgaagtggctgagttcctttctgtttaattcttgttacccctctggcccttatgaaaggaaaacaattgcaatgaaacttattcttacactactagatgtatggcctatttgccgctctgaagggaaaattgatctttatccttacaatgacagcataatattgccagtttcaacaatttcatttgtagggtctataattgatagctgggacagattaagggaaaactcttttcgcattctactgcagttcccaacgccacttcctgggatttccttgagtacatccataaatgatgttatcagatgggcaaaaaaacttgttctaagcccacgagtccgagaaagtgatgctgaagttgtgactagtcaaaacccagttgcacagtatatctcttcactcattcaatggctctgtattgttgtcgaagagggcgagagggatctttctgaagcatgtaagaagagctttgttcatggagttcttcttactctgcgctacacatttgatgagatggattggaactctgaggtagtacaatcatgtatttctgaaatgaggtgcctggtagaaaagctacttcaactcataatgcgtgtaacttcggtagccctgtgggtggtttcttcagacgcattgtgtctgccatatgacatggatgacgtgattgatgatggttccctcctctcagatatacatgaggaggatcaacctgcttcagaaagagaggagaacacaaaaccagggagtaatggcaaaccagccgaacaagttgttatggttggttgctggcttgctatgaaggaggtcagtttactttttggaaccatcatcaggaagataccattgcctggctgttctcattcagcttcatctcagaatggtttgcctgacagtactgagacaagcatgtctgaagaaattcttgatgtggggcagttaaagatgatgggtgaccattttttacaggttcttcttaaaatgaagcataacggtgcaatagataaaacaagggctgggtttactgccctttgcaaccgtcttctttgctcaaatgattcaaggctgtgcaaaatgacagaatcatggatggtgctactaatggataggacaattgctaaaggtcaaactgtggatgatttgataaggaggagtgcaggaattccggcagcatttatcgccctgttcctggcagagccagaaggaacaccaaagaaactacttccaagggcattggaatggctgatagagtttgctaagaactctttagctaatttccagaaagactccaaccagaggtctggagtaatgaaagatggtcttggagagctattggaatcacaatcagaaactacaataagtgtacattctaacggtaacctatctaaaggccgagatgagggtgttgttcccaccgtgcatgtgttcaatgtgcttagagctgccttcaatgatgcaaatctggcaactgacacttcgggtttcagtgctgatgcaacaatggttgctatacgtgcgttttcatctccttactgggaagtgcgcaatgcagcttgccttgcgtatactgcgctagttcgtcgcatggttgggtttctgaatgtgcagaagcgtgaatcggcacgtcgatctttaacgggccttgaattcttccacaggtacccagcccttcatcctttcctttctagtgaactgcaaaccgcaactgaacaactagctgatggagtgtccagcaatttagagtcacacattacaaaagcaatacaccctagcctgtgtccaattcttattcttttatcaagacttaagccttcacctataagctgtggaactgatgattctttagacccttttttgcttttgcatttcattcaaagatgtgctacccagagtaactaccgggtccgtatccttgcatcaagggcattaactggtttggtatctaatgagagactgcagtatgttgttagtgatatactggatagtttacctcatggaaatcacaaagcaatggttcacagtgttcagcatagtgatgctgccgtatcagctaatatgggaaatggaaatgtactgctttctaagtcattcaattcaatccatggccttctgctgcagctggcttctcttctggataacaactttagatgtttgacagatggtagcacgaaggatcagattattggcctactactggaggttctctcaagatgttcttggcttggctgcacgaaattatgctcatgccctgtcgtaattacatcttacttgcgggtattggatctcatgcttgatgttgcaaggatagggaaaagcagacatactgaagtcattcaggcattgctgctagagttaagttctcagtgcttgagcaatacagtatcatcccagtacgcattccatgatccaactcgtattgaactaaaacaacaagcaactgaatcatttttgagctgtgttggtctttctaagaaaaacaatgaaactaacgatgaagatgtgcagttgcaaatacttggtgaaccaacctcagagatgcctagagaggactactcccttcatgaactacacaaggagattatgtcatgtctcactgatccttcatatgatgttagaattacagtgctgaagaggattctttggctcacaaaatcaatcagacatggtgatgcagaaaacattttgcaccagtgggcaggagttaatttgcagcctgctttaatggaacggttatttgtggaagaacaccctaagtgcctttattataatctgaagatcatcttttcatggaacatggaattcccattcaacaatggagaagattctagcacacttttgtccttgtgggacaggttagttcatttaaacagcacgatgtcacatgcaaaaaccagagaaatagttctatgttgcatgggtatgtgcatgaaactgttcactaaactatctaggggtggtgtttcaatggattgtcttaagaccagtgagatctctgcatcctttgtcagaatcaatgaagggaatagattatctgatgtcatgcttagagtaaacttgtttgtcactcttgtcaagaaccaaagtgaaccatcggaaagtgtgaatgctcgaagggctgctgctgaggcaattgttgcttctggtcttcttgaagaagcaaactacgttgcatcatctgtgtccaacatgtactctccagaatttgatgaaggccctatcaaagagaaatgcatggaagctagcgtttttgaatttatcagtctttatgcatgcaagatacttgacttatggtttgtatgtattcagttgctggaggatgaggatgcctatctgagacaaaaacttgcgaaggatattcagaaaataatcgctaagggttcagctaataccttctgtgatgattccacaccactacaagttgatagagtcattgaattaagcttggactatttaacttctttatttggccactggctgaaatacattgaattcttgttaagggtagtcttggacactggaaacgctctgaactcccgtggcgatttggtccgtcagatatttgataaagaaatagataaccaccatgaggagaagctattgatatgtcaaatctgctgttcgaatattcagaaacttttgcattcaaaatgtcagatggaagcaggagcaaaaactaaactgttcctgcaggattggagggagacctttttaaaccagctcacctcactgactggtgggtatcttgagaaagaggggaagaacaattggattggaggcataggtaaccacaaggacgtgttcatatcagtgtatgcagttctgctaggcttatatgcactcacgcaatctggctctctggaacaattggaggacaaccgtgcaatttatttgcaagaattttcaaaccttgaagggtttatcacaccattcctcaagaaccctttgatttctaatctttacggtcttgtaaaattatcacatgagaggttcagatcatcagataagccagaggaccaagtgggcaattcaggatcaagttttgacccatattttcttatcagatga

SEQ ID NO: 10860 - protein, 2122 aa, Sorghum bicolor
  misc_feature: Ceres ANNOT ID no. 6117725
  misc_feature (1)..(2122): NCBI GI: 115474983 NCBI Desc: os08g0169700 [oryza sativa (japonica cultivar-group)]
  misc_feature (1235)..(1432): NCBI GI: 34493758 NCBI Desc: death receptor interacting protein [homo sapiens]
  misc_feature (1235)..(1432): NCBI GI: 71891709 NCBI Desc: kiaa1767 protein [homo sapiens]
  misc_feature (1235)..(1394): NCBI GI: 34493762 NCBI Desc: death receptor interacting/3p fusion protein splice variant [homo sapiens]
  misc_feature (1235)..(1394): NCBI GI: 34493760 NCBI Desc: death receptor interacting/3p fusion protein [homo sapiens]
MSAKWRSLQHRHRYTYTSIVFPKHYHDALAVVPAEVSSSDFFVRLNDLISLTSTYSQVVAVKDLASAYVQFLSTTGIPDDAVLAATKLYLEILFLENSLPLHRTLISVLAKCKKFSTAISGCFALLCEEYGGSGSKAKKRFMVSRAALSLIGYPKLGFLDEAVERCAEIMALDVVDGLDGVTNDIDEGSRPSPVVMEQCQEAMSCMYYLLQRYPSKFTGLDKASSVFKSAVRTILSVLKSSAFSRDCLVASGVSFCAAIQVFMSSEEISWFIYQGLFDICANHEDRKNQSVHNVFSDFDLCEQIRDLSVLSRLCLLRGILTSIPRTVLNMRQLHSSGPLWTILYDGILPELCKHCENPVDSHFNFHALTVTQICLQQIKTSISSDFTDFSGDYKPFSRDVVNRILGIIWRNLEDPLSQTVKQVHLIFDLLLDIELCIASEDHEHNNKLFLCNIANDLLRLGPRCKGRYVPLASLTKRLGAKSLLILKSYLLSETAYAYIDDDVCCAATTFLKSFLETLRGECWNDDGVELGYDAFRDLCLPPFMRGLVSGNSKLRSNLNTYALPALIEVDAESIFTMLGFISIGPSTKETKLDVVLKNDQCIAALVSLLKVSRNLALVEGDIDLDPDELSQPQQMDSKGAAVISIKGIKVTVPVNWFALALTHSDESLRIDAAESLFLNPKTSSLPSSLELSLLKEAVPLNMRCSSTAFQMKWTSLFRKFFARVRTALDRQVKQGSWIPSLTSSVKAADSIDTSEATVVKRAEDLFRFMKWLSSFLFNSCYPSGPYERKTIAMKLILTLLDVWPICRSEGKIDLYPYNDSIILPVSTISFVGSIIDSWDRLRENSFRILLQFPTPLPGISLSTSINDVIRWAKKLVLSPRVRESDAEVVTSQNPVAQYISSLIQWLCIVVEEGERDLSEACKKSFVHGVLLTLRYTFDEMDWNSEVVQSCISEMRCLVEKLLQLIMRVTSVALWVVSSDALCLPYDMDDVIDDGSLLSDIHEEDQPASEREENTKPGSNGKPAEQVVMVGCWLAMKEVSLLFGTIIRKIPLPGCSHSASSQNGLPDSTETSMSEEILDVGQLKMMGDHFLQVLLKMKHNGAIDKTRAGFTALCNRLLCSNDSRLCKMTESWMVLLMDRTIAKGQTVDDLIRRSAGIPAAFIALFLAEPEGTPKKLLPRALEWLIEFAKNSLANFQKDSNQRSGVMKDGLGELLESQSETTISVHSNGNLSKGRDEGVVPTVHVFNVLRAAFNDANLATDTSGFSADATMVAIRAFSSPYWEVRNAACLAYTALVRRMVGFLNVQKRESARRSLTGLEFFHRYPALHPFLSSELQTATEQLADGVSSNLESHITKAIHPSLCPILILLSRLKPSPISCGTDDSLDPFLLLHFIQRCATQSNYRVRILASRALTGLVSNERLQYVVSDILDSLPHGNHKAMVHSVQHSDAAVSANMGNGNVLLSKSFNSIHGLLLQLASLLDNNFRCLTDGSTKDQIIGLLLEVLSRCSWLGCTKLCSCPVVITSYLRVLDLMLDVARIGKSRHTEVIQALLLELSSQCLSNTVSSQYAFHDPTRIELKQQATESFLSCVGLSKKNNETNDEDVQLQILGEPTSEMPREDYSLHELHKEIMSCLTDPSYDVRITVLKRILWLTKSIRHGDAENILHQWAGVNLQPALMERLFVEEHPKCLYYNLKIIFSWNMEFPFNNGEDSSTLLSLWDRLVHLNSTMSHAKTREIVLCCMGMCMKLFTKLSRGGVSMDCLKTSEISASFVRINEGNRLSDVMLRVNLFVTLVKNQSEPSESVNARRAAAEAIVASGLLEEANYVASSVSNMYSPEFDEGPIKEKCMEASVFEFISLYACKILDLWFVCIQLLEDEDAYLRQKLAKDIQKIIAKGSANTFCDDSTPLQVDRVIELSLDYLTSLFGHWLKYIEFLLRVVLDTGNALNSRGDLVRQIFDKEIDNHHEEKLLICQICCSNIQKLLHSKCQMEAGAKTKLFLQDWRETFLNQLTSLTGGYLEKEGKNNWIGGIGNHKDVFISVYAVLLGLYALTQSGSLEQLEDNRAIYLQEFSNLEGFITPFLKNPLISNLYGLVKLSHERFRSSDKPEDQVGNSGSSFDPYFLIR

SEQ ID NO: 10861 - DNA, 1599 bp, Sorghum bicolor
  misc_feature: Ceres ANNOT ID no. 6117728
  misc_feature: Encodes the peptide sequence at SEQ ID NO 10862
atggcgtctccttccagcaaggcagaggaggtgcgaaaggctactaccttccacccaagtctgtggggcaatttcttcctgacttaccagccgccaactgcacctcagcaagcatacatgaaagagcgagccgaggtattaagagagcgtgttaggaaggttttgaaggactcaactgaattaccagaaacattgaatcttatattaacactgcaacgacttggactggattaccactacgagaatgagatagaaaagttactgcaccatatttacaactctgattacaacgatgaagatcttaacttagtttcactgcggttttatcttcttcgaaagaatggttatgatgtgtcatcagatgtatttctaaacttcaaaacagaagaaggtggctttcgttatgatgacacgagaagcttgttaagcttatataatgcgtcatatttgaggaggcatgaagagaaggtactagatgaagcaatttctttcactagatgttgccttcaagatatccttgtacttccagaatcaccatttgcaaaggaggtgtcttcttcccttcatacccctcttttcagaagggttggaatattagaagcgagaaattacataccaatttatgaaaaagaggctacacggaatgaagacatattggagtttgcaaaattgaactttaaccttcaacagcttattttttgtgaagagttaaagcattgcacagtgtggtggaaggagttccaagccaaatcagagatgacttttgttagagatagaatagtagagatgtatttttggatgaatggagcatgctatgatccactatactctcgttcacgaattatactaacaaaggtcacaggtctcattgcaataattgatgatatgtttgacacatatggtaccacagaagagtgcctggaattcactgaagcacttggcagatgggatgaaagtgcagtacatctccttccagagtacatgaagggtttctacttattcctgttggagacatttcagtcatttgaggatgtgttagggccagagaagagctaccgtgtgatttatctaaaacagctatactgcaaggaaataaaatggcgtgatgaagattatgtgcccacaatgagtgaacaccttcaagtttcagaagaaagcattggatccatcgctctaacatgtgctgcatatgttggaatgggtgatataataacagaggagaccttcaagtggcttttgagctatcctcaatttctaacatcttttggtacatttgtacggctctccaatgatgttgtatcaaccaagcgtgagcaaacaaaagaccatagtgcctcgactgtccattgttacatgaagaagcatggaacaacaatgaatgatgcatgtgaaaagataaaagaacttaccgaagattcatggaaggatatgttagagcaatgccttgcactgaaagaattaccaaaggttgtgccacgaatagtgtttgacttttcaagaaccgcggataatatatacaaggatcttgatgcattgacttcttcagaagcactcaaagaaatgatacaactactactcgtggagccaatacccgaatga

SEQ ID NO: 10862 - protein, 532 aa, Sorghum bicolor
  misc_feature: Ceres ANNOT ID no. 6117728
  misc_feature (217)..(478): Pfam Id: Terpene_synth_C Pfam Desc: Terpene synthase family, metal binding domain
  misc_feature (22)..(212): Pfam Id: Terpene_synth Pfam Desc: Terpene synthase, N-terminal domain
  misc_feature (1)..(532): NCBI GI: 46358529 NCBI Desc: terpene synthase 5 [zea mays]
  misc_feature (1)..(532): NCBI GI: 46358523 NCBI Desc: terpene synthase 4 [zea mays]
  misc_feature (1)..(532): NCBI GI: 46358531 NCBI Desc: terpene synthase 5 [zea mays]
  misc_feature (1)..(532): NCBI GI: 46358525 NCBI Desc: terpene synthase 5 [zea mays]
  misc_feature (4)..(532): NCBI GI: 46358537 NCBI Desc: terpene synthase 9 [zea mays]
MASPSSKAEEVRKATTFHPSLWGNFFLTYQPPTAPQQAYMKERAEVLRERVRKVLKDSTELPETLNLILTLQRLGLDYHYENEIEKLLHHIYNSDYNDEDLNLVSLRFYLLRKNGYDVSSDVFLNFKTEEGGFRYDDTRSLLSLYNASYLRRHEEKVLDEAISFTRCCLQDILVLPESPFAKEVSSSLHTPLFRRVGILEARNYIPIYEKEATRNEDILEFAKLNFNLQQLIFCEELKHCTVWWKEFQAKSEMTFVRDRIVEMYFWMNGACYDPLYSRSRIILTKVTGLIAIIDDMFDTYGTTEECLEFTEALGRWDESAVHLLPEYMKGFYLFLLETFQSFEDVLGPEKSYRVIYLKQLYCKEIKWRDEDYVPTMSEHLQVSEESIGSIALTCAAYVGMGDIITEETFKWLLSYPQFLTSFGTFVRLSNDVVSTKREQTKDHSASTVHCYMKKHGTTMNDACEKIKELTEDSWKDMLEQCLALKELPKVVPRIVFDFSRTADNIYKDLDALTSSEALKEMIQLLLVEPIPE

SEQ ID NO: 10863 - DNA, 1653 bp, Sorghum bicolor
  misc_feature: Ceres ANNOT ID no. 6117742
  misc_feature: Encodes the peptide sequence at SEQ ID NO 10864
atgtcgctgacacctgcagtttgctccgtcaatgatgttcaggggctgcaaaaggatctgacgacctaccacccaagtctgtggggcaattttttcctgaaatacaagccgccaactgcaccaaagcgtggatacatgacagaaagggctgaagtgttgaaagaagaagttaggaaaatgctgaaggctgcaaatgaagtaaaaaatatattagaacttataatcacattacagaggcttggactggataatcactatgagaatgagatcaatggactgttgagctttgtttacaattcgggttacgatgacaaagatctgaatttagtctcactgagattttatcttctacgcaaacatggttattatgtttcatcagatgtctttacaagttttaaagacaaggaaggaaatttcgtggcagatgatacaaaatgtctcttgagcttatacaatgcagcataccttaggactcatggggagaaagtacttgatgaagccattatattcaccagacaccaacttgaagctttattagattctttggaatcaacgctagcagatgaagtatctgttacccttcaaacacctcttttccgaagagttagaatactggaaacaagaaactatatcccaatctatgaaaaggaagctgcacgaaatgaagtcatattagagttcgcaaaattgaatttcaaccttcttcagcttatttattgtgaggagttaaaaaaggtcacactatggtggaagcagcttaatgttgagacaaacttaagttttattcgagatagaattgttgaatgtcatttctggatgacaggagcatgctttgaaccacagtattctcttgcacgagttataagtacgaagatgacagcctgtatcacaatattagatgacataatggacacctacagtacaactgaggaggccatgctccttgctgaagcaatatacagatgggaagagaatgccgcagaactacttccagaatacatgaaggatttctatctatacctattgaagacaatcgattcatgtgacaatgaactaggaccaaacaaaagctttcggacattttatctcaaagaagtggcaagtcttttaaaggtgttggtccgaggaaactctcaagagataaaatggcgtaatgaaaattacgttccagaaacaatcaatgaacacttagaacattcaggacgatctgtgggagcctttcaagtagcatgttcttcatttgttgggatgggtgacaacataacaaaggaaattcttgagtggtttttgacatatccagaacttctcaagtctttcacgactattgcacgactatcgaatgatattgcatcaacaaagcgggagcaaaatgtggggcaccatgtttctacggtccaatgttatatgttgaagcatgggacaacaatggatgatgcatatgagaagataaaagagttaatagaagacacatggaaggatatgatggaactctaccttacaccaacagaacaaccaaaactcgtcacacaaacagtcgttgattttgcaaggacagcggactacatgtacaagaaaacagatgcattcactttttcccacacactcaaagatatgatagcaaaactctttgtggagccaatattattattctag

SEQ ID NO: 10864 - protein, 550 aa, Sorghum bicolor
  misc_feature: Ceres ANNOT ID no. 6117742
  misc_feature (223)..(495): Pfam Id: Terpene_synth_C Pfam Desc: Terpene synthase family, metal binding domain
  misc_feature (28)..(218): Pfam Id: Terpene_synth Pfam Desc: Terpene synthase, N-terminal domain
  misc_feature (19)..(550): NCBI GI: 62754276 NCBI Desc: terpene synthase 10 [zea mays]
  misc_feature (19)..(550): NCBI GI: 62754278 NCBI Desc: terpene synthase 10 [zea mays]
  misc_feature (14)..(549): NCBI GI: 46358533 NCBI Desc: terpene synthase 6 [zea mays]
  misc_feature (16)..(547): NCBI GI: 46358529 NCBI Desc: terpene synthase 5 [zea mays]
  misc_feature (16)..(547): NCBI GI: 46358523 NCBI Desc: terpene synthase 4 [zea mays]
MSLTPAVCSVNDVQGLQKDLTTYHPSLWGNFFLKYKPPTAPKRGYMTERAEVLKEEVRKMLKAANEVKNILELIITLQRLGLDNHYENEINGLLSFVYNSGYDDKDLNLVSLRFYLLRKHGYYVSSDVFTSFKDKEGNFVADDTKCLLSLYNAAYLRTHGEKVLDEAIIFTRHQLEALLDSLESTLADEVSVTLQTPLFRRVRILETRNYIPIYEKEAARNEVILEFAKLNFNLLQLIYCEELKKVTLWWKQLNVETNLSFIRDRIVECHFWMTGACFEPQYSLARVISTKMTACITILDDIMDTYSTTEEAMLLAEAIYRWEENAAELLPEYMKDFYLYLLKTIDSCDNELGPNKSFRTFYLKEVASLLKVLVRGNSQEIKWRNENYVPETINEHLEHSGRSVGAFQVACSSFVGMGDNITKEILEWFLTYPELLKSFTTIARLSNDIASTKREQNVGHHVSTVQCYMLKHGTTMDDAYEKIKELIEDTWKDMMELYLTPTEQPKLVTQTVVDFARTADYMYKKTDAFTFSHTLKDMIAKLFVEPILLF

SEQ ID NO: 10865 - DNA, 1605 bp, Sorghum bicolor
  misc_feature: Ceres ANNOT ID no. 6117750
  misc_feature: Encodes the peptide sequence at SEQ ID NO 10866
atggcagcacttcaatacaactgcgatgccggacttgcaaaggctcctacctttcacccaagcctgtggggtgatttcttcctgacataccagccgcctactgcacctcagcatgtgtacatgaaagagcgagctgagctgttaaaggaagaagttagggagattgtaaaggggacaaatgaactaccaaaattattggatcttataatcacactgcaacggcttggactagataaccactatgagatagagattgatgagcacctgcactttatttacaattctagttgcgatgtcaaagatctgaatttggtttcactgcgattttatcttctaaggaagaatggctatgatgtgtcatctgatgtatttctaaatttcaaagacaaggatggaaattttgcttctgatgatatcagaagtcttttgagcttatataatgcagcataccttagaactcatggcgaggaagtacttgatgaagccattatattcactagaagacaccttgaagccgcattgacctcattagaatccaaattagcagatgaagtctctttgtcccttcaaacgcctctcttccggagggttagaatactggaaacaaggaactatatccctatttacgaaatggagccctcacggaatgaagccatgttagagtttgcaaaactgaacttcaacctccttcaaattctttattgtgaggagttgaaaacagtcacagcgtggtggaagcagcttaatattgaaacagatttaagttttattcgagacagaatagttgaaatgcatttctggatggcaggagcatgctctgagcccaaatattctctttcacgagttatactcacgaaaatgacagcctttatcaccatactagatgatataattgatacccacagtacaacagaggagggcaagctgcttgccaaagcaatagacaggtgcagtcaagacgcgaatgaagtacttccagactacatgaagcacttctacatgtttttattgaagacatttgattcttgtgaggatgagctaggaccaaacaaaagatatcggttaaagatattagtccgaggatactctcaggagatagaatggcgtgatgaacattatgttcctgaaacaattgacaaacatctagaaatttcaagagtaactgttggagcttttcaactggcatgctcttcatttgttgggatgggtgatatcataacaaaggaagttctcgattggcttttgacatatccagaacttctcaagtgtttcacaacgtttgtacgactatccaatgatattacatcaacagagcgcgagcaaactggagggcatcatgcttcaactgtccaatgttatatgttgcagcatagcacaacgatgcatgatgcatgtgagaagataaaaggtctaattgaagattcatggaaggatatgatgcaactctaccttacaccaacagaacagtcgaaggttgtggcacagacagttgttgactttgcaaggactggtgattacatgtacaagaaaactgatgcatttactttttcccatacgatcaaagatatgatagcattgctgtatgtggagccaatattgttctaa

SEQ ID NO: 10866 - protein, 534 aa, Sorghum bicolor
  misc_feature: Ceres ANNOT ID no. 6117750
  misc_feature (218)..(480): Pfam Id: Terpene_synth_C Pfam Desc: Terpene synthase family, metal binding domain
  misc_feature (23)..(213): Pfam Id: Terpene_synth Pfam Desc: Terpene synthase, N-terminal domain
  misc_feature (15)..(534): NCBI GI: 62754276 NCBI Desc: terpene synthase 10 [zea mays]
  misc_feature (15)..(534): NCBI GI: 62754278 NCBI Desc: terpene synthase 10 [zea mays]
  misc_feature (15)..(533): NCBI GI: 46358533 NCBI Desc: terpene synthase 6 [zea mays]
  misc_feature (9)..(532): NCBI GI: 46358529 NCBI Desc: terpene synthase 5 [zea mays]
  misc_feature (9)..(532): NCBI GI: 46358523 NCBI Desc: terpene synthase 4 [zea mays]
MAALQYNCDAGLAKAPTFHPSLWGDFFLTYQPPTAPQHVYMKERAELLKEEVREIVKGTNELPKLLDLIITLQRLGLDNHYEIEIDEHLHFIYNSSCDVKDLNLVSLRFYLLRKNGYDVSSDVFLNFKDKDGNFASDDIRSLLSLYNAAYLRTHGEEVLDEAIIFTRRHLEAALTSLESKLADEVSLSLQTPLFRRVRILETRNYIPIYEMEPSRNEAMLEFAKLNFNLLQILYCEELKTVTAWWKQLNIETDLSFIRDRIVEMHFWMAGACSEPKYSLSRVILTKMTAFITILDDIIDTHSTTEEGKLLAKAIDRCSQDANEVLPDYMKHFYMFLLKTFDSCEDELGPNKRYRLKILVRGYSQEIEWRDEHYVPETIDKHLEISRVTVGAFQLACSSFVGMGDIITKEVLDWLLTYPELLKCFTTFVRLSNDITSTEREQTGGHHASTVQCYMLQHSTTMHDACEKIKGLIEDSWKDMMQLYLTPTEQSKVVAQTVVDFARTGDYMYKKTDAFTFSHTIKDMIALLYVEPILF

SEQ ID NO: 10867 - DNA, 792 bp, Sorghum bicolor
  misc_feature: Ceres ANNOT ID no. 6117808
  misc_feature: Encodes the peptide sequence at SEQ ID NO 10868
atggctgccacgctctcctccgtggctgccccttccctccccaagcacggctccatcatcagagctcagcagcaggcgcctccttccatcatctcggcatcaacgactcagaagactgccttccatggggtgtcgctggtggacaggaggtgggcggccgccggccaccggagaggcggcggcgcgcggcggaggctgctgcaggtgaacgcgaggaccgccgccaagaacattgaggtggaggtcgacaagccacttgggttagccttaggccagaagcccggcggtggcgtcgtcatcacttctgtggaatctggagggaatgcagcaagagctggtctgaaagccggcgaccaggtcttgtacacaagtagcttctttggagatgagctgtggcctgcagataagcttgggttcaccaagacagccatccaagcaaagccagactccgtctactttgtcgtgagcaggggtgccgaagttgatgtgaagcgcctacctaagaggccggcaccgcctcggtttggacggaagttgactgatgcacaaaaggagagagcaacgcacatctgccttgattgtggattcatatacttcctacccaagccttttgaagaacagcctgatgaatatggatgcccacaatgcaatgcgccaaagaagcgatttgcaaagtatgatgctgccactgggaaggccatcggcggtgcgctgccgcctattgcggtgatcataagttttgtaatcggcatcgccggagtaggggctctgcttgtgtatggcctgcaatag

SEQ ID NO: 10868 - protein, 263 aa, Sorghum bicolor
  misc_feature: Ceres ANNOT ID no. 6117808
  misc_feature (188)..(223): Pfam Id: Rubredoxin Pfam Desc: Rubredoxin
  misc_feature (3)..(186): NCBI GI: 145334505 NCBI Desc: rubredoxin family protein [arabidopsis thaliana]
  misc_feature (172)..(232): NCBI GI: 92871093 NCBI Desc: rubredoxin-type fe(cys)4 protein [medicago truncatula]
  misc_feature (79)..(147): NCBI GI: 92884723 NCBI Desc: pdz/dhr/glgf; tetratricopeptide-like helical [medicago truncatula]
  misc_feature: The sequence is a functional homolog of SEQ ID NO. 436 in the 11/188,298 US application
MAATLSSVAAPSLPKHGSIIRAQQQAPPSIISASTTQKTAFHGVSLVDRRWAAAGHRRGGGARRRLLQVNARTAAKNIEVEVDKPLGLALGQKPGGGVVITSVESGGNAARAGLKAGDQVLYTSSFFGDELWPADKLGFTKTAIQAKPDSVYFVVSRGAEVDVKRLPKRPAPPRFGRKLTDAQKERATHICLDCGFIYFLPKPFEEQPDEYGCPQCNAPKKRFAKYDAATGKAIGGALPPIAVIISFVIGIAGVGALLVYGLQ

SEQ ID NO: 10869 - DNA, 1566 bp, Sorghum bicolor
  misc_feature: Ceres ANNOT ID no. 6117817
  misc_feature: Encodes the peptide sequence at SEQ ID NO 10870
atgctgctgctccgagtgctgctccggcgacggcggccgccgctccccgtccccaccgcaggattcttcaccagctccggaagcaacgccaccgcgcctcctcctcctcctcctcctcctccttctcttggggcggaggggccccgcgacgtgccagggcaggagggctcgctggcgcggcgggtggagcgggcggcgtcggtcggcgcggccatgcggggctggatggccgacggccgcgccgtgcaccgcggccacgtattccacgccatcaaccgcctccgacgacaccgtctacaccgcaccgccctgcaggtcatggaatggatcgtgagagagaggccctacaagctgagtgagcttgattactcgtatctgctggagttcacagctaaagtccatggcatttctgaagccgaaagcctcttccttcgcgtacctcaggaataccagaaagagctcctctataacaaccttgtcatggctgctttggatctggatctcattaagcattcatacgcttacatgaggaagatgagagaattgtccttgccgatctcgccatatgtttacaaccgcctgatcatccttcattcttcacccagtcgcaggaaaactatatccaagatcctttatcaaatgaaagctgatcgtgtgacccctcacacgtcaacctacaacatcctgttgaaaatacaagccaatgagcacaacattgacgggctagccagggtgtttagtgatatgaaaagagcaaagattgagcccaatgagatcacttatggcattctagctatttcacatgctgttgcaagactatatactgtttgccacacatatgtagaagccattgagaattccatgacaggtactaattggtccacactggaaattcttcttatcttgtatggataccttgggaaggaaaaggagctaaagaggacatgggagatcatgcaagacctccctcatgttcgatccaaaagcttcacagtagcaatagaagcatttggaaaggttggttccattgatcaggcagagaagatatgggtccagataaaatcaacaaaaaagttaagccttacagaacagttcaattccattttatcagtttactgcaggcacggtgttgtggataaagcatcatctgtattcaaggaaatgagagcaaacggatgccagcctaatgctattacttatcgccacttagcattgggttgcttgaaatcgggtcttgttaaagaagccttgaacacaatagatatgggaaagaaggaagtcgtcactaaaaaggtgaggagttcaacaccatggttggagaccacacatctgttgcttgagaactttgcagaaattggagacttggaaaatgcaaagagactatacagtgaactgaatgaatcaaaatattctcggaattcctttgtgtataacaccctcctgaaagcttatgtgaaggcaaaagtttatgagccagatttgttgaggacaatgattttgagaggggcaatgcctgatgctgagacatatagccttctcagactgattgaacagttcaagatctaa

SEQ ID NO: 10870 - protein, 521 aa, Sorghum bicolor
  misc_feature: Ceres ANNOT ID no. 6117817
  misc_feature (363)..(397): Pfam Id: PPR Pfam Desc: PPR repeat
  misc_feature (38)..(520): NCBI GI: 15809864 NCBI Desc: at1g07590/f22g5_2 [arabidopsis thaliana]
  misc_feature (80)..(520): NCBI GI: 8778536 NCBI Desc: f22g5.3 [arabidopsis thaliana]
  misc_feature (67)..(520): NCBI GI: 5103846 NCBI Desc: f9l1.43 [arabidopsis thaliana]
  misc_feature (67)..(520): NCBI GI: 145335742 NCBI Desc: dna binding [arabidopsis thaliana]
  misc_feature (68)..(519): NCBI GI: 6958202 NCBI Desc: dna-binding protein [triticum aestivum]
MLLLRVLLRRRRPPLPVPTAGFFTSSGSNATAPPPPPPPPPSLGAEGPRDVPGQEGSLARRVERAASVGAAMRGWMADGRAVHRGHVFHAINRLRRHRLHRTALQVMEWIVRERPYKLSELDYSYLLEFTAKVHGISEAESLFLRVPQEYQKELLYNNLVMAALDLDLIKHSYAYMRKMRELSLPISPYVYNRLIILHSSPSRRKTISKILYQMKADRVTPHTSTYNILLKIQANEHNIDGLARVFSDMKRAKIEPNEITYGILAISHAVARLYTVCHTYVEAIENSMTGTNWSTLEILLILYGYLGKEKELKRTWEIMQDLPHVRSKSFTVAIEAFGKVGSIDQAEKIWVQIKSTKKLSLTEQFNSILSVYCRHGVVDKASSVFKEMRANGCQPNAITYRHLALGCLKSGLVKEALNTIDMGKKEVVTKKVRSSTPWLETTHLLLENFAEIGDLENAKRLYSELNESKYSRNSFVYNTLLKAYVKAKVYEPDLLRTMILRGAMPDAETYSLLRLIEQFKI

SEQ ID NO: 10871 - DNA, 867 bp, Sorghum bicolor
  misc_feature: Ceres ANNOT ID no. 6117818
  misc_feature: Encodes the peptide sequence at SEQ ID NO 10872
atggaaatgggcgacagcttcgagtactactgggagacgcagcagtacctggagtcagaggagctcagcatctaccttggtacgcaggacgacgccctgtcctgctacgactccagctcgccggacggctccatctccaataactcctcctgggccgcgccggcggggacggtggccacggcggcggccggaaaggaggaggagggccccggcggcgcgggcggaggtggtgcggtggccgccgcgaacaagaacatcatcatggagcgcgaccgccggcgcaagctcaacgagaagctctacgcgctgcgcagcgtcgtgcccaacatcaccaagatggacaaggcgtcgatcatcaaggacgcgatcgagtacatcgaggcgctgcaggcggaggagcggcggatgctgcaggaggtgcgcgcgctggaggaggcagacgccgccgaggagcgctgcgagtacgacgagtacggcgaggagggcgcgctcctgcaggcggcggatcgggggaggaagaagatgaagcggacgcagtccgtgccttcgtcgtccgtcccggcggccgcggcgcccgtggaggtcctggagctccgcgtgtcggaggtgggcgaccgcgtgctggtggtcaacgtgacgtgcggcaagggccgcgacgccatggcccgcgtgtgccgcgccgtcgaggagctccgcctccgcgtcatcaccgccagcatcacctccgtcgccggctgcctcatgcacaccatcttcgtcgaggtggatttggatgaagcgaatcgtattcaaatgaagcacatgattgaggccgctctgagtcagctagatgccgccgggagtccgccaagtgcgatgagctattag

SEQ ID NO: 10872 - protein, 288 aa, Sorghum bicolor
  misc_feature: Ceres ANNOT ID no. 6117818
  misc_feature (81)..(130): Pfam Id: HLH Pfam Desc: Helix-loop-helix DNA-binding domain
  misc_feature (1)..(288): NCBI GI: 115457612 NCBI Desc: os04g0301500 [oryza sativa (japonica cultivar-group)]
  misc_feature (1)..(288): NCBI GI: 116308947 NCBI Desc: h0215e01.1 [oryza sativa (indica cultivar-group)]
  misc_feature (1)..(288): NCBI GI: 29466635 NCBI Desc: transcription factor [oryza sativa]
  misc_feature (1)..(285): NCBI GI: 70663984 NCBI Desc: osjnbb0018a10.7 [oryza sativa (japonica cultivar-group)]
  misc_feature (66)..(284): NCBI GI: 92877476 NCBI Desc: helix-loop-helix dna-binding [medicago truncatula]
  misc_feature: The plant flowers significantly late compared to wild-type.
  misc_feature: The plant is abnormally small.
  misc_feature: The sequence is a functional homolog of SEQ ID NO 1195 in the 11/479,226US patent application
  misc_feature: The sequence is a functional homolog of SEQ ID NO 538 in the 10/412,699US patent application
  misc_feature: Useful for making plants with modulated biomass
  misc_feature: Useful for making plants with modulated flowering time
  misc_feature: Useful for making plants with modulated growth and phenotype characteristics
  misc_feature: The sequence is a functional homolog of SEQ ID NO 538 in the 20040045049 US patent application
  misc_feature: Functional homolog of the protein sequence given in SEQ ID NO 13563
  misc_feature: The sequence is a functional homolog of SEQ ID NO. 483 in the 11/188,298 US application
  misc_feature: The sequence is a functional homolog of SEQ ID NO. 414 in the 11/188,298 US application
MEMGDSFEYYWETQQYLESEELSIYLGTQDDALSCYDSSSPDGSISNNSSWAAPAGTVATAAAGKEEEGPGGAGGGGAVAAANKNIIMERDRRRKLNEKLYALRSVVPNITKMDKASIIKDAIEYIEALQAEERRMLQEVRALEEADAAEERCEYDEYGEEGALLQAADRGRKKMKRTQSVPSSSVPAAAAPVEVLELRVSEVGDRVLVVNVTCGKGRDAMARVCRAVEELRLRVITASITSVAGCLMHTIFVEVDLDEANRIQMKHMIEAALSQLDAAGSPPSAMSY

SEQ ID NO: 10873 - DNA, 3417 bp, Sorghum bicolor
  misc_feature: Ceres ANNOT ID no. 6117821
  misc_feature: Encodes the peptide sequence at SEQ ID NO 10874
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to aminocyclopropane carboxylic treatment
  misc_feature: Down-regulated in root tissues in response to salicylic acid treatment
atgtcgtctcttagcagggagctggttttcctcatcctgcagttcctcgatgaggagaagttcaaggagacggtgcacaagttggagcaggagtcgggcttctacttcaacatgaagcacttcgaggacctcgtccagggcggcgagtgggacgaggtggagaagtacctcagcggcttcaccaaggtggaggacaaccgctactccatgaagatcttctttgagatccgcaagcagaagtacctcgaggcccttgataggcatgatagggccaaggctgtggagattctcgtgaaggatctcaaggtgttcgcctccttcaatgaggagctgttcaaggagataacacagctgctgaccttggagaattttaggcaaaatgagcagctgtccaagtacggggacacaaagtcagcccggaatatcatgcttttggagctcaaaaagctcattgaagcgaaccccctgttccgggacaagctgaatttcccaccattcaaagcttccaggcttcgcacattgatcaatcaaagtctgaactggcaacatcagctctgcaagaaccccagaccaaaccctgacatcaagacactctttactgatcactcttgtgctgctcctaccaatggagcaagagcacctccacctgccaatggtccgcttgttggatccatccctaagtcagctggatttccaccaatgggtgctcatgctccatttcaacctgtggtgtcgccatctccaaacgccattgcaggttggatgacaaatgcaaacccctctttgcctcatgctgctgttgcacaaggaccacctggtcttgttcaggctcctaacacagcggcatttctaaagcatcctagaacccctacaagcgcacctggtattgattaccaatctgcagattcagaacatctcatgaaaagaatgcgtgttggacaaccagatgaggtatctttctctggtgcaagccatcctgccaatatgtacacacaagaagaccttcccaaacaagtttctcgtacccttaatcagggttctaatgttatgagcttggatttccaccccgttcaacaaaccattcttttagttggaacaaatgttggtgacattgcggtgtgggaagttggttcacgggaaaggatagctcacaagactttcaaagtttgggatattggttcctgtaccttgcctttgcaggcttcgctgatgaaagatgctgcaatatctgtcaatagatgtctgtggagcccagatggaactattctaggtgttgctttctcgaagcatattgttcagacatatacttttgtccctaatggagatttacggcagcaagcagagattgatgcacacatcggcggggttaatgatatagccttctctcaccctaataaaactctatctatcattacatgtggtgatgataaactcattaaggtgtgggatgctcaaacaggacaaaagcagtacacatttgaaggccatgaagctcctgtgtattctgtatgccctcactacaaggagtccattcagtttatcttctctactgccattgatggaaaaatcaaggcatggttgtatgattgcttgggctcaagagttgactatgatgctcctggacattggtgtactaccatggcttacagtgctgatggtacaagactgttctcttgtggtactagtaaagaaggtgattcacacttggttgaatggaatgaaactgaaggggctatcaagaggacatacaatggcttcaggaaacgttcactcggtgttgttcagtttgacacaactaggaatcgcttcttggctgctggagatgaatttcttgttaaattctgggatatggataacaataacatactaacgacaacagactgtgatggtggactgccagcaagccctcgtttgaggttcaatagagaaggttcattacttgcagttacaacaagtgataatggaataaaaatacttgccaacactgatggacagcgcttgcttaggatgcttgagagtagagcatttgagggctctagaggacctcctcaacaaataaataccaagcctccaattgtcgcccttggtccagtttcaaatgtcagcagtcctatagcagtaaatgccgagcgacctgatcggatcttgcctgcagtgtcgacaagtggcttggcacctatggatccaagcagaactccagatgttaaaccaagaataacagatgaatctgaaaaggtcaaaacctggaagttggctgacattgttgacaatgggcatcttcgagccctgcatttaacagacacggacacgaacccaagcaaagttgtccgtttgttatatacaaataatggaattgcactcttggctcttggctccaatgctgttcataagttgtggaaatggcaacggggcgacagaaatcctagcggcaagtctactgcatctgttgcccctcacctgtggcaaccagcaaatgggattctgatgacaaatgacactaacgatggcaatccagaagaagcaactgcctgcattgcattgtccaaaaatgactcctatgttatgtctgcctctggtggcaaagtctcgttgttcaatatgatgacattcaaggtcatgactactttcatggcacctccgcctgctgcaactttccttgcattccacccacaagataataatatcatagctattggaatggaggactctaccatccaaatctacaatgtccgcattgatgatgtcaaaagtaagctcaagggacatcagaagaagatcactggactggccttttctcaatcaatgaatgtgctagtatcatcaggcgctgatgctcagctatgtgtgtggagtattgatggttgggaaaaaaagaaatcaagatatattcaacccccagcaaatcgacctggcactttggttggtgatacaagggtgcagttccacaatgaccagacacatcttttggtagtccatgagagccagttggcaatctatgatggaaatcttgaatgtttgcgctcgtggtcaccaagagatgcactcccagctccaatatcgagtgcaatatactcgtgtgatggtcttttggtttatgctgcgttctgtgatggtgctattggagtctttgaagcagaatctcttaggttgcgctgccggattgctccttctgcttacattccaccttcaatactagcctgtgctggacgggtttacccattggtagttgctgctcatcccatggagcctaaccagattgcacttggcatgagtgatggtaaggtccatgtggtggagccattagacggggacccaaagtggggaacagcgccacctcaggacaatggagtgcacccagcaatatcagcagcaccatcagccgctaccaaccaggcatccgatcagccaacgaggtga

SEQ ID NO: 10874 - protein, 1138 aa, Sorghum bicolor
  misc_feature: Ceres ANNOT ID no. 6117821
  misc_feature (443)..(483): Pfam Id: WD40 Pfam Desc: WD domain, G-beta repeat
  misc_feature (487)..(527): Pfam Id: WD40 Pfam Desc: WD domain, G-beta repeat
  misc_feature (913)..(951): Pfam Id: WD40 Pfam Desc: WD domain, G-beta repeat
  misc_feature (1)..(1128): NCBI GI: 115474917 NCBI Desc: os08g0162100 [oryza sativa (japonica cultivar-group)]
  misc_feature (1)..(1138): NCBI GI: 24461849 NCBI Desc: ctv.2 [poncirus trifoliata]
  misc_feature (1)..(1138): NCBI GI: 92870734 NCBI Desc: lissencephaly type-1-like homology motif; ctlh, c-terminal to lish motif; wd40-like; quinonprotein alcohol dehydrogenase-like [medicago truncatula]
  misc_feature (1)..(1138): NCBI GI: 87162556 NCBI Desc: lissencephaly type-1-like homology motif; ctlh, c-terminal to lish motif; nitrous oxide reductase, n-terminal; wd40-like; quinonprotein alcohol dehydrogenase-like [medicago
  misc_feature (1)..(1138): NCBI GI: 87162556 (continued) truncatula]
  misc_feature (1)..(1138): NCBI GI: 92879651 NCBI Desc: lissencephaly type-1-like homology motif; ctlh, c-terminal to lish motif [medicago truncatula]
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to aminocyclopropane carboxylic treatment
  misc_feature: Down-regulated in root tissues in response to salicylic acid treatment
  misc_feature: The sequence is a functional homolog of SEQ ID NO. 502 in the 11/188,298 US application
MSSLSRELVFLILQFLDEEKFKETVHKLEQESGFYFNMKHFEDLVQGGEWDEVEKYLSGFTKVEDNRYSMKIFFEIRKQKYLEALDRHDRAKAVEILVKDLKVFASFNEELFKEITQLLTLENFRQNEQLSKYGDTKSARNIMLLELKKLIEANPLFRDKLNFPPFKASRLRTLINQSLNWQHQLCKNPRPNPDIKTLFTDHSCAAPTNGARAPPPANGPLVGSIPKSAGFPPMGAHAPFQPVVSPSPNAIAGWMTNANPSLPHAAVAQGPPGLVQAPNTAAFLKHPRTPTSAPGIDYQSADSEHLMKRMRVGQPDEVSFSGASHPANMYTQEDLPKQVSRTLNQGSNVMSLDFHPVQQTILLVGTNVGDIAVWEVGSRERIAHKTFKVWDIGSCTLPLQASLMKDAAISVNRCLWSPDGTILGVAFSKHIVQTYTFVPNGDLRQQAEIDAHIGGVNDIAFSHPNKTLSIITCGDDKLIKVWDAQTGQKQYTFEGHEAPVYSVCPHYKESIQFIFSTAIDGKIKAWLYDCLGSRVDYDAPGHWCTTMAYSADGTRLFSCGTSKEGDSHLVEWNETEGAIKRTYNGFRKRSLGVVQFDTTRNRFLAAGDEFLVKFWDMDNNNILTTTDCDGGLPASPRLRFNREGSLLAVTTSDNGIKILANTDGQRLLRMLESRAFEGSRGPPQQINTKPPIVALGPVSNVSSPIAVNAERPDRILPAVSTSGLAPMDPSRTPDVKPRITDESEKVKTWKLADIVDNGHLRALHLTDTDTNPSKVVRLLYTNNGIALLALGSNAVHKLWKWQRGDRNPSGKSTASVAPHLWQPANGILMTNDTNDGNPEEATACIALSKNDSYVMSASGGKVSLFNMMTFKVMTTFMAPPPAATFLAFHPQDNNIIAIGMEDSTIQIYNVRIDDVKSKLKGHQKKITGLAFSQSMNVLVSSGADAQLCVWSIDGWEKKKSRYIQPPANRPGTLVGDTRVQFHNDQTHLLVVHESQLAIYDGNLECLRSWSPRDALPAPISSAIYSCDGLLVYAAFCDGAIGVFEAESLRLRCRIAPSAYIPPSILACAGRVYPLVVAAHPMEPNQIALGMSDGKVHVVEPLDGDPKWGTAPPQDNGVHPAISAAPSAATNQASDQPTR

SEQ ID NO: 10875 - DNA, 1770 bp, Sorghum bicolor
  misc_feature: Ceres ANNOT ID no. 6117825
  misc_feature: Encodes the peptide sequence at SEQ ID NO 10876
atggcgaccgcgggggtgggtgctgttcttgctgtggtggttttggcttgtgcactgggagccagagctgatggatctgatcacaagtacaaggaaggggatcatgttccgctctatgccaacaaggtcgggcctttccacaatccaagtgagacgtaccggtactatgatctacccttttgtgcaccagaacatccaaaggacaaaaaggaagctcttggcgaggttctaaatggtgaccggttggttgatgccccatatgagttggacttcaaggaagataggaactccaaggttctctgcaagaaagtattgtcaaaacagcaagttgccaagctccgggatgcagttgccaaggattactacttccagatgtactacgatgatttgccgttatggggattccttggtaaactggacaaggacaaggagcaaggagatgcgaagtacctactgtttaaacacatccactttgacatcatgtacaatgataaccgtgtcatagaaataaatgtacagactgatccaaatgtggctgtggatatcacagaggacaaggaagtgccaatagagttctcttattcagtgacatggaaaaagacagatattccttttgagaaaagaatggataagtactccaagtcttcctctatgccacaacatctagagatccattggttttccataattaactcgtgtgttacagttctcctcctgactggtttcctggctacaatcctgatgcgtgttctcaagaacgatttcatcaagtattctcatgaagatgagtcccttgaagaccaagaggagactggatggaagtatattcacggtgatgtcttccgtttccccaaacagaagtccatttttgcagcaattattggatctggaactcagcttcttgcccttgcaatttttatcttcctcctcgctcttgttggtgtcttttatccatacaaccggggagctctttttactgcccttgttgtcatctatgctcttacgtccggtattgctggatacacagccacttctttctatctgcaactggagggaacaaactgggttaggaatctaatattgactggctgcttattctgtggacctctcttcttgacattctgtttcctaaatacagttgcaatagcgtacagtgctacagcagctttgcctttcggcactatcattgtcattatcctcatctgggcacttgtaacctctcctctccttgtgttgggtggtatagccgggaaaaatagtaatacagaattccaagccccctgccgcacaaccaagtacccgagggaaatccctcagcttccatggtaccgaagcaccattcctcagatggcaatggcagggttcctccctttcagcgcaatttacatcgagctgtactacatatttgccagtatctgggggcataagatatacaccatctacagcattctctttattgtgttcattatcctcatcattgtcactgcctttgtcacagtggcacttacgtacttccagcttgctgttgaggatcatgagtggtggtggagatctgtcctgtgtggaggctccacgggcatattcatcttcttctactgcatctactactaccatgcgcggtccgacatgtcaggcttcatgcagacatccttcttcttcggctacatgacctgcgtctgctttggcttcttcctcatgctgggcaccgtcggtttccgcgcatcgctcttcttcgtgcggcacatctaccgctccatcaagtgcgagtaa

SEQ ID NO: 10876 - protein, 589 aa, Sorghum bicolor
  misc_feature: Ceres ANNOT ID no. 6117825
  misc_feature (51)..(547): Pfam Id: EMP70 Pfam Desc: Endomembrane protein 70
  misc_feature (23)..(589): NCBI GI: 9758717 NCBI Desc: endosomal protein-like [arabidopsis thaliana]
  misc_feature (305)..(589): NCBI GI: 7527721 NCBI Desc: t5e21.15 [arabidopsis thaliana]
  misc_feature (9)..(589): NCBI GI: 145323800 NCBI Desc: endomembrane protein 70 family protein [arabidopsis thaliana]
  misc_feature (257)..(589): NCBI GI: 8778208 NCBI Desc: f10b6.3 [arabidopsis thaliana]
  misc_feature (9)..(589): NCBI GI: 37622957 NCBI Desc: phg1b [dictyostelium discoideum]
  misc_feature: Useful for making plants with altered cell wall content and/or composition
  misc_feature: Functional homolog of the protein sequence encoded by LOCUS at1g14670
  misc_feature: Useful for making plants with altered cell wall content and/or composition
  misc_feature: Functional homolog of the protein sequence given in SEQ ID NO 13589
MATAGVGAVLAVVVLACALGARADGSDHKYKEGDHVPLYANKVGPFHNPSETYRYYDLPFCAPEHPKDKKEALGEVLNGDRLVDAPYELDFKEDRNSKVLCKKVLSKQQVAKLRDAVAKDYYFQMYYDDLPLWGFLGKLDKDKEQGDAKYLLFKHIHFDIMYNDNRVIEINVQTDPNVAVDITEDKEVPIEFSYSVTWKKTDIPFEKRMDKYSKSSSMPQHLEIHWFSIINSCVTVLLLTGFLATILMRVLKNDFIKYSHEDESLEDQEETGWKYIHGDVFRFPKQKSIFAAIIGSGTQLLALAIFIFLLALVGVFYPYNRGALFTALVVIYALTSGIAGYTATSFYLQLEGTNWVRNLILTGCLFCGPLFLTFCFLNTVAIAYSATAALPFGTIIVIILIWALVTSPLLVLGGIAGKNSNTEFQAPCRTTKYPREIPQLPWYRSTIPQMAMAGFLPFSAIYIELYYIFASIWGHKIYTIYSILFIVFIILIIVTAFVTVALTYFQLAVEDHEWWWRSVLCGGSTGIFIFFYCIYYYHARSDMSGFMQTSFFFGYMTCVCFGFFLMLGTVGFRASLFFVRHIYRSIKCE

SEQ ID NO: 10877 - DNA, 903 bp, Sorghum bicolor
  misc_feature: Ceres ANNOT ID no. 6117829
  misc_feature: Encodes the peptide sequence at SEQ ID NO 10878
atggtgacggcgacggcggcggcggcggcggcgcagacagtttggtacgatcccatgtcttcgccacaggcgccggcgccgcaccagcagccggcgatagagactgcggaggcggcctcgccgtcgatgagctccgacgcgcggcctctcagggtgtatgccgacggcatctacgatctcttccacttcggccatgcgcgcgcgctcgaacaggctaagaaatcatttcccaacacctacttgctggtaggttgctgcagtgatgagatcacccacatgtacaaaggaaagaccgtcatgaccgaggacgagcgctatgaatcacttcggcattgcaagtgggttgacgaggttataccagatgctccatgggtgatcaaccaggagttcatcgacaaacacaacatcgactatgtcgctcatgatgcgctcccatatgctgacacgagtggagctgccaatgatgtctatgaatttgtgaaagctattgggaagttcaaggagacgaagcgcaccgagggcatctctacatcggacatcatcatgaggatcttgaaggactacaaccagtacattatgcggaatctcacccgtgggtacagccgtaaagacctcggcgtcagctatgttaaggagaagcaactgagagtcaacatggggattagcaagctaagggagaaggtgaaggagcatcaagagaagtttcacagtgcggcaaagatcgctggaaccaaccctgtggagtggatggagaatgcagaccgttggattgttgggttccttgagaagtttgaggaaggttgccacatgatggaaactgccattaaagatcgaattcaggagggattgaagaggcaaggcaggtcagagtcaaacctttctggagaggactccgactcgtaa

SEQ ID NO: 10878 - protein, 300 aa, Sorghum bicolor
  misc_feature: Ceres ANNOT ID no. 6117829
  misc_feature (53)..(183): Pfam Id: CTP_transf_2 Pfam Desc: Cytidylyltransferase
  misc_feature (37)..(299): NCBI GI: 140043931 NCBI Desc: cytidylyltransferase [medicago truncatula]
  misc_feature (34)..(292): NCBI GI: 21668500 NCBI Desc: ctp:phosphorylcholine cytidylyltransferase [arabidopsis thaliana]
  misc_feature (48)..(286): NCBI GI: 1657382 NCBI Desc: cholinephosphate cytidylyltransferase [pisum sativum]
  misc_feature (20)..(300): NCBI GI: 1418127 NCBI Desc: ctp:phosphocholine cytidylyltransferase [brassica napus]
  misc_feature (20)..(300): NCBI GI: 1418125 NCBI Desc: ctp:phosphocholine cytidylyltransferase [brassica napus]
  misc_feature (20)..(264): SWISSPROT Homolog: EC 2.7.7.15 Choline-phosphate cytidylyltransferase B
MVTATAAAAAAQTVWYDPMSSPQAPAPHQQPAIETAEAASPSMSSDARPLRVYADGIYDLFHFGHARALEQAKKSFPNTYLLVGCCSDEITHMYKGKTVMTEDERYESLRHCKWVDEVIPDAPWVINQEFIDKHNIDYVAHDALPYADTSGAANDVYEFVKAIGKFKETKRTEGISTSDIIMRILKDYNQYIMRNLTRGYSRKDLGVSYVKEKQLRVNMGISKLREKVKEHQEKFHSAAKIAGTNPVEWMENADRWIVGFLEKFEEGCHMMETAIKDRIQEGLKRQGRSESNLSGEDSDS

SEQ ID NO: 10879 - DNA, 2886 bp, Sorghum bicolor
  misc_feature: Ceres ANNOT ID no. 6117837
  misc_feature: Encodes the peptide sequence at SEQ ID NO 10880
atggcgccgggcggcggagacggccggcgcaacggcgagggacagcagcaggcgaacggcaacaacaacaacaacaacagcaacgctaaggctaagcacgggtgcgtgtgcgggttccccgtgtgcgcgtgcgccggcgcggccgcggtggcgtccgcggcctcctccgccgacatggaccgcgtggccgccgcgcagaccgagggccagatcggcgccgtcaacgacgagagctggatcgccgtcgacctgagcgacgacctctccggcgacggcggcggcgccgaccccggcgtcgcgatcgaggaccgccccgtcttccgcaccgagaagatcaagggcatcctcctccacccctacagggtgctcatcttcgtgcgcctgatcgcgttcacgctgttcgtcatctggcgtatctcgcaccgcaacccggacgcgatgtggctgtgggtgacgtcgatcgcgggcgagttctggttcggcttctcctggctgctggaccagctccccaagctgaacccgatcaaccgcgtcccggacctcgcggtgctccggcagcggttcgaccgcgccgacggcacgtcccgcctcccgggcctggacatcttcgtcaccacggcggacccgttcaaggagcccatcctgagcacggccaactccatcctctccatccttgccgccgactaccccgtggagcgcaacacgtgctacctctccgacgactccgggatgctgctcacctacgaggccatggcggaggccgccaagttcgccaccgtctgggtgcccttctgccggaagcacggcatcgagcctcgtggccccgagagctacttcgagctcaagtcgcacccctacatggggaggtcgcaggaggacttcgtcaacgaccgccgccgtgtccgcaaggagtacgacgagttcaaggcccggatcaatggcctcgagcatgatatcaagcagaggtccgacgcgtttaacgccgctagggggcttaaggacggcgagcccagagctacgtggatggccgacgggaaccagtgggagggcacatgggttgagccatcggagaaccaccgcaagggtgaccacgccggcatcgtctatgtgcttctgaaccacccgagccacagccgtcagctcggcccgccggcgagcgcggacaacccgctggacttcagcatggtggacgttcgcctccccatgctggtgtacgtctcccgtgagaagcggcccgggttcaaccacgagaagaaggccggcgccatgaacgcgctgacccgctgctccgccgtgatctccaactcgcccttcatcctcaacctggactgcgaccactacatcaacaactcgcaggcgcttcgcgccggcatctgcttcatgctcggccgggacagcgacacggtggcgttcgtgcagttcccgcagcggttcgagggcgtggaccccacggacctgtacgccaaccacaaccgcatcttcttcgacggcacgctccgggcgctggacggcatgcagggccccatctacgtcggcaccggctgcatgttccgccgcatcacgctctacggcttcgacccgccgaggatcaacgtcggcgggccgtgcttcccgtcgctcggcggcatgttcgccaagaccaagtacgagaagcccgggctggagctcaccaccaaggccgccgtcgccaagggcaagcacggcttcctcccgttgcccaagaagtcgtacggcaagtcggacgcgttcgtcgacaccatcccgagggcgtctcacccgtcgccgttcctgagcgccgacgaggccgccgccatcgtcgccgacgaggccatgatcaccgaggccgtggaggtgtgcacggcggcgtacgagaagaagaccggctggggcagcgacatcggctgggtgtacggcaccgtcaccgaggacgtggtgacggggtaccggatgcacatcaaggggtggcggtctcgctactgctccatctacccgcacgccttcatcggcaccgccccgatcaacctgacggagcggctgtaccaggtgctccgctggtccacggggtcgctggagatcttcttctcccggaacaacccgctgttcggcagcacgttcctgcacccgctgcagcgcgtggcgtacatcaacatcaccacctacccgttcacggcgctgttcctcatcttctacaccaccgtgccggcgctgtcgttcgtgacggggcacttcatcgtgcagcggccgaccaccatgttctacgtgtacctggccatcgtgctggggacgctgctcatcctggccgtcctggaggtgaaatgggcgggcgtcaccgtcttcgagtggttcaggaacgggcagttctggatgacggccagctgctccgcgtacctggccgccgtgtgccaggtgctggtgaaagtggtgttccggcgagacatctccttcaagctcacatccaagcagcccgccggcgacgagaagaaggacccctacgccgacctgtacgtggtgcgctggacctggctcatggtgacccccatcatcatcatcctcgtcaacatcatcggatccgccgtggcgttcgccaaggtgctggacggcgagtggacgcactggctcaaggtggccggcggcgtcttcttcaacttctgggtgctgttccacctctacccgttcgccaagggcctcctcgggaggcacggcaagacccccgtggtggtgctcgtctggtgggcattcaccttcgtcatcaccgccgtgctctacatcaacatcccccacatccatggccccggcggcaagcacggcggcgcgatcggaaagcacggcgccgcccaccacggcaagaagttcgacctcgacaacctctcctacaactggccgtga

SEQ ID NO: 10880 - protein, 961 aa, Sorghum bicolor
  misc_feature: Ceres ANNOT ID no. 6117837
  misc_feature (105)..(938): Pfam Id: Cellulose_synt Pfam Desc: Cellulose synthase
  misc_feature (450)..(961): NCBI GI: 28611151 NCBI Desc: cslf6 [oryza sativa]
  misc_feature (570)..(934): NCBI GI: 6056428 NCBI Desc: very similar to cellulose synthase catalytic subunit [arabidopsis thaliana]
  misc_feature (46)..(534): NCBI GI: 16519235 NCBI Desc: cellulose synthase-like protein oscslf4 [oryza sativa]
  misc_feature (45)..(529): NCBI GI: 16519231 NCBI Desc: cellulose synthase-like protein oscslf2 [oryza sativa]
  misc_feature (49)..(529): NCBI GI: 16519229 NCBI Desc: cellulose synthase-like protein oscslf1 [oryza sativa]
  misc_feature: Useful for making plants with altered cell wall content and/or composition
  misc_feature: Functional homolog of the protein sequence encoded by LOCUS at3g03050
  misc_feature: Functional homolog of the protein sequence encoded by LOCUS at5g16910
  misc_feature: Useful for making plants with altered cell wall content and/or composition
  misc_feature: Functional homolog of the protein sequence given in SEQ ID NO 13647
  misc_feature: Useful for making plants with modulated plant growth and development
  misc_feature: Functional homolog of the protein sequence given in SEQ ID NO 13629
MAPGGGDGRRNGEGQQQANGNNNNNNSNAKAKHGCVCGFPVCACAGAAAVASAASSADMDRVAAAQTEGQIGAVNDESWIAVDLSDDLSGDGGGADPGVAIEDRPVFRTEKIKGILLHPYRVLIFVRLIAFTLFVIWRISHRNPDAMWLWVTSIAGEFWFGFSWLLDQLPKLNPINRVPDLAVLRQRFDRADGTSRLPGLDIFVTTADPFKEPILSTANSILSILAADYPVERNTCYLSDDSGMLLTYEAMAEAAKFATVWVPFCRKHGIEPRGPESYFELKSHPYMGRSQEDFVNDRRRVRKEYDEFKARINGLEHDIKQRSDAFNAARGLKDGEPRATWMADGNQWEGTWVEPSENHRKGDHAGIVYVLLNHPSHSRQLGPPASADNPLDFSMVDVRLPMLVYVSREKRPGFNHEKKAGAMNALTRCSAVISNSPFILNLDCDHYINNSQALRAGICFMLGRDSDTVAFVQFPQRFEGVDPTDLYANHNRIFFDGTLRALDGMQGPIYVGTGCMFRRITLYGFDPPRINVGGPCFPSLGGMFAKTKYEKPGLELTTKAAVAKGKHGFLPLPKKSYGKSDAFVDTIPRASHPSPFLSADEAAAIVADEAMITEAVEVCTAAYEKKTGWGSDIGWVYGTVTEDVVTGYRMHIKGWRSRYCSIYPHAFIGTAPINLTERLYQVLRWSTGSLEIFFSRNNPLFGSTFLHPLQRVAYINITTYPFTALFLIFYTTVPALSFVTGHFIVQRPTTMFYVYLAIVLGTLLILAVLEVKWAGVTVFEWFRNGQFWMTASCSAYLAAVCQVLVKVVFRRDISFKLTSKQPAGDEKKDPYADLYVVRWTWLMVTPIIIILVNIIGSAVAFAKVLDGEWTHWLKVAGGVFFNFWVLFHLYPFAKGLLGRHGKTPVVVLVWWAFTFVITAVLYINIPHIHGPGGKHGGAIGKHGAAHHGKKFDLDNLSYNWP

SEQ ID NO: 10881 - DNA, 1131 bp, Sorghum bicolor
  misc_feature: Ceres ANNOT ID no. 6117843
  misc_feature: Encodes the peptide sequence at SEQ ID NO 10882
atggagctcttcccctcccagccggacctctccctccagatcggcctccccgcaagcgccacgccccacgaccaccaccaccaccacggcgccaccgccctcagcgccaggttcctcgcggcagcagccgcaggcggtggcggcagcaacggagtcgttcctggcggcaacccggcggcgtccatggcgccgtcgtcgctgcagctgcccatgcccatgccgctgccgctgccggtgcagctgccgatgcccgtgccccccaacgccgccgccgccgccggggcgggcggcggcctgtactaccaccccgacaccgctgcggccgccgccatgctccggcccatccgcgggatgccgctgtaccagcacccgcacacgcacgcggtgccgccgccgacgttcccgccgccgcacgcggcgggggcgggggctggcccgtgcttctgcgagccctgccacgtcgccgcgggcgcctggcgccgcgccgggtgcggcgtcggggcgcgcgtcgccgggttgggtttccccccggccaagcgcgccgccagggcgccgcgcatgcgctggacgtccacgctccacgcgcgcttcgtccacgccgtcgagctcctcggcggacacgaaagggcaactcccaagtcagttcttgagctcatggacgtcaaggatctcaccctggctcatgtcaagtctcacttgcagatgtacaggaccgtgaagaacaccgaaaggccggcagcttcgtcagatcaagctgatgggttcgagaacgggtcggccggcgagatctgcgacgacaactcttcgctcgatctgcacggcagcgccggcaggccagagtcggcggcggctcggcatggaaggttagctgcctgtaacgatcatgggagcagcaccggcgctcatggtgccctctggaatagctcctcaagggaagactggaccggctttcccagcgactccaacaccgggagcatgagcatgcactctcgatctctcaaggatcagacgatgcattccaagagcctggagatcctctcggacatgaactcctcctgcgtgtcggagacgacgtcgtgtgccagcgagttgaacctggagttcaccctaggcccacgcatcaggcactag

SEQ ID NO: 10882 - protein, 376 aa, Sorghum bicolor
  misc_feature: Ceres ANNOT ID no. 6117843
  misc_feature (186)..(237): Pfam Id: Myb_DNA-binding Pfam Desc: Myb-like DNA-binding domain
  misc_feature (40)..(375): NCBI GI: 115474901 NCBI Desc: os08g0160300 [oryza sativa (japonica cultivar-group)]
  misc_feature (40)..(311): NCBI GI: 37806262 NCBI Desc: myb family transcription factor-like protein [oryza sativa (japonica cultivar-group)]
  misc_feature (112)..(371): NCBI GI: 92888229 NCBI Desc: homeodomain-related [medicago truncatula]
  misc_feature (112)..(275): NCBI GI: 140066599 NCBI Desc: homeodomain-related [medicago truncatula]
  misc_feature (166)..(357): NCBI GI: 115479007 NCBI Desc: os09g0395300 [oryza sativa (japonica cultivar-group)]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 134 in the 10/666,642US patent application
  misc_feature: The sequence is a functional homolog of SEQ ID NO 1857 in the 10/374,780US patent application
  misc_feature: The sequence is a functional homolog of SEQ ID NO 2058 in the 10/374,780US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 2058 in the 20060162006 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MELFPSQPDLSLQIGLPASATPHDHHHHHGATALSARFLAAAAAGGGGSNGVVPGGNPAASMAPSSLQLPMPMPLPLPVQLPMPVPPNAAAAAGAGGGLYYHPDTAAAAAMLRPIRGMPLYQHPHTHAVPPPTFPPPHAAGAGAGPCFCEPCHVAAGAWRRAGCGVGARVAGLGFPPAKRAARAPRMRWTSTLHARFVHAVELLGGHERATPKSVLELMDVKDLTLAHVKSHLQMYRTVKNTERPAASSDQADGFENGSAGEICDDNSSLDLHGSAGRPESAAARHGRLAACNDHGSSTGAHGALWNSSSREDWTGFPSDSNTGSMSMHSRSLKDQTMHSKSLEILSDMNSSCVSETTSCASELNLEFTLGPRIRH

SEQ ID NO: 10883 - DNA, 3189 bp, Sorghum bicolor
  misc_feature: Ceres ANNOT ID no. 6117845
  misc_feature: Encodes the peptide sequence at SEQ ID NO 10884
atgggctccggcgacgacgagcgctccacctcaaagcaccaccaccgcgacaaggacaaggaccgcgaccgctcctcgtctcgccaccaccgcgacaaggagcgcgaccgcgaccgcgagcgcgagcgctcctcctcgcgccaccaccgcgacgacggcgaccgggaccgggaccgggaccgccaccaccgcgacaaggagcgggatcgagaggagcggaaggagcgggagcgggaggagcggaaggcgcgggaacgggaggagcgggagagggagaaggagaaggagaaagagaaggagcgggcgcggcggcgcgaggagagggaccgcgaggagcgggagaggtcgaggcggcgcggggatgcggatggcgaggaggacgacgaccgggaccgcaagcgccgccgccggtcctcgcaccaccaccaccaccaccgggacccggagccggcgtcccgggaggaggaggaggtggacgccgaggaggcggagcgccggcgccagcggaagaaagaggaggacatggaggccgagcagcagcgcctcgacgacgagatggagcgccggcgccgccgcgtcaaggagtggcaggagaagcgccgcgagcagcagcagcagcaagatggcggtggagctggtggcgcttctgctgcagcggcggctgaggctgatggcgtcaaggtggcggggaagaagtggaccttggatggtgaggagtctgatgaggaaggtgacaaggaggatggcaagaaggatgaggagaatggcggcgctggtgacatggatgtggatttgcccaatggggatggcgatgccaacggtggtgctgggatggaggaggacgaaattgatccgcttgatgccttcatgaactctatggtgttgccagaggttgccaaactggagagtgctgcagcagcaatggacaccaccgcgcctggtgcaggtgcagatgacaagaatggtaagagctcaaaggatgtcgttagtaatggggataagaaagggtcaaggaaggcgatagggagaattatgcaaggggatgattcagaatcagactatgatgacgctgatgatgatggggctggagaggatgatgaggatgatgaggaattcataaagcgcgtcaagaagacgaaggccgagaagttggcaattgttgaccattctaagattgactaccaaccattccggaagaatttctatattgaggtgaaggacatctccaagatgacatccgaggaagtggtagagtaccggaagcacttggagctcaaggtgcatgggaaagacgtgcccaagccaataaagacatgggtgcagagtgggctgacaagcaagctccttgacaccatcaagaagcttggttttgagaaaccgatgcctatacagacacaggctttaccgatcataatgagtgggcgtgattgtataggcatcgcaaaaactggatctggcaagactctagcatttgtcctcccaatgctgaggcatgttaaagatcagccccctgttgtccctggagatggccctattggtctcattatggctcctactagagagcttgtggtgcagatacattcagacattaaaaagttctctaaggtgcttggcatcaactgtgttgcaatctatggaggttcgggagttgcgcagcagatcagtgaattgaagaggggtgccgaaattgttgtttgcacgccgggaaggatgattgatatcctttgcactagcagtggaaaaataactaaccttaggagagtgactttcttggtgatggatgaagctgataggatgtttgacatgggttttgagcctcagattactcgtatagtccagaatacccggccagataggcagacagtacttttctctgccacatttccacgtcaagtggagatactggcacgcaaggtgcttactaagcctgttgaaattcaagtgggtgggaggagtgtcgtgaacaaagatatcacacaactggttgaggtgcggccagacactgagaggttcttcaggctgttagagttgcttggtgaatggtatgttaaggggaaaatccttgtttttgttcactcacaagataaatgtgattctctactcaaagacttgttccagcatgggtatccatgtctgtcccttcatggcggcaaagaccagactgaccgtgaatcaactattgctgatttcaagagcaacgtctgcagcttgctgattgctactagcgttgctgctagaggtttagatgtaaaagaacttgaactggttgtcaattatgatgtccctaaccattatgaggactatgtccatcgggttggtagaacagggcgtgctggtagaaagggctttgccgtgacttttatttctgaggaggaggagcgatatgcaccagaccttgttaaggctctggaactctctgagcaggctgttccacaggacctaaaagccctggctgatagatttatggctaaggtgaaacagggaacagagcaggcccatggtacaggctatggtggtagtggtttcaagtttaatgaggaagaggatgaagcacggaagactgcaaagaaggctcaggcaagggaatatggttatgaagaggacaagtcagattcagattctgatgaggaagggggagtgcgtaaggcaggaggtgacctagcagcacaagctattgccaatgctcatgcagcagctgctttggttgcaaacaaggctgctaataatgttaatcagcaaataccaggatctgcgacagtccccttgattcctttactcgcagcaacaaaccaacaaaatgatgaggccactgctcgggcacttcaggctgcaatgaacttacaacaaaatctggctaggatacaggcccatgcggttccagaacactatgaggctgaacttgagattaatgatttcccacagaatgcccgttggaggatcactcacaaagagacactggcccctattcaggactggactggtgctgctatcactacaaggggaacatatattcctcaaggaaaaattgttggtgcaaatgagcgcaagctctacctgtttattgagggcccgacggagtcgtctgtgaagaaggcaaaagcagaattgaaacgtgtccttgaggattgtgccaaccaggcacttaatcttcctggatctgctcaaactggaaaatattctgttatttga

SEQ ID NO: 10884 - protein, 1062 aa, Sorghum bicolor
  misc_feature: Ceres ANNOT ID no. 6117845
  misc_feature (461)..(635): Pfam Id: DEAD Pfam Desc: DEAD/DEAH box helicase
  misc_feature (703)..(779): Pfam Id: Helicase_C Pfam Desc: Helicase conserved C-terminal domain
  misc_feature (154)..(734): NCBI GI: 143456125 NCBI Desc: dead-box atp-dependent rna helicase 45
  misc_feature (334)..(930): NCBI GI: 54643510 NCBI Desc: ga19457-pa [drosophila pseudoobscura]
  misc_feature (61)..(905): NCBI GI: 81890303 NCBI Desc: probable atp-dependent rna helicase ddx46 (dead box protein 46) (helicase of 117.4 kda)
  misc_feature (61)..(905): NCBI GI: 85540944 NCBI Desc: probable atp-dependent rna helicase ddx46 (dead box protein 46)
  misc_feature (53)..(905): NCBI GI: 40788370 NCBI Desc: kiaa0801 protein [homo sapiens]
MGSGDDERSTSKHHHRDKDKDRDRSSSRHHRDKERDRDRERERSSSRHHRDDGDRDRDRDRHHRDKERDREERKEREREERKAREREEREREKEKEKEKERARRREERDREERERSRRRGDADGEEDDDRDRKRRRRSSHHHHHHRDPEPASREEEEVDAEEAERRRQRKKEEDMEAEQQRLDDEMERRRRRVKEWQEKRREQQQQQDGGGAGGASAAAAAEADGVKVAGKKWTLDGEESDEEGDKEDGKKDEENGGAGDMDVDLPNGDGDANGGAGMEEDEIDPLDAFMNSMVLPEVAKLESAAAAMDTTAPGAGADDKNGKSSKDVVSNGDKKGSRKAIGRIMQGDDSESDYDDADDDGAGEDDEDDEEFIKRVKKTKAEKLAIVDHSKIDYQPFRKNFYIEVKDISKMTSEEVVEYRKHLELKVHGKDVPKPIKTWVQSGLTSKLLDTIKKLGFEKPMPIQTQALPIIMSGRDCIGIAKTGSGKTLAFVLPMLRHVKDQPPVVPGDGPIGLIMAPTRELVVQIHSDIKKFSKVLGINCVAIYGGSGVAQQISELKRGAEIVVCTPGRMIDILCTSSGKITNLRRVTFLVMDEADRMFDMGFEPQITRIVQNTRPDRQTVLFSATFPRQVEILARKVLTKPVEIQVGGRSVVNKDITQLVEVRPDTERFFRLLELLGEWYVKGKILVFVHSQDKCDSLLKDLFQHGYPCLSLHGGKDQTDRESTIADFKSNVCSLLIATSVAARGLDVKELELVVNYDVPNHYEDYVHRVGRTGRAGRKGFAVTFISEEEERYAPDLVKALELSEQAVPQDLKALADRFMAKVKQGTEQAHGTGYGGSGFKFNEEEDEARKTAKKAQAREYGYEEDKSDSDSDEEGGVRKAGGDLAAQAIANAHAAAALVANKAANNVNQQIPGSATVPLIPLLAATNQQNDEATARALQAAMNLQQNLARIQAHAVPEHYEAELEINDFPQNARWRITHKETLAPIQDWTGAAITTRGTYIPQGKIVGANERKLYLFIEGPTESSVKKAKAELKRVLEDCANQALNLPGSAQTGKYSVI

SEQ ID NO: 10885 - DNA, 825 bp, Sorghum bicolor
  misc_feature: Ceres ANNOT ID no. 6117860
  misc_feature: Encodes the peptide sequence at SEQ ID NO 10886
atggcgtgccggggcttcttcgagtgcgtcctcaagctgctcaacctcgtcgtcatggcggtcgggctcgctatggtgggctacggcgcctacctgctcgtgatgtggctgcaggtcgcgccgccgctcccgccgcccgcgccgtcgccggcgcccagcggcggcgacctcgtgcggctcgggaggccgctgctgctccttgtcgatgcgtccctgtcggactcggatgggaccgcggagaggctctccagtgcctggtttatttttgctttcattggtgtcggtgctatactcttcatcacatcgatctttggttgtgctggagctagaaatggatgctgcctgtctatttactcattcctcattattttgttcatactggtcgagcttggtgcaggaggcttcattttcttcaaccatagttggaaagaggtcatcccagttgacaaaactggaaactttgacatgatgtacagctttttgaaagagaattggagaattgcaaaatgggttgcacttggagctgttgtatttgaggcattgttgttcactgtggctatcatagtacagtcggggaatcaagctgattatgacagtgacgatgagtacatcggcgcaaggtctggaatacggcagccgttggtgaatcagcaagctgctgccactgatcctagggtgcccaatctcgactaccgcccaatccggaatgacgcatggagccaaagaatgagagaaaagtacggggtggacagctttgatccgaacaggtttcaacaggccacgatatctccaggagaacaaagaaaccgatgcaccattctctga

SEQ ID NO: 10886 - protein, 274 aa, Sorghum bicolor
  misc_feature: Ceres ANNOT ID no. 6117860
  misc_feature (6)..(179): Pfam Id: Tetraspannin Pfam Desc: Tetraspanin family
  misc_feature (1)..(274): NCBI GI: 37806153 NCBI Desc: senescence-associated protein-like [oryza sativa (japonica cultivar-group)]
  misc_feature (1)..(274): NCBI GI: 37806408 NCBI Desc: senescence-associated protein-like [oryza sativa (japonica cultivar-group)]
  misc_feature (1)..(274): NCBI GI: 140055385 NCBI Desc: cd9/cd37/cd63 antigen [medicago truncatula]
  misc_feature (117)..(274): NCBI GI: 8920615 NCBI Desc: contains similarity to gmfp4 from glycine max gbu64915. ests gbav442477, gbav441037, gbav534954, gbav560678 and gbav518757 come from this gene. [arabidopsis thaliana]
  misc_feature (82)..(264): NCBI GI: 54291569 NCBI Desc: senescence-associated protein-like [oryza sativa (japonica cultivar-group)]
MACRGFFECVLKLLNLVVMAVGLAMVGYGAYLLVMWLQVAPPLPPPAPSPAPSGGDLVRLGRPLLLLVDASLSDSDGTAERLSSAWFIFAFIGVGAILFITSIFGCAGARNGCCLSIYSFLIILFILVELGAGGFIFFNHSWKEVIPVDKTGNFDMMYSFLKENWRIAKWVALGAVVFEALLFTVAIIVQSGNQADYDSDDEYIGARSGIRQPLVNQQAAATDPRVPNLDYRPIRNDAWSQRMREKYGVDSFDPNRFQQATISPGEQRNRCTIL

SEQ ID NO: 10887 - DNA, 1374 bp, Sorghum bicolor
  misc_feature: Ceres ANNOT ID no. 6117861
  misc_feature: Encodes the peptide sequence at SEQ ID NO 10888
atgctagcaaccgcaggaggccgcgcggtgttccacctccgcccgcgcccgccatggcgagcccctcctcctcccgccaccacgcacctctcccactcagcgcccgcgaggcgcgccgaccaccatcgcctccccctaggttttttatcaactatggaagtggggatttcatcagtctacttgggtcagcgggcgcactctgcaacatgtagctattctttggatgataggttacagggagagctagatgatatgaatggagaacagagaaagcaagagacggtcggtgcatttcagaaaataccaatggtgatgcctgcaactgatatactaatgtcagcacaaaggaaatctagaaatgtgccaccgactaagggtatagcaaatattgctaagcgtgaaaggaacaaaggtgcgaaacagcttgatgccttaatgaaagaactttctgtaccgttgagaacatacacagaaaacttcccaaagaggagagatttgcatccttatgagaggtctctcattgagttgacctttggggagggttattatgagcaggttctaggacgtgtagatactctgaggaaaaggattacttctgttggaaagcaacatgcttcagtctgtgctaagtcaacaacaaaacgtgaagcagaggagcgcctcactgagggcagaaagaagcttgaagaggctttccagcatgggaagcatgctgttgatgatttagtaaatgtagcaaaggctttgcgttctatgcctgttgttgatctgcatattccaacactatgtctagttggatcacccaatgtggggaagtcatcattagtccgcatattatcatctggaaaacctgaggtctgcagctacccattcacaacaagagggattctaatgggtcacattgtatccaatcacgaacgttttcaggttacggacactccaggactcctgacgaggcatgatgatgacagaaataacatagagagattgacacttgctgtcctttcttatctacctatcgctgtcctgtatgtgcacgatctatctgaagactgtggcacctcagtggccgatcagtacatcacatacaagcatattaaggacagatttggcgatcgcctatggcttgatgttatatccaaatgcgatcttttaggaaagaaagagcccataagctttcacgatgccgatgatgtagcacagtacagaagattggggccagaaggcgccctccgagtatctgtgcagagtgaaatcggcgtcaaagagctaaaggaaagagtgcatgagctactgacctctcagatggctcggatcaaagctagcaaggcggagcatgaaacacaggaaattaggactagtgttgtttactga

SEQ ID NO: 10888 - protein, 457 aa, Sorghum bicolor
  misc_feature: Ceres ANNOT ID no. 6117861
  misc_feature (326)..(383): Pfam Id: NOG1 Pfam Desc: Nucleolar GTP-binding protein 1 (NOG1)
  misc_feature (260)..(383): Pfam Id: MMR_HSR1 Pfam Desc: GTPase of unknown function
  misc_feature (1)..(449): NCBI GI: 37806152 NCBI Desc: nucleolar gtp-binding protein 1-like [oryza sativa (japonica cultivar-group)]
  misc_feature (92)..(453): NCBI GI: 6503289 NCBI Desc: est gbai997445 comes from this gene. [arabidopsis thaliana]
  misc_feature (98)..(455): NCBI GI: 18977867 NCBI Desc: gtp-binding protein, gtp1/obg family [pyrococcus furiosus dsm 3638]
  misc_feature (98)..(455): NCBI GI: 119606933 NCBI Desc: gtp binding protein 4, isoform cra_b [homo sapiens]
  misc_feature (98)..(455): NCBI GI: 4191616 NCBI Desc: gtp-binding protein ngb [homo sapiens]
MLATAGGRAVFHLRPRPPWRAPPPPATTHLSHSAPARRADHHRLPLGFLSTMEVGISSVYLGQRAHSATCSYSLDDRLQGELDDMNGEQRKQETVGAFQKIPMVMPATDILMSAQRKSRNVPPTKGIANIAKRERNKGAKQLDALMKELSVPLRTYTENFPKRRDLHPYERSLIELTFGEGYYEQVLGRVDTLRKRITSVGKQHASVCAKSTTKREAEERLTEGRKKLEEAFQHGKHAVDDLVNVAKALRSMPVVDLHIPTLCLVGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYITYKHIKDRFGDRLWLDVISKCDLLGKKEPISFHDADDVAQYRRLGPEGALRVSVQSEIGVKELKERVHELLTSQMARIKASKAEHETQEIRTSVVY

SEQ ID NO: 10889 - DNA, 1344 bp, Sorghum bicolor
  misc_feature: Ceres ANNOT ID no. 6117878
  misc_feature: Encodes the peptide sequence at SEQ ID NO 10890
atggcttcgggtccacacaacaagggttggttgtccatccggacaaacacctctaaccaatcacattggtccaacgatgatggcacaccactaactgatgagatcatcctcttcatcttcacaagctttcttgagattgccgaccttgttcgctgcgctgctacctgcaagcgttggcgccacctagtgtcgggtcatgccaacttcatttgtcggacctcacaacagctatgcttcatcaacaaattcattccctcgctcattgtcggattctttcacaagcatgatgccactatgctaaacttcatccccatggcttctgcgtcacgtcggttcccattcctccacaagccatcactatcattggccatgaacatcgacaatgagcttttgaactcatctcacattgtggcctctaggaatggcctccttgtcattgaagtccaacgtggcaaacatagtaggactctcaagctctgtgtctgcaaccccatgagtggcgaggtccatgtattaccagccctaaggggtaaggatggtcttggacactatgcctgcacggtgctcaccactgtcgactatcaaaacatgaacaggaacaacaactcacagcctccattgtcctctcactaccacttgatcatagtgtatagtcggctccacttcacagcatttcggagctactcatctaaggatggcatatggagaccagagggcaaggtgactggagcccagcttggcaaaaaccaaatacgactaatgcgcaatggtgtgatcgcctatggtggacaggtagcatattggataacaatagacctcgtgtttgggctacacctcaacacattagatgccacaatgataagattgccttggtcaagaggcaacaccttcatcgacacaaagaatatattgctgggcacgacaccaaagggtaggctttgtgctatccagtttagcaagaattggtccttatcgatgcatggtaagtgggaaccaacaaatgaaatacatgtaattacctacgacaacaatggcagtaccaacaacaatatgctgcaaatgagcaattcgttatggaagacaaagatcaatatccaaatagaccaagctttgaaagttgatgcgcttgcaatggaggtaaagctacaatggttttgtgagaagagtggggtcgtgttctttactatcagctactatggtaaaccgagaagtgaggtgtatgctctgaacttaggcacaagaatgattgagaaggtggcaagcaacaccagctgcaatgacttgtggaacaacttttatggctatgagatggatcatgcctcgtatctgacaaccctcacttag

SEQ ID NO: 10890 - protein, 447 aa, Sorghum bicolor
  misc_feature: Ceres ANNOT ID no. 6117878
MASGPHNKGWLSIRTNTSNQSHWSNDDGTPLTDEIILFIFTSFLEIADLVRCAATCKRWRHLVSGHANFICRTSQQLCFINKFIPSLIVGFFHKHDATMLNFIPMASASRRFPFLHKPSLSLAMNIDNELLNSSHIVASRNGLLVIEVQRGKHSRTLKLCVCNPMSGEVHVLPALRGKDGLGHYACTVLTTVDYQNMNRNNNSQPPLSSHYHLIIVYSRLHFTAFRSYSSKDGIWRPEGKVTGAQLGKNQIRLMRNGVIAYGGQVAYWITIDLVFGLHLNTLDATMIRLPWSRGNTFIDTKNILLGTTPKGRLCAIQFSKNWSLSMHGKWEPTNEIHVITYDNNGSTNNNMLQMSNSLWKTKINIQIDQALKVDALAMEVKLQWFCEKSGVVFFTISYYGKPRSEVYALNLGTRMIEKVASNTSCNDLWNNFYGYEMDHASYLTTLT

SEQ ID NO: 10891 - DNA, 1383 bp, Sorghum bicolor
  misc_feature: Ceres ANNOT ID no. 6117890
  misc_feature: Encodes the peptide sequence at SEQ ID NO 10892
atgccgccggcgcggcgaccccgcgtttcgtcgcggctaccgtccacttcttccgctgcggcggcggatgggcgtggcggcaaaggatggctttccaccctccgccgtgaccccgccaaacgtccgcgccgtgcggacgacgagggcacgccgctcaacgacgaggtcctcctcgtcatcttcgccggcgtgcacaacctcgctgatctcgtccgctgcgccgccacctgccggcgctggcgtcgcctggtgtccaccgaagccgccttcctctgccgcactcctcggctcgtgcccgccaggttcatcggccccctcgcgctcggcttcttccaccaccgggtcgacgcagcgccgggcttcgtcgccatggcctccgcgttgcgccgcttccccgggctcctccaggacccgccgccgtctctgggcgcgctcgacgacaacggcctgttcgacggttcttcccgcatcgtggcagccaggaacggtctcctcgtcgttgacatccggcacgggaagcagaacagggcactcaagctttgcgtctgcaaccccatgacaggcgaagtgcacgttctgccacccctggcaggcaaggatggcctcgggcactactcgtgcacggtcctcacagccgaggaccgtgatgacaagaccacagacccaccgccgccaccgtcttacttccgcctggtcatggtgtacactcgacgtggcttcactgcattccggagctactcatcggacgaaggcagctggagtgaggaggcaaaggtgaccggctctaggctcggcaagaaacagatgggcttgacacacagtggagtcgtgagccgtgatggcaagctagtgtactggatggccaagaacgtggtacttgttcttagcctcaacaagctgcagtccatgctgggaagcatgcctcggtctggaaacggacagatctttgacatgaaaaacaccttgctgggtttgtcaccaaagggtcggctctgtgctgtccagtttgacccacttccagttccagcacgaatgaaggctgatcgcatctccatacgcataaccaactgcaccaccgaccgtcggtggtttgatgagatcgaatcgatccaggtaggacaatccttgcctgatgatgtgatcagtttgaagctgaagtggttctgttggaagagtgggatcgtgttcttcactgccgtcgctggggacagtgggcaccagagaagggaggtgtatgctctgagcctcaacacacgggtggttgagaagctagcatgccacgacggtgtcagtgatccgtgggagggccttcatgggtatgagattgatcaggtggcatacctggcatcccttgctgagcctgatagcctggaggatatgtga

SEQ ID NO: 10892 - protein, 460 aa, Sorghum bicolor
  misc_feature: Ceres ANNOT ID no. 6117890
MPPARRPRVSSRLPSTSSAAAADGRGGKGWLSTLRRDPAKRPRRADDEGTPLNDEVLLVIFAGVHNLADLVRCAATCRRWRRLVSTEAAFLCRTPRLVPARFIGPLALGFFHHRVDAAPGFVAMASALRRFPGLLQDPPPSLGALDDNGLFDGSSRIVAARNGLLVVDIRHGKQNRALKLCVCNPMTGEVHVLPPLAGKDGLGHYSCTVLTAEDRDDKTTDPPPPPSYFRLVMVYTRRGFTAFRSYSSDEGSWSEEAKVTGSRLGKKQMGLTHSGVVSRDGKLVYWMAKNVVLVLSLNKLQSMLGSMPRSGNGQIFDMKNTLLGLSPKGRLCAVQFDPLPVPARMKADRISIRITNCTTDRRWFDEIESIQVGQSLPDDVISLKLKWFCWKSGIVFFTAVAGDSGHQRREVYALSLNTRVVEKLACHDGVSDPWEGLHGYEIDQVAYLASLAEPDSLEDM

SEQ ID NO: 10893 - DNA, 1191 bp, Sorghum bicolor
  misc_feature: Ceres ANNOT ID no. 6117892
  misc_feature: Encodes the peptide sequence at SEQ ID NO 10894
atggcaagcctactccggcgatccgcggcacccgcgcgccagctcctcctcctcccgcgccacctcgccgccgcgggcggctccgcccccgcctcgtcccgctccttctcccgcttccacccgcgcgacgacagctccatgttcgacccgccggagccgccggtgaactggggcgtgagcatagtcccggagaagaaggctttcgtcatcgagaggttcgggaagtatctcaagacgctcggctccgggttccacctcctgatccccgccgtcgaccgtatcgcctacgtgcactcgctcaaggaggagaccatccccatcccccaccagaacgccatcaccaaggacaacgtcaccatacagatcgacagcgtcatctatgtcaagatcatggacccctaccttgcttcctatggtgtggagaatccaatctatgctgtcctacaacttgcacaaacaaccatgagaagtgaacttgggaagataaccttagacaagacttttgaggagagagatgcattaaatgagaaaattgtgagtgccatcaatgaagcagccacagattggggcctgaagtgtatccgctatgagatcagggacattactcctccaatagggattaagcaggctatggagatgcaggctgaagcagaaaggagaaaacgcgcccaaatccttgaatcggaagggaagaaacaagcccaaatccttgaatcggaagggaagaaaactgcccagatccttgaatctgaaggagctatgttggatctagcaaaccgtgcgaagggtgcggccgaagcaattcttgccaagtcggaagctactgctcgcggaatgagattggtttcagatgcgatgacaactgaaggcagtgccaaggctgctagcctaaaacttgcagagcaatacatcgaagcattctcaaatctggcacaaaagacaaatacaatgctccttccaggcgacagtgccagcccagcatcttttgtggcccaggcgatgaagacgtatgagcatatccattcccacaaccaggcattaaagagccacccccagatacaagagctggaggaatcaggagagaccagtcctgctgccccatcttctgaggcgagcacgatgccaccactcattgaggatgcagactctaaccagaccttcacgctgcaacgccccaagaacaagaagtga

SEQ ID NO: 10894 - protein, 396 aa, Sorghum bicolor
  misc_feature: Ceres ANNOT ID no. 6117892
  misc_feature (60)..(232): Pfam Id: Band_7 Pfam Desc: SPFH domain / Band 7 family
  misc_feature (1)..(396): NCBI GI: 7716464 NCBI Desc: stomatin-like protein [zea mays]
  misc_feature (32)..(395): NCBI GI: 144923133 NCBI Desc: stomatin [medicago truncatula]
  misc_feature (10)..(338): NCBI GI: 21554125 NCBI Desc: stomatin-like protein [arabidopsis thaliana]
  misc_feature (59)..(348): NCBI GI: 42453588 NCBI Desc: cog0330: membrane protease subunits, stomatin/prohibitin homologs [rickettsia rickettsii]
  misc_feature (54)..(359): NCBI GI: 41054125 NCBI Desc: similar to stomatin (epb7.2)-like 2 [danio rerio]
MASLLRRSAAPARQLLLLPRHLAAAGGSAPASSRSFSRFHPRDDSSMFDPPEPPVNWGVSIVPEKKAFVIERFGKYLKTLGSGFHLLIPAVDRIAYVHSLKEETIPIPHQNAITKDNVTIQIDSVIYVKIMDPYLASYGVENPIYAVLQLAQTTMRSELGKITLDKTFEERDALNEKIVSAINEAATDWGLKCIRYEIRDITPPIGIKQAMEMQAEAERRKRAQILESEGKKQAQILESEGKKTAQILESEGAMLDLANRAKGAAEAILAKSEATARGMRLVSDAMTTEGSAKAASLKLAEQYIEAFSNLAQKTNTMLLPGDSASPASFVAQAMKTYEHIHSHNQALKSHPQIQELEESGETSPAAPSSEASTMPPLIEDADSNQTFTLQRPKNKK

SEQ ID NO: 10895 - DNA, 1641 bp, Sorghum bicolor
  misc_feature: Ceres ANNOT ID no. 6117896
  misc_feature: Encodes the peptide sequence at SEQ ID NO 10896
atgacgacgatgaacacgatggtagctgcggcagcccttgctctccatctctttgcagtttcagccacacgcgccagcaccactcagtcgtcgtcaccaccaccacaaccaccagcatcagcagtagacatctcctcctgcctgctctccaatggcgtcgccaacttctccctcccatcatccccaagctacacgccgctcctcaactcctccatccggaacctccgcttcgcgctcccaagcgtcggcaagccggccgccgtcgttctcccggccaccaagcgcgacatccagcacgccgtcctctgcgcgcgcagcacctcgctggcgatccgcgtgcgcagcggcgggcacagctacgagggcctctcctacacgacggagaaccacgtccccttcatggtgatcgacctcgccaacctgaaccacgtcgacgtcgacccggtctccgccacggcctgggtcgagtccggcgcgacgctgggcgaggtctaccacgcggtggggctgtcgaacaggaccctcgccttctccgccggctcctgcgcgacggtcggcatgggcgggcacgccgccggcggcggcttcggcctgctgtcgaggaagttcgggctctccgccgacaacgtcctggacgccgtcctcatcgacgcgagcggcgacgcgctcacccgtgccaccatgcccgacgacgtgttctgggccatccgcggcggcggcggaggcagctggggcgtggtgtacgcgtggaaggtccgcctcgtcccggtccccgacaacatcaccgtgttcaccgtccgccggaccggccccgccgagctcatcgccgggctgatgcacaggtggcagtacgtggcgccgagcctccccgacgagttctacctctcggcgtacattcccactggtccatcatccaacggcaaccactccatctccttcaccggccaagttctccggccgaagcgtcttgccatgtcggtgctgtgccagaccttcccggagctggggctcgccgagtcggagctctccgaggtgagctggctggagtcggcggtgaagttcgccggcctgagcaccgtcgccaacctcacgagccgtcagcccggagttggacagtactcgaagagcaagtccgactacgtccaggcgccgatctcgaagcaggacgcggtgaagatcctgcggttcatggcgactgcagggtcgccggcgccggagggggccatccagttggatccctacggcggtgccatggcgaggatcgggagcaccatgacgcctttccctcaccgtgctgggtacctgtacagcatccagtatagcgtctcgtggaaagcgtcggatgtggattgtgcggacgagtacgtcggatggctacggtcgttctacgatttcatggcgccttacgtgacgaaaaacccacgggctgcgtatgtgaactacttggaccttgatttgggcaccaatggttggatgaacgcgaccggtggaacgtcgtatggctctgtgggacatgcggcgtcgtcatggggccaacgatatttcttggcgaactttggcaggttggttagggccaagactaaggttgatccggaaaatgtgttcaataatgcacaaagtattcctcctttatactcgtaa

SEQ ID NO: 10896 - protein, 546 aa, Sorghum bicolor
  misc_feature: Ceres ANNOT ID no. 6117896
  misc_feature (85)..(226): Pfam Id: FAD_binding_4 Pfam Desc: FAD binding domain
  misc_feature (477)..(542): Pfam Id: BBE Pfam Desc: Berberine and berberine like
  misc_feature (17)..(544): NCBI GI: 115475998 NCBI Desc: os08g0343600 [oryza sativa (japonica cultivar-group)]
  misc_feature (44)..(544): NCBI GI: 3282517 NCBI Desc: berberine bridge enzyme [papaver somniferum]
  misc_feature (42)..(544): NCBI GI: 4335857 NCBI Desc: berberine bridge enzyme [berberis stolonifera]
  misc_feature (43)..(544): NCBI GI: 2897944 NCBI Desc: berberine bridge enzyme [eschscholzia californica]
  misc_feature (43)..(544): NCBI GI: 51980210 NCBI Desc: berberine bridge enzyme; bbe [thalictrum flavum subsp. glaucum]
MTTMNTMVAAAALALHLFAVSATRASTTQSSSPPPQPPASAVDISSCLLSNGVANFSLPSSPSYTPLLNSSIRNLRFALPSVGKPAAVVLPATKRDIQHAVLCARSTSLAIRVRSGGHSYEGLSYTTENHVPFMVIDLANLNHVDVDPVSATAWVESGATLGEVYHAVGLSNRTLAFSAGSCATVGMGGHAAGGGFGLLSRKFGLSADNVLDAVLIDASGDALTRATMPDDVFWAIRGGGGGSWGVVYAWKVRLVPVPDNITVFTVRRTGPAELIAGLMHRWQYVAPSLPDEFYLSAYIPTGPSSNGNHSISFTGQVLRPKRLAMSVLCQTFPELGLAESELSEVSWLESAVKFAGLSTVANLTSRQPGVGQYSKSKSDYVQAPISKQDAVKILRFMATAGSPAPEGAIQLDPYGGAMARIGSTMTPFPHRAGYLYSIQYSVSWKASDVDCADEYVGWLRSFYDFMAPYVTKNPRAAYVNYLDLDLGTNGWMNATGGTSYGSVGHAASSWGQRYFLANFGRLVRAKTKVDPENVFNNAQSIPPLYS

SEQ ID NO: 10897 - DNA, 1680 bp, Sorghum bicolor
  misc_feature: Ceres ANNOT ID no. 6117898
  misc_feature: Encodes the peptide sequence at SEQ ID NO 10898
atgagctgctccattgcagctctcctggtcctggtttccctcttccttccactccatcaaagcacatcatcgtgctatgctgccggcgccgacgatggcgcagcagcacacagcctctcctcctgcctcctctcccacggcgtcaacaacttcaccctccggacgtctccaagctacgccgcgatcctcaactcctccatcagcaacctccgcttcgcgctcccggacgtcggcaagccggccgccgtggtgctcccggcctccaagcgggacctccagcgcgccgtcgtctgcgcgcgggaaagctcgctggcgatccgcgtgcgcagcggcgggcacagctacgagggcctctcctacacgacggagaaccacgtccccttcgtggtgatcgacgtcgccaacctgaaccgggtccgcgtcgaccggggctcggccacggcctgggccgagtccggcgcgacgctaggcgagctctactacgccgtgggacggtccagccggtcgctggcgttctcggccgggtcctgctcgaccatcggcctgggcggcatcgtctccggcggcggcttcgggctgctgtcccggaagttcgggctcgccgccgacaacgtgctggacgcggtgctcgtcgacgccgacggcagggtgctcgaccggaccaccatgggcgccgacgtgttctgggccatccgaggcggcggcggcgggagctggggcgtggtgtacgcctggaagctccggcttgtccccgtcccgcgcaacgtcaccgtgttctctgtcggccggaccggtccggtcgacctcgtcgccgggctgatccacaggtggcagttcgtggcgcccagtctccccgacgacttctacctctccgtgtacctcccgaccggcggcctccggtcgtcgtcgtcgtcgtcggatggcaacgtgtccgtctcgttctccgggcaggttcttggaccaaagcaccgtgccctgtcggcgctgcgtcagagcttcccagagctcggcctgaccgagtcagagctcgccgaaacgagctggctggaggcgaccgcgcagttcgccggcctcgacacggcggccgaccttccgaaccgcctgctggggcggtcgaagcagtactccaagggcaagtccgactacgtgcggtcgccgatctcgcggcgcgccatggcgggcatcgtccggtacctctccacggggccaccgcggcagggccaggggcaggggcagggcggcgggtacgtgatcctggacccctacggcggcgccatggcccggatcgggagcggcgacacgccgtgcccgcaccgcgccgggaccctgtacggcgtgcagtaccaggtgtactgggacgaggacgacggcgacctcggtggccgcgccgccgccgccggcgagttctgcgtggggtggctccggtcgctctacgcgttcatggcgccccacgtgtccaaggacccccgcgccgcgtacgtcaactacctggaccttgacctcggcgccgacaactggacagcaccggcgggagggtcgtcggaggcggcggtggcgcgcgcgcgctcgtcgtggggcgccgcctacttcggggacaattttgaccggctcgtcagggcaaagacgttggcggaccccggcaatgtgttcaacaatgcacaaagcattcctcctttgtag

SEQ ID NO: 10898 - protein, 559 aa, Sorghum bicolor
  misc_feature: Ceres ANNOT ID no. 6117898
  misc_feature (80)..(221): Pfam Id: FAD_binding_4 Pfam Desc: FAD binding domain
  misc_feature (492)..(557): Pfam Id: BBE Pfam Desc: Berberine and berberine like
  misc_feature (9)..(559): NCBI GI: 115475998 NCBI Desc: os08g0343600 [oryza sativa (japonica cultivar-group)]
  misc_feature (38)..(414): NCBI GI: 4335857 NCBI Desc: berberine bridge enzyme [berberis stolonifera]
  misc_feature (39)..(403): NCBI GI: 3282517 NCBI Desc: berberine bridge enzyme [papaver somniferum]
  misc_feature (37)..(403): NCBI GI: 2897944 NCBI Desc: berberine bridge enzyme [eschscholzia californica]
  misc_feature (39)..(414): NCBI GI: 51980210 NCBI Desc: berberine bridge enzyme; bbe [thalictrum flavum subsp. glaucum]
MSCSIAALLVLVSLFLPLHQSTSSCYAAGADDGAAAHSLSSCLLSHGVNNFTLRTSPSYAAILNSSISNLRFALPDVGKPAAVVLPASKRDLQRAVVCARESSLAIRVRSGGHSYEGLSYTTENHVPFVVIDVANLNRVRVDRGSATAWAESGATLGELYYAVGRSSRSLAFSAGSCSTIGLGGIVSGGGFGLLSRKFGLAADNVLDAVLVDADGRVLDRTTMGADVFWAIRGGGGGSWGVVYAWKLRLVPVPRNVTVFSVGRTGPVDLVAGLIHRWQFVAPSLPDDFYLSVYLPTGGLRSSSSSSDGNVSVSFSGQVLGPKHRALSALRQSFPELGLTESELAETSWLEATAQFAGLDTAADLPNRLLGRSKQYSKGKSDYVRSPISRRAMAGIVRYLSTGPPRQGQGQGQGGGYVILDPYGGAMARIGSGDTPCPHRAGTLYGVQYQVYWDEDDGDLGGRAAAAGEFCVGWLRSLYAFMAPHVSKDPRAAYVNYLDLDLGADNWTAPAGGSSEAAVARARSSWGAAYFGDNFDRLVRAKTLADPGNVFNNAQSIPPL

SEQ ID NO: 10899 - DNA, 2151 bp, Sorghum bicolor
  misc_feature: Ceres ANNOT ID no. 6117908
  misc_feature: Encodes the peptide sequence at SEQ ID NO 10900
atggaggtgaattcctctggtgaggaaatggtggtcaaggtaagaaagccatacacaatcacaaagcagcgggagcggtggacagaggctgagcacaaacggttccttgaagccttgaaactttatggcagagcatggcagcgtatagaagagcatgttgggacaaagacggccgtgcagatcagaagtcacgctcaaaagttcttcaccaagttggaaaaggaagctatgaccaatggtacttctccggggcaagcccttgacattgacatacctccaccacggcctaaaagaaagcctaacaatccatatcctcgaaaaagtggtctcagctctgagacaccaaccaaagattttccaaatgacaagtcagcaaaaccaaatatgcccttgagcaatggaaatgtacaaatggcaggtgatgcatctcttcagaaatttcaaaggaaggagttgtctgaaaaaggaagttgctcagaagttcttaatctcttccgtgatgccccatctgcgtcattttcttcagttaacaaaagctcttcaaatcatggtgcacccaggggggtcgaggcaagtaaaacagaaatccgagatatgaccatcatggaaaataattctcttaaccccaacatgcaagaggatgtaaaggagatcagcgatcatgaaatggaaaggcttaatagtatccaaatcagctctaaatgtgaacattctcacgagggatatttggatctctcaatgcaacaaatgaagctaaagccaaaatctgtggagacaacatatgtggacaaacaaactgcaagagcttcgcactccctagcggagaaaaatgggacagctagcattctggtcactgcaactgaaggaactcattctgatcaaacaagtgatcaagtgggaatcaatggaagcattaacccatgcatccatccaatgctttcttcagatccaaaatttgatagcagtgccacaccacagcattttcctcataattatgctgcctttgctccaatgatgcagggcaactgcaaccaagatacctacaggtcattcgtcaatatgtcatccaccttctccagcatgcttgtttccacgttgttgtcaaaccctgccatccatgcagctgccaggctcgcagcatcatactggccagcagctgaaggtaacacacttatcgatccaaatcaagaaaatcctgcagatgatgttcaaggaaggaacataggctctcctccaagcatggcttctattgtagcagctacagttgctgcagcatctgcatggtgggcaacacaaggtcttctccctttcttcactccacccatggcttttccatttgtaccagctcctagtgctgcctttcccacagttgatgttccaagaccttcagagaaagacagagatttcccagttgaaaatgcacagaaggaatgccaagaagctcaaaaacagggacaatttgaaggtttaagagttgctgcttcttcagtgtctgatgggagtggaaaaggcgaggtgtctctccacacagagttaaagatatctcctgtccagaatgctgatgcaacacctaccacaggagctgatacaagtgatgcattcaggaataagaaaaagcaggatcgctcttcatgtggttctaacacaccttcaagtagtgatgttgatgcagacaatgttcctgagaaggaggacaatgctaatgagaaggtgaagcaagcctcctgcagcaactcttcagctggtgacactaaccaccgcagatttagaagcagtggaagcactagtgattcatggaaggagggtcgtctggctttcgatgcgctgttcagtagagaaaagcttccgcaaagcttttctcccccacaagcagaagactcgaaggaggttgccaaggaggaagaaaatgaagtgactacagtggcagttgacctcaacaagaacgccacaagcattgatcatgacctcgacacaatggatgagccaagggcttcctttcccaatgaattgtcgcacctgaagctgaaatcgcgccgaacaggcttcaagccatacaagagatgttctgtggaagcgaaggagaatagggtgccggctagtgacgaggttggtaccaagaggattcgtcttgagagcgaagcatccacataa

SEQ ID NO: 10900 - protein, 716 aa, Sorghum bicolor
  misc_feature: Ceres ANNOT ID no. 6117908
  misc_feature (24)..(69): Pfam Id: Myb_DNA-binding Pfam Desc: Myb-like DNA-binding domain
  misc_feature (1)..(716): NCBI GI: 115474871 NCBI Desc: os08g0157600 [oryza sativa (japonica cultivar-group)]
  misc_feature (1)..(601): NCBI GI: 38455772 NCBI Desc: circadian oscillator component [oryza sativa (japonica cultivar-group)]
  misc_feature (1)..(716): NCBI GI: 21213868 NCBI Desc: lhy protein [phaseolus vulgaris]
  misc_feature (248)..(568): NCBI GI: 88174516 NCBI Desc: circadian oscillator component [oryza nivara]
  misc_feature (248)..(568): NCBI GI: 63108750 NCBI Desc: coc1 [oryza sativa (japonica cultivar-group)]
  misc_feature: The sequence is a functional homolog of SEQ ID NO 1067 in the 11/479,226US patent application
  misc_feature: The sequence is a functional homolog of SEQ ID NO 1096 in the 10/225,066US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 128 in the 10/412,699US patent application
  misc_feature: The sequence is a functional homolog of SEQ ID NO 146 in the 10/374,780US patent application
  misc_feature: The sequence is a functional homolog of SEQ ID NO 1744 in the 10/412,699US patent application
  misc_feature: The sequence is a functional homolog of SEQ ID NO 18 in the 10/412,699US patent application
  misc_feature: The sequence is a functional homolog of SEQ ID NO 1806 in the 10/412,699US patent application
  misc_feature: The sequence is a functional homolog of SEQ ID NO 2 in the 10/374,780US patent application
  misc_feature: The sequence is a functional homolog of SEQ ID NO 254 in the 11/375,241US patent application
  misc_feature: The sequence is a functional homolog of SEQ ID NO 303 in the 11/479,226US patent application
  misc_feature: The sequence is a functional homolog of SEQ ID NO 34 in the 11/375,241US patent application
  misc_feature: The sequence is a functional homolog of SEQ ID NO 36 in the 10/374,780US patent application
  misc_feature: The sequence is a functional homolog of SEQ ID NO 464 in the 10/412,699US patent application
  misc_feature: The sequence is a functional homolog of SEQ ID NO 464 in the 11/435,388US patent application
  misc_feature: The sequence is a functional homolog of SEQ ID NO 794 in the 10/225,066US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 128 in the 20040045049 US patent application
  misc_feature: The sequence is a functional homolog of SEQ ID NO 18 in the 20040045049 US patent application
  misc_feature: The sequence is a functional homolog of SEQ ID NO 1806 in the 20040045049 US patent application
  misc_feature: The sequence is a functional homolog of SEQ ID NO. 514 in the 11/188,298 US application
MEVNSSGEEMVVKVRKPYTITKQRERWTEAEHKRFLEALKLYGRAWQRIEEHVGTKTAVQIRSHAQKFFTKLEKEAMTNGTSPGQALDIDIPPPRPKRKPNNPYPRKSGLSSETPTKDFPNDKSAKPNMPLSNGNVQMAGDASLQKFQRKELSEKGSCSEVLNLFRDAPSASFSSVNKSSSNHGAPRGVEASKTEIRDMTIMENNSLNPNMQEDVKEISDHEMERLNSIQISSKCEHSHEGYLDLSMQQMKLKPKSVETTYVDKQTARASHSLAEKNGTASILVTATEGTHSDQTSDQVGINGSINPCIHPMLSSDPKFDSSATPQHFPHNYAAFAPMMQGNCNQDTYRSFVNMSSTFSSMLVSTLLSNPAIHAAARLAASYWPAAEGNTLIDPNQENPADDVQGRNIGSPPSMASIVAATVAAASAWWATQGLLPFFTPPMAFPFVPAPSAAFPTVDVPRPSEKDRDFPVENAQKECQEAQKQGQFEGLRVAASSVSDGSGKGEVSLHTELKISPVQNADATPTTGADTSDAFRNKKKQDRSSCGSNTPSSSDVDADNVPEKEDNANEKVKQASCSNSSAGDTNHRRFRSSGSTSDSWKEGRLAFDALFSREKLPQSFSPPQAEDSKEVAKEEENEVTTVAVDLNKNATSIDHDLDTMDEPRASFPNELSHLKLKSRRTGFKPYKRCSVEAKENRVPASDEVGTKRIRLESEAST

SEQ ID NO: 10901 - DNA, 570 bp, Sorghum bicolor
  misc_feature: Ceres ANNOT ID no. 6117924
  misc_feature: Encodes the peptide sequence at SEQ ID NO 10902
atggggttcccgtcggtgtgctactgcgtgatcctgccgcagccgctgatcctggtgctgcagctgctggacttcctccggcacgccgtgctgctgtgcctgtcctcgctgggcctcgcggcgtcgccggccgccgacgaccacccggcctactacgcggccccgccggcgccggccgacctctgggcgctgcagccgtcgtcgtcgtccctgctgctgctgcaggcgggggcggcgcccctgcaggaggcgcccacgccggccgccatcaaggcccggctccccgccgtccggtacgccgacctcctcaggtcccgccgcgcatccgcgtcgccgccggccccggtcccggccgtgtgcgcggtgtgcctgggcgcgctcgaggcgcggcaccgcgtccgggagctcggcaactgcgcgcacgccttccacaaggcctgcatcgacaagtgggtcgacaagggccaggccacctgcccgctctgccgcgccctcctcctccccgacccctccagcgccggcgccggcgacaccgtcggcgagctcgcctcctcccccttctccttctga

SEQ ID NO: 10902 - protein, 189 aa, Sorghum bicolor
  misc_feature: Ceres ANNOT ID no. 6117924
  misc_feature (120)..(162): Pfam Id: zf-C3HC4 Pfam Desc: Zinc finger, C3HC4 type (RING finger)
  misc_feature (1)..(189): NCBI GI: 32488512 NCBI Desc: osjnba0011j08.19 [oryza sativa (japonica cultivar-group)]
  misc_feature (85)..(168): NCBI GI: 87162911 NCBI Desc: zinc finger, ring-type; ringv [medicago truncatula]
  misc_feature (68)..(170): NCBI GI: 20160754 NCBI Desc: p0503c12.20 [oryza sativa (japonica cultivar-group)]
  misc_feature (1)..(169): NCBI GI: 21554155 NCBI Desc: ring zinc finger protein-like [arabidopsis thaliana]
  misc_feature (80)..(169): NCBI GI: 72536737 NCBI Desc: at1g63840-like protein [arabidopsis lyrata]
  misc_feature: The sequence is a functional homolog of SEQ ID NO 270 in the 10/666,642US patent application
  misc_feature: The sequence is a functional homolog of SEQ ID NO 874 in the 11/435,388US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13260
  misc_feature: The sequence is a functional homolog of SEQ ID NO 874 in the 20060272060 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
MGFPSVCYCVILPQPLILVLQLLDFLRHAVLLCLSSLGLAASPAADDHPAYYAAPPAPADLWALQPSSSSLLLLQAGAAPLQEAPTPAAIKARLPAVRYADLLRSRRASASPPAPVPAVCAVCLGALEARHRVRELGNCAHAFHKACIDKWVDKGQATCPLCRALLLPDPSSAGAGDTVGELASSPFSF

SEQ ID NO: 10903 - DNA, 1134 bp, Sorghum bicolor
  misc_feature: Ceres ANNOT ID no. 6117930
  misc_feature: Encodes the peptide sequence at SEQ ID NO 10904
atggcggaggcgaacgtggcagcggcgtcgctcttcggcgctgacagccgcctctgctccgctgacatcctcgcgccgcctgaggtccgggcaaggatcgaggtggccgtgctcaacttcctcgccgcgctcgcctccccttcctcgccggccatctccgtcctccccctgatcagccggagctctgctaactgcagcctccgcagcgggttgctgaacgacgtttcgtcggtttatctctcgcacaccttctgcaagaggtctctgatgcacaatccaaaggcgtttgtcatggagatgtgctacaagatcttgggggaggggaagctggtccaccaacgcgagttgttctacaagctcctgtcggactcacccaagtacttcagctgtcaacgtcatgtcaaccaagccattcaagatgttgtttccttgctccggtgtacaaggcagagcctaggagtcatggcatcaagcagaggggcactgattgggcgccttgtgctgcatgagccagatgaagaacagattgactgctccattcttggagcttcagggcatgcaattacaggggacctgaacctgttgagcaaactaaatttgtcttcagatgctcggtatatcattgtggtggagaaggatgccatatttcagaggctggctgaagaccgcctgtataatcagctcccttgtatcctgatcactgcaaagggatatcctgatattgccacaaggtttatcttgcatcggctgagccagacatttccgaatatgccgattttcgcattagtggattggaacccagcaggacttgctataatgtgcacttacaaatatggaagcatatcaatgggtctggagtcatacagatatgcgtgcaacgtgaaatggcttgggatgagaggagatgatctgcagcttatccccgagagtgcgtttcaagtgctgaagccacgtgatttgcagattgccaaaagcttgctgtcatcaaagttcctacaggagagtcacagagctgagctgacactgatggtggagaagggcaagcgtgcagacatcgaagctctctactcccacgggttcgattacctggggaagtacatcgcgagaaagattgtacagggcgattacatctga

SEQ ID NO: 10904 - protein, 377 aa, Sorghum bicolor
  misc_feature: Ceres ANNOT ID no. 6117930
  misc_feature (92)..(155): Pfam Id: TP6A_N Pfam Desc: Type IIB DNA topoisomerase
  misc_feature (1)..(377): NCBI GI: 53125146 NCBI Desc: topoisomerase 6 subunit a [oryza sativa (indica cultivar-group)]
  misc_feature (266)..(377): NCBI GI: 6692104 NCBI Desc: f22c12.24 [arabidopsis thaliana]
  misc_feature (95)..(377): NCBI GI: 115452329 NCBI Desc: os03g0284800 [oryza sativa (japonica cultivar-group)]
  misc_feature (95)..(377): NCBI GI: 53127616 NCBI Desc: topoisomerase vi subunit a [oryza sativa (indica cultivar-group)]
  misc_feature (3)..(377): NCBI GI: 119595933 NCBI Desc: spo11 meiotic protein covalently bound to dsb-like (s. cerevisiae), isoform cra_b [homo sapiens]
MAEANVAAASLFGADSRLCSADILAPPEVRARIEVAVLNFLAALASPSSPAISVLPLISRSSANCSLRSGLLNDVSSVYLSHTFCKRSLMHNPKAFVMEMCYKILGEGKLVHQRELFYKLLSDSPKYFSCQRHVNQAIQDVVSLLRCTRQSLGVMASSRGALIGRLVLHEPDEEQIDCSILGASGHAITGDLNLLSKLNLSSDARYIIVVEKDAIFQRLAEDRLYNQLPCILITAKGYPDIATRFILHRLSQTFPNMPIFALVDWNPAGLAIMCTYKYGSISMGLESYRYACNVKWLGMRGDDLQLIPESAFQVLKPRDLQIAKSLLSSKFLQESHRAELTLMVEKGKRADIEALYSHGFDYLGKYIARKIVQGDYI

SEQ ID NO: 10905 - DNA, 735 bp, Sorghum bicolor
  misc_feature: Ceres ANNOT ID no. 6117936
  misc_feature: Encodes the peptide sequence at SEQ ID NO 10906
atggccacccccgcccctgccaccgccggcgagctcctacgcgtggaacccctcgagctacgcttccccttcgagttgaataagcagatctcgtgctccatgcagctgtcgaatcacaccaacgactacatcgccttcaaggtgaaaactacaagtccaaagaagtattcagtgcggcccaacactggggttgtcttgccacggtctacctgtgatgttgttgttacgatgcaagcacagcggctagctccgccagacatgcagtgcaaagataagttcctagtccaaagcatcgttgccccttctggtataactgtgaaggatgtcacaggggatatgtttacgaaggagtctgggaataagatggaggaggtcaagttgcgagtgacttatgttgctcctccacagccaccctctccagttccagaggaatctgaagaaggttctccatctaggacttctgaatcagaaaatggagatggacctgctggaggattcaccagagcactgagggagcgcatcgagcctcaagacaaatctacagaggctggagctttgatttccaagttgactgaagaaaagaattccgcgattcaacagaatcatagacttagacaggaacttgatttggtgagacaggagatcagcaagaggcgtggagggggcttctcctttatcattgtcataattgttgctttgatcggcatcatcctaggctatctgatgaagtcataa

SEQ ID NO: 10906 - protein, 244 aa, Sorghum bicolor
  misc_feature: Ceres ANNOT ID no. 6117936
  misc_feature (12)..(119): Pfam Id: Motile_Sperm Pfam Desc: MSP (Major sperm protein) domain
  misc_feature (10)..(243): NCBI GI: 92872094 NCBI Desc: major sperm protein [medicago truncatula]
  misc_feature (11)..(243): NCBI GI: 115459632 NCBI Desc: os04g0534400 [oryza sativa (japonica cultivar-group)]
  misc_feature (11)..(243): NCBI GI: 116310461 NCBI Desc: osigba0159i10.10 [oryza sativa (indica cultivar-group)]
  misc_feature (10)..(243): NCBI GI: 6688926 NCBI Desc: vap27 [nicotiana plumbaginifolia]
  misc_feature (11)..(182): NCBI GI: 79315823 NCBI Desc: vap27-1 (vamp/synaptobrevin-associated protein 27-1); structural molecule [arabidopsis thaliana]
  misc_feature: The sequence is a functional homolog of SEQ ID NO. 356 in the 11/188,298 US application
MATPAPATAGELLRVEPLELRFPFELNKQISCSMQLSNHTNDYIAFKVKTTSPKKYSVRPNTGVVLPRSTCDVVVTMQAQRLAPPDMQCKDKFLVQSIVAPSGITVKDVTGDMFTKESGNKMEEVKLRVTYVAPPQPPSPVPEESEEGSPSRTSESENGDGPAGGFTRALRERIEPQDKSTEAGALISKLTEEKNSAIQQNHRLRQELDLVRQEISKRRGGGFSFIIVIIVALIGIILGYLMKS

SEQ ID NO: 10907 - DNA, 726 bp, Sorghum bicolor
  misc_feature: Ceres ANNOT ID no. 6117953
  misc_feature: Encodes the peptide sequence at SEQ ID NO 10908
atgagcggaggaagcgggactttcctcgagatccagccatcggagctcgcattcccctttgagataatgaggcagagctcctgctccatgcaattgaccaataagactgaccattatgtagcattcaaggtcaaaacaaccaacccgaagcagtactgcgtgcgtcctaatattggcgttgtattacctgggtcaacttgtgatgttacagtgacaatgcaagcacagaaggcttcaccatctgacatgcaatgcaaggacaagttcctagttcaaagcgttgtggctgagaatggtgcaacagctcaagaaattaatgcagcaatgttcaataaggagccagggaaggttgttgatgaattcaagctgcgtgtggtttatgtgccaacaactacacccaacccgatccctgaagaatctgaactaggggcttctgctccctcatattcacaagaaaatgggatcagtcattccacgatgccactatctgtatctagatcatctgctgaaacaacaaaggagaagccctctgaggcaacgtctgtgatctccaagctaactgaggagaaaatgtctgctattcagcagaaccagaagttacgacaagagctggaacttctacggaaagagagcagcaaaaccagcggcggcggtttctccatcaccttcttgtttgtcgttggccttctgggcatcatcgtcggctacatcctcaagagaacatag

SEQ ID NO: 10908 - protein, 241 aa, Sorghum bicolor
  misc_feature: Ceres ANNOT ID no. 6117953
  misc_feature (8)..(115): Pfam Id: Motile_Sperm Pfam Desc: MSP (Major sperm protein) domain
  misc_feature (1)..(241): NCBI GI: 6688926 NCBI Desc: vap27 [nicotiana plumbaginifolia]
  misc_feature (6)..(240): NCBI GI: 92872094 NCBI Desc: major sperm protein [medicago truncatula]
  misc_feature (1)..(240): NCBI GI: 115459632 NCBI Desc: os04g0534400 [oryza sativa (japonica cultivar-group)]
  misc_feature (1)..(240): NCBI GI: 116310461 NCBI Desc: osigba0159i10.10 [oryza sativa (indica cultivar-group)]
  misc_feature (5)..(240): NCBI GI: 116310410 NCBI Desc: osigba0143n19.13 [oryza sativa (indica cultivar-group)]
  misc_feature: The sequence is a functional homolog of SEQ ID NO. 356 in the 11/188,298 US application
MSGGSGTFLEIQPSELAFPFEIMRQSSCSMQLTNKTDHYVAFKVKTTNPKQYCVRPNIGVVLPGSTCDVTVTMQAQKASPSDMQCKDKFLVQSVVAENGATAQEINAAMFNKEPGKVVDEFKLRVVYVPTTTPNPIPEESELGASAPSYSQENGISHSTMPLSVSRSSAETTKEKPSEATSVISKLTEEKMSAIQQNQKLRQELELLRKESSKTSGGGFSITFLFVVGLLGIIVGYILKRT

SEQ ID NO: 10909 - DNA, 2235 bp, Sorghum bicolor
  misc_feature: Ceres ANNOT ID no. 6117972
  misc_feature: Encodes the peptide sequence at SEQ ID NO 10910
atgacgcagagcatgagaggcggagggagcggccgcggccacgggaaaggccaatacagcagcagcagcaacaaccaccacctccaccacaccgcgctgtgctgcctctccgccgcgccgccgctgccgggggacgccacgccgacgctgacgccggagccggaggccgcggcggcggcggcggcgggaccggccgtcgcggtggagggcgtgctgcacaagtggaccaactacggccgcgggtggcgggagcgctggttctcgctccgggacggcgtcctgtcctactccaagattcgggccgacgcgggggcgcgggcgcgggcgggcgcggcggacggagacgacagggaggttaggctgatcggctccagggtgggaggagcccgccgcacggagaagcccgccggcgtcgttttcctcaaggtgtcagcatttcgggagagtaagtcggacgataggagattctacatattttcccccaccaagacgcttcacttgaagacggactcgaaagatgaccgtgttgcctggattgaggccttgatcctggcaaggagtgtttattctctcgggtcactcagtgggagagtaactttcgtgcagagtgatgcttcgatttcaacagcaaggcttagagatcgaatgcatcaggagggtctgaatgagagtcttatacaggactgtgaacagattgtgctttctgagttctcaagctaccggaagcaactgaagcggcgttacgaggattacttaagcttgtttggatcctgcagacatcattttgaggaaggtaaagatggaagtataacacaggaggcattgacaagaaatgacttctctagttctcggcatggaaattttagcgaatatagcaccacagaatctgatgagcatgagtttgagaagcacgatggaggtgaattgacttttgaagatgaatctacattctttgattctgtagactacttcacagagtcagacaacagatcgtcaaccatgttaagcagtcaggaagttgtggattcccaaacacatgattccactaacaacatagtgccgcaaatcagacgacggattaggctgcctgagcctactgagaaagagaaagggatcagtctctggtccattattaaagatagtgttggaaaggatttgacacgagtttgtcttccagtttacttcaatgaaccactctcatcccttcagaagtgctttgaagatttggaatattcatacctcttggatcaagcatatcaacatggaaaagtgggggacagcctcatgagaattctcaaagtagctgcttttgcggcctctggttatgcttcatctgttgcaagaccttgcaaaccattcaatccattgctaggagagacctacgaagctgattaccctgacagaggagttcgtttttttgcagaaaaggttagtcatcatccaatgctgattgcctgccactgtgaaggcaagggctggaaattctggggcgacagcaatgtcaaatccaagttttgggggcagtcaattcaagttgaaccagttggcactttgactctggaatttgaggatggtgaaatcttccaatggaataaggtcacaacgaccattcacaatctcattcttgggaagttgtactgcagccaccatggaaccatgcacataaaagggaatcgtcagtattcatgtaaactgaagttcaaagagccatcacttcttgaccggaatcctcatatagtacaaggctttgtagaggacaataacgggaacaaagcttcgtttttgatagggaagtgggatgaaagcatgtattgtagtgattctgatactttcaaggtgaagagcgccgatcaactgaaaggtgcctcgctgctgtgggaaaagaacaaacctgctcctaacccaacacgatataatttgtcttcatttgcgatcacactgaatgagttaaccccagggctgcaggagaaacttccacctactgattcacggctgagaccagatcagcgccacctagagaatggtgaatacgagaaggcgaatgcagagaagttgagattggaacgacgacaaagaatgtctacgaaacttcaagacaatggctggaaaccccggtggttcgaacaggacaccgaggacgggacgtatcgctacaaaggcggatactgggaaacaagagagaagggctgctgggatgggtgcctcgacatatttggggaatttgtcgaaacatga

SEQ ID NO: 10910 - protein, 744 aa, Sorghum bicolor
  misc_feature: Ceres ANNOT ID no. 6117972
  misc_feature (336)..(728): Pfam Id: Oxysterol_BP Pfam Desc: Oxysterol-binding protein
  misc_feature (66)..(187): Pfam Id: PH Pfam Desc: PH domain
  misc_feature (277)..(743): NCBI GI: 24111447 NCBI Desc: at4g22540/f7k2_120 [arabidopsis thaliana]
  misc_feature (289)..(743): NCBI GI: 145340141 NCBI Desc: oxysterol binding [arabidopsis thaliana]
  misc_feature (289)..(740): NCBI GI: 140054118 NCBI Desc: oxysterol-binding protein; pleckstrin-like [medicago truncatula]
  misc_feature (123)..(739): NCBI GI: 42570131 NCBI Desc: oxysterol-binding family protein [arabidopsis thaliana]
  misc_feature (123)..(739): NCBI GI: 42572843 NCBI Desc: oxysterol-binding family protein [arabidopsis thaliana]
MTQSMRGGGSGRGHGKGQYSSSSNNHHLHHTALCCLSAAPPLPGDATPTLTPEPEAAAAAAAGPAVAVEGVLHKWTNYGRGWRERWFSLRDGVLSYSKIRADAGARARAGAADGDDREVRLIGSRVGGARRTEKPAGVVFLKVSAFRESKSDDRRFYIFSPTKTLHLKTDSKDDRVAWIEALILARSVYSLGSLSGRVTFVQSDASISTARLRDRMHQEGLNESLIQDCEQIVLSEFSSYRKQLKRRYEDYLSLFGSCRHHFEEGKDGSITQEALTRNDFSSSRHGNFSEYSTTESDEHEFEKHDGGELTFEDESTFFDSVDYFTESDNRSSTMLSSQEVVDSQTHDSTNNIVPQIRRRIRLPEPTEKEKGISLWSIIKDSVGKDLTRVCLPVYFNEPLSSLQKCFEDLEYSYLLDQAYQHGKVGDSLMRILKVAAFAASGYASSVARPCKPFNPLLGETYEADYPDRGVRFFAEKVSHHPMLIACHCEGKGWKFWGDSNVKSKFWGQSIQVEPVGTLTLEFEDGEIFQWNKVTTTIHNLILGKLYCSHHGTMHIKGNRQYSCKLKFKEPSLLDRNPHIVQGFVEDNNGNKASFLIGKWDESMYCSDSDTFKVKSADQLKGASLLWEKNKPAPNPTRYNLSSFAITLNELTPGLQEKLPPTDSRLRPDQRHLENGEYEKANAEKLRLERRQRMSTKLQDNGWKPRWFEQDTEDGTYRYKGGYWETREKGCWDGCLDIFGEFVET

SEQ ID NO: 10911 - DNA, 2772 bp, Sorghum bicolor
  misc_feature: Ceres ANNOT ID no. 6117974
  misc_feature: Encodes the peptide sequence at SEQ ID NO 10912
atggcggttgtcaaccctagcaacaaccctgctatgttcgacgacgacgacgatgttcccctttcgttcaagaggacgagtaactctttgaagactgccaggcccaccccgtctaagcaagaggggtcgtcaggaggcgctgccaggcccaccccctccaagcaggaggggtcgtcaggaggctctgggaaccctgccaggcccaaacctgtggctcataacctgcagaagaatggcgtgaccggggcttcgaggccagtgcatatgaagccactgtcatccactcctaaccatcggccttcagggtctggccagccaaatagttcggcacaacatagttcaaagggtaataatagcattgacaagagtaaactgaaaagacctcttgtgaaggacgagaggtctgacgattcggatgatgaggtgccgattgggttgaggagaaaggctgaggagaagaagttgaagagagttgatactgcggttcataaggcagatgactcagatgacgatgataaaccattgagtctcaagatcaactcgtccaaaatgtctaacaacagcgtgagtaagcctgttctgcagaggattgcaccgaaggttgagcagcctgatgaagattcagatgatgataaaccattggcaagcaggttgcccaataatgcttgtccaaaaagtggaggtaatgtctctgaagattcagaggatgagaagccattggctgccagattttcaaaagttgctggcagtgggaacctaaaaacagcttcttccagcaaaggattaaacagtgatacaaatggccagcgaagtttgggtaaaaggcctctagacaatagtaatcaaacaagtttagctattaagaaggcaaaaccttcaaatgtttcagcttctgcaagtgttaaaagagaaatcaagacagatgacaatgacaacacacctcttgcacaaaggctgaaaatgggagagtcttcgaaaggcaagccacctgcaaagagtatcgtcaagaagagtcctgcttctgcgaaggacatcaagaaactgaaagggaaagggaaattaaagaagaacatgaaaaattctcagttctccaagacaatgagggtccctcctggatctggtgaaggaaagaaatggactaccttggagcacaatggcgttattttccctcctccgtacaagcctcatggtgtaaaaatgctttacaatgggcaacctgttgatctgacaccagaacaagaggaggttgcaacaatgtttgctgttatgaaagacacagactatgcgggcaagccaacattcattgataactttttcactgactggagaaaaattcttggtaaaaaccatattatcaagaagtttgagctttgtgatttcacaccaatatatgaatggcacctcagagagaaggagaagaagaagcagatgacaacagaggcatgtgagaaaaaagcattgagggaagagaaattgaaacaagaggagaagtacatgtgggctgttgtagatggtgttaaagaaaaggttggaaatttcagagtagaaccgcctggcttgttcaggggacgtggagaacatccaaagatgggaaaactaaagcgacgcattcaaccaagcgatatcacgataaatattggaaaaggagctccagtccctgagtgcccgatacctggagaaagttggaaagaaatcaaacatgacaatactgttacatggttggctttttggaatgatccaattagccaaaaggatttcaagtatgttttcctggcagcaagcagctcactgaaagggcaaagtgacaaagagaagtatgagaagtccagaaagttgaagggtcacatacaaagaattcgtgagaattatacaaaagatttcaaaaacaaagatgtgacgaggaggcaaattgctgtggctacataccttatagataaactagcccttagggcaggcaatgaaaaggatgatgacgaagctgatactgttggttgctgtacgcttaaggttgataatgttacgtgtatgcccccaaataagattcagtttgactttctgggtaaagattcgataagatactttaacaccgtagaggtcgaagagcttgtgtacaaggcaattgagggtttccgtgctggaaagaagccgggagaaggtctctttgacaagattgatacaactaggctaaatgctcatttgaaggatctaatgcctgggcttactgcaaaagtgttccgtacatataatgcttccatcacattggacggaattttgcatgaagaaacagaagatggaactcttctagaaaaaattgctgtctatcaacgagcaaacaaagaggttgccataatctgtaaccatcagcgtagtgtctcaaaatcacatgaatcccagatgattaaactgaatgaaaagattgatgaattgaagtcccaaatggaggagctgaaagcagacttgagcaaagcaaagaaagggaagcctctaggatatgataaagaggggaagcaaaagaggaacttggctcctgaagcgattgaaaagaagattgcaatggttgaaggcaagatagataagatggagatggacaagaagataaaagaggatctgaagactgttgcacttggaacgtcaaagatcaactaccttgatcctagaattaccgtggcatggtgcaaacgccatgaggtccctattgagaagattttcaacaaatctcttatcgcgaaatttggatgggcaatggacgtcgacccggacttcagattctag

SEQ ID NO: 10912 - protein, 923 aa, Sorghum bicolor
  misc_feature: Ceres ANNOT ID no. 6117974
  misc_feature (377)..(591): Pfam Id: Topoisom_I_N Pfam Desc: Eukaryotic DNA topoisomerase I, DNA binding fragment
  misc_feature (594)..(828): Pfam Id: Topoisom_I Pfam Desc: Eukaryotic DNA topoisomerase I, catalytic core
  misc_feature (14)..(923): NCBI GI: 9758162 NCBI Desc: dna topoisomerase i [arabidopsis thaliana]
  misc_feature (14)..(923): NCBI GI: 5326994 NCBI Desc: dna topoisomerase i [daucus carota]
  misc_feature (101)..(898): NCBI GI: 14626487 NCBI Desc: topoisomerase i [nicotiana tabacum]
  misc_feature (86)..(908): NCBI GI: 2330649 NCBI Desc: topoisomerase i [pisum sativum]
  misc_feature (206)..(884): NCBI GI: 1800221 NCBI Desc: topoisomerase i [daucus carota]
  misc_feature (14)..(923): SWISSPROT Homolog: EC 5.99.1.2 DNA topoisomerase 1
MAVVNPSNNPAMFDDDDDVPLSFKRTSNSLKTARPTPSKQEGSSGGAARPTPSKQEGSSGGSGNPARPKPVAHNLQKNGVTGASRPVHMKPLSSTPNHRPSGSGQPNSSAQHSSKGNNSIDKSKLKRPLVKDERSDDSDDEVPIGLRRKAEEKKLKRVDTAVHKADDSDDDDKPLSLKINSSKMSNNSVSKPVLQRIAPKVEQPDEDSDDDKPLASRLPNNACPKSGGNVSEDSEDEKPLAARFSKVAGSGNLKTASSSKGLNSDTNGQRSLGKRPLDNSNQTSLAIKKAKPSNVSASASVKREIKTDDNDNTPLAQRLKMGESSKGKPPAKSIVKKSPASAKDIKKLKGKGKLKKNMKNSQFSKTMRVPPGSGEGKKWTTLEHNGVIFPPPYKPHGVKMLYNGQPVDLTPEQEEVATMFAVMKDTDYAGKPTFIDNFFTDWRKILGKNHIIKKFELCDFTPIYEWHLREKEKKKQMTTEACEKKALREEKLKQEEKYMWAVVDGVKEKVGNFRVEPPGLFRGRGEHPKMGKLKRRIQPSDITINIGKGAPVPECPIPGESWKEIKHDNTVTWLAFWNDPISQKDFKYVFLAASSSLKGQSDKEKYEKSRKLKGHIQRIRENYTKDFKNKDVTRRQIAVATYLIDKLALRAGNEKDDDEADTVGCCTLKVDNVTCMPPNKIQFDFLGKDSIRYFNTVEVEELVYKAIEGFRAGKKPGEGLFDKIDTTRLNAHLKDLMPGLTAKVFRTYNASITLDGILHEETEDGTLLEKIAVYQRANKEVAIICNHQRSVSKSHESQMIKLNEKIDELKSQMEELKADLSKAKKGKPLGYDKEGKQKRNLAPEAIEKKIAMVEGKIDKMEMDKKIKEDLKTVALGTSKINYLDPRITVAWCKRHEVPIEKIFNKSLIAKFGWAMDVDPDFRF

SEQ ID NO: 10913 - DNA, 1185 bp, Sorghum bicolor
  misc_feature: Ceres ANNOT ID no. 6117975
  misc_feature: Encodes the peptide sequence at SEQ ID NO 10914
  misc_feature: Up-regulated in shoot tissues in response to methyl jasmonate treatment
  misc_feature: Up-regulated in root tissues in response to methyl jasmonate treatment
atggcgctctccatctccacgcccacctcctcctccctcgtcccggcctcccgtcaggtggtcaggttgacttcgcggtcggcaaagcctgcgactttcagcctccggaggccgcctctcgccgcggcggccgccgctggcaacgcacccacgtccccggtcagcgaggtcgtcactgagctcgacgcggtggccggcttcagcgagatcgtgccggacaccgtcgtgttcgatgatttcgagaggttcgcacccacggcagccacggtgagctcgtcgctgctgcttggaatcgctgggctcccagacaccaagttcaagagtgcgatagatactgcgctggcagatggtgagtgtaacgcattggagaagcctgaggacaggatgtcctgttacctcaccaaggctctggcaaacgttggcgctgaactagctcatcaagtccctggacgcgtttcgactgaaatagatgctcggttggcttatgacacccagggcattatccacagggtgcatgaactgttgaatctatacaaccagcatgatgtctcaactgaccgcctgttattcaaaattcctgctacatggcaaggcatagaggcctcaaggttgcttgaatctgaaggagttcaaacacatctaacatttgtttacagtttcgcacaagcagcagcggcagcacaagctggtgcatctgttgtacagatatttgtggggcggttgcgggattgggcaaggaatcactctggtgatccagagatagatgaggctctgaagaagggagaagatgcagggcttgctttggcgaagaaagtatatgcctatattcacagaaatgggtacaaaacaaagttgatggttgctgccatacggaacaagcaggacgtatttagccttctggggattgattacatcatcgcaccactgaagatattgcagtctctggaagaatctgtcaccgatcctgatgtgaagtacggttatgtcccaaagttgacccctgctattggcaagacgtacaacttcactgaagaggagcttgtgaagtgggaccagttgagcctatcagctgcgatggggccagctgctgaagaactgcttgcttcaggactagagggatatgtgaaccaagcacgccgcgttgaggagctcttcgggaagatctggccacctcccaatgtttaa

SEQ ID NO: 10914 - protein, 394 aa, Sorghum bicolor
  misc_feature: Ceres ANNOT ID no. 6117975
  misc_feature (69)..(385): Pfam Id: Transaldolase Pfam Desc: Transaldolase
  misc_feature (1)..(394): NCBI GI: 21594999 NCBI Desc: transaldolase total2 [arabidopsis thaliana]
  misc_feature (1)..(394): NCBI GI: 144924743 NCBI Desc: transaldolase [medicago truncatula]
  misc_feature (1)..(394): NCBI GI: 15418698 NCBI Desc: transaldolase total2 [lycopersicon esculentum]
  misc_feature (1)..(394): NCBI GI: 33391719 NCBI Desc: transaldolase [gossypium hirsutum]
  misc_feature (1)..(363): NCBI GI: 22497402 NCBI Desc: transaldolase-like protein [arabidopsis lyrata]
  misc_feature: Up-regulated in shoot tissues in response to methyl jasmonate treatment
  misc_feature: Up-regulated in root tissues in response to methyl jasmonate treatment
  misc_feature: The sequence is a functional homolog of SEQ ID NO. 478 in the 11/188,298 US application
MALSISTPTSSSLVPASRQVVRLTSRSAKPATFSLRRPPLAAAAAAGNAPTSPVSEVVTELDAVAGFSEIVPDTVVFDDFERFAPTAATVSSSLLLGIAGLPDTKFKSAIDTALADGECNALEKPEDRMSCYLTKALANVGAELAHQVPGRVSTEIDARLAYDTQGIIHRVHELLNLYNQHDVSTDRLLFKIPATWQGIEASRLLESEGVQTHLTFVYSFAQAAAAAQAGASVVQIFVGRLRDWARNHSGDPEIDEALKKGEDAGLALAKKVYAYIHRNGYKTKLMVAAIRNKQDVFSLLGIDYIIAPLKILQSLEESVTDPDVKYGYVPKLTPAIGKTYNFTEEELVKWDQLSLSAAMGPAAEELLASGLEGYVNQARRVEELFGKIWPPPNV

SEQ ID NO: 10915 - DNA, 1119 bp, Sorghum bicolor
  misc_feature: Ceres ANNOT ID no. 6117992
  misc_feature: Encodes the peptide sequence at SEQ ID NO 10916
atgggggaggaggagaggaagggaggagcggacgacggcgcggcagcggcggcggcagcgcgcgcggcggagcaggcgcgggagctgcaggacgcggcggcggcgctgctgacgcggacgcgggccgaggaggaggcgctgcgccgccgcgccgccgctctccaggtggagctccggcggctacgcgaggccgccgcggcgtcccacgccgacagcgacaaggttgaggaggacttggatcgagcgacgtgtctcattgctgacggtgatgttgcgtcgctgctaccgagcaagacgcaaggcgcttttctgaagatgttcttgggaccagtaaatctgcgggcaacaaggaaggaggtgcagctcaaggtgaaggaggagtacaatagctatagggacagaactgccttgctgtttcttggttttccggtgattctattgtttcttcgacaatggttatggaatggatgctttccagcgttgccagttcagctgtaccaggcttggttgttgttcctgtatactagtttagctttgcgtgagaacatactgcgagttaatggaagtgatattcgtccttggtggatacttcatcactactgtgccatgctgatgtctctaataagtctcacatgggagataaaggggcaacctaattgtgcacgcaagcagagaggcgtcgaacttttcctgtgctgggccataatgcaaggatttgttatgatgttgcagaatagatatcagcgtcaaagattatatactaggattgctttggggaaggctaaaagaatggatgttgtatggggagagactgctggtgttgaaggtcaattgttgctgttgtgccctctcctttttctcttgcagggctttgagggttatgtcggatttttacttcttcgcacagctcatactggtgtcgtccctgagtggcaggttgtggtctgtgggatcctgctggttgcaatggcaattggaaactttgcaaacacagtggacaccttgatgactaaatcaaggttcaaagcgaagatgaagaaatcaaagggcaaacgggatctcgatacatgcccctcaccaacaggttcattgcccacagattcaacaaccaaagcatga

SEQ ID NO: 10916 - protein, 372 aa, Sorghum bicolor
  misc_feature: Ceres ANNOT ID no. 6117992
  misc_feature (4)..(346): Pfam Id: TMPIT Pfam Desc: TMPIT-like protein
  misc_feature (1)..(224): NCBI GI: 115474821 NCBI Desc: os08g0152800 [oryza sativa (japonica cultivar-group)]
  misc_feature (3)..(355): NCBI GI: 140070513 NCBI Desc: loc548366 protein, related [medicago truncatula]
  misc_feature (24)..(349): NCBI GI: 57870649 NCBI Desc: transmembrane protein induced by tumor necrosis factor alpha [rattus norvegicus]
  misc_feature (24)..(349): NCBI GI: 30354641 NCBI Desc: transmembrane protein induced by tumor necrosis factor alpha [homo sapiens]
  misc_feature (24)..(349): NCBI GI: 13994300 NCBI Desc: transmembrane protein induced by tumor necrosis factor alpha [homo sapiens]
MGEEERKGGADDGAAAAAAARAAEQARELQDAAAALLTRTRAEEEALRRRAAALQVELRRLREAAAASHADSDKVEEDLDRATCLIADGDVASLLPSKTQGAFLKMFLGPVNLRATRKEVQLKVKEEYNSYRDRTALLFLGFPVILLFLRQWLWNGCFPALPVQLYQAWLLFLYTSLALRENILRVNGSDIRPWWILHHYCAMLMSLISLTWEIKGQPNCARKQRGVELFLCWAIMQGFVMMLQNRYQRQRLYTRIALGKAKRMDVVWGETAGVEGQLLLLCPLLFLLQGFEGYVGFLLLRTAHTGVVPEWQVVVCGILLVAMAIGNFANTVDTLMTKSRFKAKMKKSKGKRDLDTCPSPTGSLPTDSTTKA

SEQ ID NO: 10917 - DNA, 1386 bp, Sorghum bicolor
  misc_feature: Ceres ANNOT ID no. 6118014
  misc_feature: Encodes the peptide sequence at SEQ ID NO 10918
atggtttcctgtagtgctgctgttaacggaattaatggaggcctcacctacagtacatgtcgttcaagaaactactactatcagtattctcatactactaatttgcaaagttcgccagtagaccagatgcctttgcctcggaaattaaggaaatcgattcaacgaaatgcttactttttaacccagaagaggaagttcgtaccacactgttcatcagaccttagtacctcctgcagagaagaagtacccaactatttatcaatcaatgttttgcaagaccaatcaaatacaaaacctggagctactcgtaaagtgcttgtcattttgaaccctaattctggattccgaagctctcgggatgttttctacaagaaagtgcaatcaacattgaagctttcaggcttcaagatggaagtcatcgaaacagcatatgccggtcatgcaaaggttctttcttctactgtcgacctccaaaaattccctgatggtattatatgtgttggtggtgatgggatcgtcaatgaggttttgaatggattacttagtagagatgattttgaagtggcaattcgatttcccattgggataatacctgctggttctgataattcattggtgtggactgttcttggcatcagggatcctgtttctgccgcaattgctttaactaagggaggtttcacaccaatagatgtgtttgccgtaaaatggatccaagctggagtgactcattttggtttgacagcttcctactatggtttcgtagctgatgttctgcaactgtctgaaaaattccgcgtgcagcttggtcccttccgttatgttgttgctggccttctgaagtttctttcattacctcagtacagatttgaggtggactatctccctgcatcaccagggagaaattctgaattgagaccactgactaaaaaatgtcatgaacagctttctgatgatggcaaggttaggagaggtacacaaatcaatggtaggattgaagataattgggttaccaggaacggggagtttcttggcatttttgtctgcaatcacttttgcaagcctgcccaggggttactttctccagttattgcaccaaaagctcagcatgacgacggcagtctggacttgattcttgtccatggaagtggcagactcagactgttttgcttctttattgcctatcagctatgctggcatcttttactcccttacgtggaatatgtcaagataaaaaaagtaaagattaggccagttggcaatactcacaatggttgtggcgtcgacggggagcttcttcatggagaggacaaagctgaatggcagtgctcgctgcttccagcacaaggccggttgcttggccaggatccccgtgctttgaagtag

SEQ ID NO: 10918 - protein, 461 aa, Sorghum bicolor
  misc_feature: Ceres ANNOT ID no. 6118014
  misc_feature (104)..(237): Pfam Id: DAGK_cat Pfam Desc: Diacylglycerol kinase catalytic domain
  misc_feature (75)..(298): NCBI GI: 38345938 NCBI Desc: osjnbb0103i08.5 [oryza sativa (japonica cultivar-group)]
  misc_feature (75)..(298): NCBI GI: 116310433 NCBI Desc: h0501d11.3 [oryza sativa (indica cultivar-group)]
  misc_feature (104)..(298): NCBI GI: 57281695 NCBI Desc: sphingosine kinase [lotus corniculatus var. japonicus]
  misc_feature (104)..(297): NCBI GI: 22654975 NCBI Desc: at5g23450/k19m13_8 [arabidopsis thaliana]
  misc_feature (104)..(297): NCBI GI: 79328532 NCBI Desc: atlcbk1 (a. thaliana long-chain base (lcb) kinase 1); diacylglycerol kinase [arabidopsis thaliana]
MVSCSAAVNGINGGLTYSTCRSRNYYYQYSHTTNLQSSPVDQMPLPRKLRKSIQRNAYFLTQKRKFVPHCSSDLSTSCREEVPNYLSINVLQDQSNTKPGATRKVLVILNPNSGFRSSRDVFYKKVQSTLKLSGFKMEVIETAYAGHAKVLSSTVDLQKFPDGIICVGGDGIVNEVLNGLLSRDDFEVAIRFPIGIIPAGSDNSLVWTVLGIRDPVSAAIALTKGGFTPIDVFAVKWIQAGVTHFGLTASYYGFVADVLQLSEKFRVQLGPFRYVVAGLLKFLSLPQYRFEVDYLPASPGRNSELRPLTKKCHEQLSDDGKVRRGTQINGRIEDNWVTRNGEFLGIFVCNHFCKPAQGLLSPVIAPKAQHDDGSLDLILVHGSGRLRLFCFFIAYQLCWHLLLPYVEYVKIKKVKIRPVGNTHNGCGVDGELLHGEDKAEWQCSLLPAQGRLLGQDPRALK

SEQ ID NO: 10919 - DNA, 1581 bp, Sorghum bicolor
  misc_feature: Ceres ANNOT ID no. 6118018
  misc_feature: Encodes the peptide sequence at SEQ ID NO 10920
atggatgtgttgccgccgcctcccaagaggcagaggggcggccagtcccagtcccgtcgccagcaacaacaacaaccgcctcccggacccaaacccgtcagaggacatgacggcggcggcggtggttgcgaggcagtcgacgtcgacatcaacgtcgacgtcgatctgctgagctccctccacgacgacgtcctgggcagcatcatcacgctgctacccaccaaggacggcgcgcggacgcaggtcctctcgcggcggtggcgtccgctgtggcgctcggcgtcggcgcctctcaacctcgaggccacggtcgtcgcaccggcagccgtgaaccttcggccgacgtctccaccgtccgccgtcgtcggcgctttgcgggcgcacgggggccccgcccgccgcgtctcgctcacctggctcggcccattcgactcgttcccgatggtcgacggcctgctgacgccgccgacgacgctccaccgccgcggcgtcgacggcggcggaagccggttcccctccctcgacggcctccgggagttcgagctctactacaagcccatcaacgtccccggtgtccaccggcacccgccgccgatggcgtccctgcgccgcttcgcgcggacactgcgcgtgctcaccgtctgctccgctgcctgcagtctcggcagttacaacccgtacaggctcgccttcccgccggagacggagctcgagttcccgaagctcgagcagcttaccctgaagcacgtcagcatctctgaagccgccctgcatgctgttcttgccagatgccctgcgctgcagagcttggtgctgcacaggaacgaaggctacggtcgtctcgtgatcagatcgccgacgctccggagccttggcgtatcacatggtgctgaggtcgtcgtcgaggacgctccgatgttggagaggctcatccctcgtcatctaggaaaattcctccggatccaggttgtccatgcacctagaatgaagacgctgggatatctgtgtgacacaatctctgaatttgagatgggaacaacagttctcaagggaatggtacccgctgctggcgcatctagcatgatccgcactgtgaagattttagcccttgacagtccccgcgatttggatgttgttattgacttgttgaaatgcttcccgtgcgtggagaagctgtacttggaactctgtcattataatgtaaagggtaaggtcaagaatgtgcgtcgcagtaatgttccgatggaatgccttggcaaacatctgaagatgttggagctgagaaattaccggggcaggaagtcggaagtgagcttaatcaggttcttcctctcgaatgctagagtggtagaatcagtgaggtttatggtccctccttacaatcgttacaaggggaaatggattgtgaatcagcgtaagaagctactgctgaacatcagagcttctcgaggtgctagatttcacttcgatatcggtcgctgtctgtccagtcgcgtacccatggaacacatccacaatttagctatagatgatccctttggcagatcatcatgtagctgccaatacgatgatttcaagtga

SEQ ID NO: 10920 - protein, 526 aa, Sorghum bicolor
  misc_feature: Ceres ANNOT ID no. 6118018
  misc_feature (408)..(457): Pfam Id: FBD Pfam Desc: FBD
  misc_feature (228)..(513): NCBI GI: 115471573 NCBI Desc: os07g0287000 [oryza sativa (japonica cultivar-group)]
  misc_feature (92)..(520): NCBI GI: 50509648 NCBI Desc: ribosomal rna apurinic site specific lyase-like [oryza sativa (japonica cultivar-group)]
  misc_feature (239)..(457): NCBI GI: 6513849 NCBI Desc: ribosomal rna apurinic site specific lyase [triticum aestivum]
  misc_feature (197)..(457): NCBI GI: 34393947 NCBI Desc: ribosomal rna apurinic site specific lyase-like [oryza sativa (japonica cultivar-group)]
  misc_feature (197)..(457): NCBI GI: 115471537 NCBI Desc: os07g0277500 [oryza sativa (japonica cultivar-group)]
MDVLPPPPKRQRGGQSQSRRQQQQQPPPGPKPVRGHDGGGGGCEAVDVDINVDVDLLSSLHDDVLGSIITLLPTKDGARTQVLSRRWRPLWRSASAPLNLEATVVAPAAVNLRPTSPPSAVVGALRAHGGPARRVSLTWLGPFDSFPMVDGLLTPPTTLHRRGVDGGGSRFPSLDGLREFELYYKPINVPGVHRHPPPMASLRRFARTLRVLTVCSAACSLGSYNPYRLAFPPETELEFPKLEQLTLKHVSISEAALHAVLARCPALQSLVLHRNEGYGRLVIRSPTLRSLGVSHGAEVVVEDAPMLERLIPRHLGKFLRIQVVHAPRMKTLGYLCDTISEFEMGTTVLKGMVPAAGASSMIRTVKILALDSPRDLDVVIDLLKCFPCVEKLYLELCHYNVKGKVKNVRRSNVPMECLGKHLKMLELRNYRGRKSEVSLIRFFLSNARVVESVRFMVPPYNRYKGKWIVNQRKKLLLNIRASRGARFHFDIGRCLSSRVPMEHIHNLAIDDPFGRSSCSCQYDDFK

SEQ ID NO: 10921 - DNA, 288 bp, Sorghum bicolor
  misc_feature: Ceres ANNOT ID no. 6118022
  misc_feature: Encodes the peptide sequence at SEQ ID NO 10922
atggcgaagttcctcaactacaccagcgtccaagtactcttcatcctttccatggtacttctggcatcatgtgtcactcatgcacaaataataagtggggaagccagagaggttagcaaaactgggagcaccacgatgaccacgatggtggcaccaagaaagataattgatgataacaaaaatttattgtgctatctgaaaggcgcactgtactgctgcgatttgattagaaagtgctggcatgacataaaggagtgctggaagcgttgccatggtggaaaggtgtaa

SEQ ID NO: 10922 - protein, 95 aa, Sorghum bicolor
  misc_feature: Ceres ANNOT ID no. 6118022
  misc_feature (18)..(90): Pfam Id: BAP Pfam Desc: Basal layer antifungal peptide (BAP)
  misc_feature (1)..(92): NCBI GI: 12214247 NCBI Desc: basal layer antifungal peptide [zea mays]
  misc_feature (18)..(91): NCBI GI: 12214245 NCBI Desc: basal layer antifungal peptide [zea mays]
  misc_feature (1)..(91): NCBI GI: 12214251 NCBI Desc: basal layer antifungal peptide [zea mays]
  misc_feature (1)..(91): NCBI GI: 12214249 NCBI Desc: basal layer antifungal peptide [zea mays]
  misc_feature (8)..(90): NCBI GI: 5042329 NCBI Desc: betl2 protein [zea mays]
MAKFLNYTSVQVLFILSMVLLASCVTHAQIISGEAREVSKTGSTTMTTMVAPRKIIDDNKNLLCYLKGALYCCDLIRKCWHDIKECWKRCHGGKV

SEQ ID NO: 10923 - DNA, 288 bp, Sorghum bicolor
  misc_feature: Ceres ANNOT ID no. 6118024
  misc_feature: Encodes the peptide sequence at SEQ ID NO 10924
atggcgaagtttctcaactataccagcgttcaaggactcttgatgctttccatggtacttcttgcatcatgtgtcattcatgcacacataataagtggggaagccagagaggttagcaacactgggatcgcgacgatgaccacgatggtggcaccaagaaagataattgcagataataaaaatttattgtgctatctgaaaggcatactgtactgctgcgatttgatcggaaagtgctggcatgacataatggagtgctggcagcattgccatggtcgaaaggtgtaa

SEQ ID NO: 10924 - protein, 95 aa, Sorghum bicolor
  misc_feature: Ceres ANNOT ID no. 6118024
  misc_feature (18)..(90): Pfam Id: BAP Pfam Desc: Basal layer antifungal peptide (BAP)
  misc_feature (1)..(92): NCBI GI: 12214247 NCBI Desc: basal layer antifungal peptide [zea mays]
  misc_feature (18)..(91): NCBI GI: 12214245 NCBI Desc: basal layer antifungal peptide [zea mays]
  misc_feature (1)..(91): NCBI GI: 12214251 NCBI Desc: basal layer antifungal peptide [zea mays]
  misc_feature (1)..(91): NCBI GI: 12214249 NCBI Desc: basal layer antifungal peptide [zea mays]
  misc_feature (8)..(90): NCBI GI: 5042329 NCBI Desc: betl2 protein [zea mays]
MAKFLNYTSVQGLLMLSMVLLASCVIHAHIISGEAREVSNTGIATMTTMVAPRKIIADNKNLLCYLKGILYCCDLIGKCWHDIMECWQHCHGRKV

SEQ ID NO: 10925 - DNA, 984 bp, Sorghum bicolor
  misc_feature: Ceres ANNOT ID no. 6118029
  misc_feature: Encodes the peptide sequence at SEQ ID NO 10926
atggcgcaaccagggagctacttccaggacgcgcgcctcccgcagcagcggggcgtcgacggcgttgtcttccccgcggtgctcgtgccgggacgcgggggcagctgcagcttcgacgagttcctggcggctgtccgctcggagaaggcgtcacggctggagccgccgctgctggcggccggggcggtgctgctgcgcggcttcccggcgcggaccgccgccgacttcgaccgcgccgtagatgcgttcgggtacgaggagctgccctacgtcggcgccgcgcctcggaccaatgtcgtcggccgcgtcttcaccgccaacgagtcgccgcccgaccagagcatccccttccaccacgagatggcgcaggctccaacatttccgtccaaattgtttttcttctgtgaagtggaagcagagagtggtggagagacaccaatagtgttgagccattttgtttataacaaggtcaaggacaagttcccagaatttgtggagaagctggagaaatgtgggctgatttacacaagaatcttaggagagggtgacgatccattttctccaatcggtcgtggatggcaatcagtatttgccactagtgatagagtcgtcgctgaggaaagggctgcaggacgtggaatgaagctggaatggactggggaccgagttaaaacagtaacaggcccgataccagcagttaaatgggacgagagacgaggaagaaaaatatggttcgttaacatggttgctgcctacacagggtggaaggatgctcggaacggtcctgtgaatacagtcatgtttggcgatggctcgcccttgcctgccgatgtcatagacgaatgtgggaagatcttagaagaagaatgcgtggccattccatggcaacaaggtgacattcttcttatagacaactgggcagtcttacatggtcggcggccttctaagtccccacgacgcatacttgcttcactctgtaaatag

SEQ ID NO: 10926 - protein, 327 aa, Sorghum bicolor
  misc_feature: Ceres ANNOT ID no. 6118029
  misc_feature (15)..(327): Pfam Id: TauD Pfam Desc: Taurine catabolism dioxygenase TauD, TfdA family
  misc_feature (1)..(327): NCBI GI: 55771308 NCBI Desc: syringomycin biosynthesis enzyme -like [oryza sativa (japonica cultivar-group)]
  misc_feature (12)..(325): NCBI GI: 86162390 NCBI Desc: syrp-like protein [marinomonas sp. med121]
  misc_feature (15)..(327): NCBI GI: 120612377 NCBI Desc: taurine catabolism dioxygenase taud/tfda [acidovorax avenae subsp. citrulli aac00-1]
  misc_feature (25)..(327): NCBI GI: 118718582 NCBI Desc: taurine catabolism dioxygenase taud/tfda [burkholderia multivorans atcc 17616]
  misc_feature (53)..(327): NCBI GI: 23128425 NCBI Desc: cog2175: probable taurine catabolism dioxygenase [nostoc punctiforme pcc 73102]
MAQPGSYFQDARLPQQRGVDGVVFPAVLVPGRGGSCSFDEFLAAVRSEKASRLEPPLLAAGAVLLRGFPARTAADFDRAVDAFGYEELPYVGAAPRTNVVGRVFTANESPPDQSIPFHHEMAQAPTFPSKLFFFCEVEAESGGETPIVLSHFVYNKVKDKFPEFVEKLEKCGLIYTRILGEGDDPFSPIGRGWQSVFATSDRVVAEERAAGRGMKLEWTGDRVKTVTGPIPAVKWDERRGRKIWFVNMVAAYTGWKDARNGPVNTVMFGDGSPLPADVIDECGKILEEECVAIPWQQGDILLIDNWAVLHGRRPSKSPRRILASLCK

SEQ ID NO: 10927 - DNA, 1080 bp, Sorghum bicolor
  misc_feature: Ceres ANNOT ID no. 6118049
  misc_feature: Encodes the peptide sequence at SEQ ID NO 10928
atgtacgccgccgctgtgttggcagcggcctctgcggcatgcgtcgtcgcggcgcagtccccggagccgcgcgacaacgcgacgatcgccgacgtgatgagcatctctgtcttcatggccgtattcttccccgtcttcgtcgtgcttctcgccttcgcctgcctccgcctgttccgggcccccgacgacgaccctcaggctccggacgcggcggcgtcggcaacggagtggccccgcggcggcgggggcagccgcaagggagggctcgacgccgccgcgatcgccgcgctgccgctggtgttcttccgggaggtgaggcagcaccggatcgtggacgggcgcggcgacgacgcgctcgagtgctccgtctgcctcctcgagttcgacgacgacgacgcgctccgcctcctcccgacgtgcccgcacgcgttccacccggagtgcatcggcctctggctcgagaggcacgccacctgcccgctgtgccgcgccagcgtcctcgacgcgccaccaccaccaccagctccggcagcggcgcagcaccagacggcgccaccgccgctgctaacgccggactcgtcgcccgttcccgcggctatcgtgctaatcggcgacgccgccggcgcaagcgcaagcgctgaaggggatgaagaggattggacaacgatccagcgcctcgcgaggaaccgccgcgcggcggggcggcaggcgctgccgcggtccaactcgacgggccacagcgccagcgacgacggcgggatggagcggttcgcgctgcggctccccgagcacgtgcgcctcgagctgctcatgtcgcacaggctgaggcacgtgacgagcgcggtggcgtccgtgcgcgtcatggagggcagcgcccacgacgccagcagtgtggtgggcgggagcgtcaggagcgccatggcgaggctgctgtcgtcgctctttgcgccgggcgccgggtggaagggcgatggcgacgataagtccggcaaggcggacgccaccgctggggcgtcgtctctccgccgccgcgacaactcgtccagaggagcagtgggagaagagaagagaagcgtctga

SEQ ID NO: 10928 - protein, 359 aa, Sorghum bicolor
  misc_feature: Ceres ANNOT ID no. 6118049
  misc_feature (121)..(162): Pfam Id: zf-C3HC4 Pfam Desc: Zinc finger, C3HC4 type (RING finger)
  misc_feature (3)..(351): NCBI GI: 38569180 NCBI Desc: osjnba0086b14.4 [oryza sativa (japonica cultivar-group)]
  misc_feature (3)..(351): NCBI GI: 116310080 NCBI Desc: h0818e04.18 [oryza sativa (indica cultivar-group)]
  misc_feature (4)..(270): NCBI GI: 46392557 NCBI Desc: ring/c3hc4/phd zinc finger-like protein [oryza sativa (japonica cultivar-group)]
  misc_feature (16)..(286): NCBI GI: 28558782 NCBI Desc: ring/c3hc4/phd zinc finger-like protein [cucumis melo]
  misc_feature (69)..(311): NCBI GI: 92890045 NCBI Desc: zinc finger, ring-type; ringv [medicago truncatula]
  misc_feature: The sequence is a functional homolog of SEQ ID NO 1131 in the 10/666,642US patent application
  misc_feature: The sequence is a functional homolog of SEQ ID NO 1132 in the 10/666,642US patent application
  misc_feature: The sequence is a functional homolog of SEQ ID NO 1133 in the 10/666,642US patent application
  misc_feature: The sequence is a functional homolog of SEQ ID NO 1134 in the 10/666,642US patent application
  misc_feature: The sequence is a functional homolog of SEQ ID NO 1541 in the 11/479,226US patent application
  misc_feature: Useful for making plants with modulated growth and phenotype characteristics
  misc_feature: The sequence is a functional homolog of SEQ ID NO 1541 in the 20070022495 US patent application
  misc_feature: The sequence is a functional homolog of SEQ ID NO 1131 in the 20070033671 US patent application
  misc_feature: The sequence is a functional homolog of SEQ ID NO 1132 in the 20070033671 US patent application
  misc_feature: The sequence is a functional homolog of SEQ ID NO 1133 in the 20070033671 US patent application
  misc_feature: The sequence is a functional homolog of SEQ ID NO 1134 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MYAAAVLAAASAACVVAAQSPEPRDNATIADVMSISVFMAVFFPVFVVLLAFACLRLFRAPDDDPQAPDAAASATEWPRGGGGSRKGGLDAAAIAALPLVFFREVRQHRIVDGRGDDALECSVCLLEFDDDDALRLLPTCPHAFHPECIGLWLERHATCPLCRASVLDAPPPPPAPAAAQHQTAPPPLLTPDSSPVPAAIVLIGDAAGASASAEGDEEDWTTIQRLARNRRAAGRQALPRSNSTGHSASDDGGMERFALRLPEHVRLELLMSHRLRHVTSAVASVRVMEGSAHDASSVVGGSVRSAMARLLSSLFAPGAGWKGDGDDKSGKADATAGASSLRRRDNSSRGAVGEEKRSV

SEQ ID NO: 10929 - DNA, 1665 bp, Sorghum bicolor
  misc_feature: Ceres ANNOT ID no. 6118051
  misc_feature: Encodes the peptide sequence at SEQ ID NO 10930
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
atggcttcggttgcgcccccgtcttcctccgtggctgccctcacccgccaaccggtgcagttcttgaaagggtgcagtgtatccaaggagacaaagggacctatcagcagtttcttccctgcaaattcaaacagcactaaggtgaaatcagtgggcttgagagtagcatcatccttcagaagtgatggcagttatccagctggcggtgtctctgggaatggcgacacgctattgccaaaaagcacatccgtccgtggccaggaccatccggttgctgaccctgtactcccattggattccatgattacgccagaaatcctctctactaatttggcacgtgctgtggagaagttctcagatgatgacacagatactgaacttgatttggatagcccgacagagggcttcgcatcgattgcagatgccattgaggacatacgacaaggaaaacttgtgattgttgttgacgacgaatcaagggaaaatgaaggagatctgataatggctgccaacttggttaccccagaggctatggcttttatagtaaggcatgggacaggaattgtttgtgtcagcatgaaagaagatgatctggaaagactgaaccttcctttgatggttaccacaaaagaaaacgaggagaagctatgcactgctttcactgttacagtggatgcaaaagagggcacaactactggggtatctgccaaggacagggcaaaaacagtcatgactcttgcatctcctgactctaagcctgaggacttcaaccgccctggtcatattttccctttgaaatacagagaaggaggtgttctgaaacgagctggacacaccgaggcatctgttgatcttgccatgctggctggattacctcctgttgctgtcctttgtgagattgtggatgatgcagatggttccatggctcgcctaccaaagttgcgtgtctttgctgaaaaggagaatttgaagattatatctattgctgacttgattaggtataggaggaaacgagacaggctaattgaacgtgcttctgttgcgcgcttgcctttgaaatggggcaatgtccgtgcctattgctacaaatctgttatcgatggcatagagcatattgccatggtgaaaggtgatattggcgatggccaagacattttggtgagggtgcactctgagtgcctcacaggcgacatttttggatcagcgagatgtgattgtggtgaccagcttgcaatggcaatggagatgattgagaaggctggaaggggtgtattagtttatctccgtggacatgaaggaaggggtattggcctgggccacaagcttcgtgcctataacttacaggatgatgggcgtgatactgtggaagctaatgaggaacttggtcttcctgtggactcacgggaatatgggattggcgcacagatattacgggatctaggagtccgttcaatgaagctgatgactaataaccctgcaaaatatagtggtctgaagggttatggactgagcattgcgggcagggtgcccttgattacgccaattaccagtgagaaccgtaagtacctggagaccaaaagaacaaagatgggacatgtatatggattggctaatgtgcaggctaaccaaccaagtggcagccagagcacagaagagaagcattag

SEQ ID NO: 10930 - protein, 554 aa, Sorghum bicolor
  misc_feature: Ceres ANNOT ID no. 6118051
  misc_feature (139)..(337): Pfam Id: DHBP_synthase Pfam Desc: 3,4-dihydroxy-2-butanone 4-phosphate synthase
  misc_feature (342)..(511): Pfam Id: GTP_cyclohydro2 Pfam Desc: GTP cyclohydrolase II
  misc_feature (73)..(536): NCBI GI: 79547445 NCBI Desc: atgch; 3,4-dihydroxy-2-butanone-4-phosphate synthase/ gtp cyclohydrolase ii [arabidopsis thaliana]
  misc_feature (80)..(535): NCBI GI: 33308405 NCBI Desc: gtp cyclohydrolase ii/3,4-dihydroxy-2-butanone 4-phosphate synthase [malus x domestica]
  misc_feature (58)..(550): NCBI GI: 2578365 NCBI Desc: gtp cyclohydrolase ii / 3,4-dihydroxy-2-butanone-4-phosphate synthase [lycopersicon esculentum]
  misc_feature (168)..(536): NCBI GI: 119935815 NCBI Desc: at5g64300 [arabidopsis thaliana]
  misc_feature (123)..(544): NCBI GI: 29367375 NCBI Desc: gtp cyclohydrolase ii/3,4-dihydroxy-2-butanone-4-phosphate synthase-like protein [oryza sativa (japonica cultivar-group)]
  misc_feature (73)..(536): SWISSPROT Homolog: EC 3.5.4.25 GTP cyclohydrolase-2
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MASVAPPSSSVAALTRQPVQFLKGCSVSKETKGPISSFFPANSNSTKVKSVGLRVASSFRSDGSYPAGGVSGNGDTLLPKSTSVRGQDHPVADPVLPLDSMITPEILSTNLARAVEKFSDDDTDTELDLDSPTEGFASIADAIEDIRQGKLVIVVDDESRENEGDLIMAANLVTPEAMAFIVRHGTGIVCVSMKEDDLERLNLPLMVTTKENEEKLCTAFTVTVDAKEGTTTGVSAKDRAKTVMTLASPDSKPEDFNRPGHIFPLKYREGGVLKRAGHTEASVDLAMLAGLPPVAVLCEIVDDADGSMARLPKLRVFAEKENLKIISIADLIRYRRKRDRLIERASVARLPLKWGNVRAYCYKSVIDGIEHIAMVKGDIGDGQDILVRVHSECLTGDIFGSARCDCGDQLAMAMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLITPITSENRKYLETKRTKMGHVYGLANVQANQPSGSQSTEEKH

SEQ ID NO: 10931 - DNA, 984 bp, Sorghum bicolor
  misc_feature: Ceres ANNOT ID no. 6118061
  misc_feature: Encodes the peptide sequence at SEQ ID NO 10932
atgggctcctcgtccactccggcggccgcggcagcggcggcgccgagccggcgcaaggtggcgctctacctggcgctcctcaccctgcagtacggcgcccagcccctcatctccaagcgctttgtccgccaagatactattgtgacctcactagttctcgcaacggaagcagcaaaggttatttgtgcaatcattttattgattgcagagggtagtctaagaaaacagttcagtaactggactctcactggatcactgactgcgtctggactgcctgctgccatctatgcccttcaaaatagtctgctgcaagtatcatacaagaatctggattccttgaccttttcaatccttaaccagactaagcttttgtggacagcatttttcacatttcttattttggggcaaaagcaatcttccaggcaaattttagcattggccctcttaattggtgctgccgttcttttaagtgtgggggagagtactagcaaaggttccaagagtggtggctctgactatatcttgctatatgggatcattccagttacagtcgcttctatgctgtctgggttggcttcttcattgtgtcagtgggcatctcaggttaaaaaacatacctcttacatgatgactatagagatgtcatttattggaagtatgtgcttgttagcaagtacctatcggtcaccagatggagaggccatcaggaaatatggatttttccatgaatggactttctggactgtggtaccggtattaatgaatgccgtgggtggaattcttgttggtcttgtcacaacttacgcaggtggcgttagaaagggttttgttatagtctcagctctccttgtaactgcactgctacaatttgtgtttgatgggaagccaccatcactctactgcctgatggctttaccacttgtcgcaacaagcatattcatctaccagaagtatccatatgttgataggaagaagaaagattga

SEQ ID NO: 10932 - protein, 327 aa, Sorghum bicolor
  misc_feature: Ceres ANNOT ID no. 6118061
  misc_feature (76)..(308): Pfam Id: Nuc_sug_transp Pfam Desc: Nucleotide-sugar transporter
  misc_feature (9)..(326): NCBI GI: 18086579 NCBI Desc: at5g65000/mxk3_23 [arabidopsis thaliana]
  misc_feature (136)..(327): NCBI GI: 115446843 NCBI Desc: os02g0573300 [oryza sativa (japonica cultivar-group)]
  misc_feature (9)..(250): NCBI GI: 42573798 NCBI Desc: nucleotide-sugar transporter family protein [arabidopsis thaliana]
  misc_feature (8)..(326): NCBI GI: 145346582 NCBI Desc: dmt family transporter: udp-galactose [ostreococcus lucimarinus cce9901]
  misc_feature (49)..(315): NCBI GI: 59798947 NCBI Desc: udp-n-acetylglucosamine transporter (golgi udp-glcnac transporter) (solute carrier family 35 member a3)
MGSSSTPAAAAAAAPSRRKVALYLALLTLQYGAQPLISKRFVRQDTIVTSLVLATEAAKVICAIILLIAEGSLRKQFSNWTLTGSLTASGLPAAIYALQNSLLQVSYKNLDSLTFSILNQTKLLWTAFFTFLILGQKQSSRQILALALLIGAAVLLSVGESTSKGSKSGGSDYILLYGIIPVTVASMLSGLASSLCQWASQVKKHTSYMMTIEMSFIGSMCLLASTYRSPDGEAIRKYGFFHEWTFWTVVPVLMNAVGGILVGLVTTYAGGVRKGFVIVSALLVTALLQFVFDGKPPSLYCLMALPLVATSIFIYQKYPYVDRKKKD

SEQ ID NO: 10933 - DNA, 1260 bp, Sorghum bicolor
  misc_feature: Ceres ANNOT ID no. 6118062
  misc_feature: Encodes the peptide sequence at SEQ ID NO 10934
atggcgaagctggcgcgatcgccaacggcctccccgccggcggcggccgcggataggcaccgctccgcggccgggtcggggctccggtccctcgccagcgccgcctccgggtggtttgaccggtgggcggtcatgggttccggactctccaagctcgaaagggccttcggcgaccagttccccgagggcgagcgctacttcgggctcgagaacttcggcaacacctgctactgcaacagcgtcctccaggcactgtattattgtgctccattccgggagcagttgctggaatactatagcaaaaacagaaatctcgaagatgctgaagaaaatttgttgacctgcctagcagatcttttttcacagataagtgcatcaaagaaaaagactggtgttattgctccaaaacgtttcattcaaatggttaggaaactaaatgaatattttcgtggctacatgcatcaggatgcccatgagtttttgaatttcttactgaatgaaattgttgatattctggaaaaagagtctagttctgcaaaggattctcctgggaccacgtctcctgaaaaggtctcaaatggggcaactgttgatgaagttagaaaagaaccactggttacatgggtacataagagttttcagggtactttgaccaatgaaaccagatgcttaatgtgtgagacaatcaccgcaaaggatgagacattttttgacttgagcgttgacattgaacagaatagttcactcacaagctgcctgaagaatttcttttctactgagactttaaatgcggatgacaagttcttctgtgacaagtgctgcagtttgcaagaagcagagaagagaatgaagataaaaaaggtgccacaaacattggtgatccacctaaagcgcttcaagttcatcgagcagcttaaccggaacaagaagctgtcgtaccgagtagtgtaccccttggagcttaagctcagcagcagctccagtgatgccgttgctgactgtgagtactccctctttgccgtggtggtccacctgggtagcggccccaaccaggggcactacgtagccaagatcaagagccatgaccattggctgtcgttcgatgatgacaatgtcgagatgatcccggagtccaccctacagacgttctatggctcttctcgtgaatattcgggcaacacggatcatggctacatcttgttctacgagcgcattggtgggaatggagatgagaagaccgactcttccgatggagtgtga

SEQ ID NO: 10934 - protein, 419 aa, Sorghum bicolor
  misc_feature: Ceres ANNOT ID no. 6118062
  misc_feature (64)..(402): Pfam Id: UCH Pfam Desc: Ubiquitin carboxyl-terminal hydrolase
  misc_feature (44)..(407): NCBI GI: 115458702 NCBI Desc: os04g0452400 [oryza sativa (japonica cultivar-group)]
  misc_feature (45)..(406): NCBI GI: 18958042 NCBI Desc: at4g39910/t5j17_80 [arabidopsis thaliana]
  misc_feature (45)..(406): NCBI GI: 4567196 NCBI Desc: ubiquitin-specific protease 4 (ubp4) [arabidopsis thaliana]
  misc_feature (45)..(406): NCBI GI: 21593319 NCBI Desc: ubiquitin-specific protease 4 (ubp4) [arabidopsis thaliana]
  misc_feature (45)..(403): NCBI GI: 119625840 NCBI Desc: ubiquitin specific peptidase 46, isoform cra_b [homo sapiens]
  misc_feature (45)..(406): SWISSPROT Homolog: EC 3.1.2.15 Ubiquitin carboxyl-terminal hydrolase 3
MAKLARSPTASPPAAAADRHRSAAGSGLRSLASAASGWFDRWAVMGSGLSKLERAFGDQFPEGERYFGLENFGNTCYCNSVLQALYYCAPFREQLLEYYSKNRNLEDAEENLLTCLADLFSQISASKKKTGVIAPKRFIQMVRKLNEYFRGYMHQDAHEFLNFLLNEIVDILEKESSSAKDSPGTTSPEKVSNGATVDEVRKEPLVTWVHKSFQGTLTNETRCLMCETITAKDETFFDLSVDIEQNSSLTSCLKNFFSTETLNADDKFFCDKCCSLQEAEKRMKIKKVPQTLVIHLKRFKFIEQLNRNKKLSYRVVYPLELKLSSSSSDAVADCEYSLFAVVVHLGSGPNQGHYVAKIKSHDHWLSFDDDNVEMIPESTLQTFYGSSREYSGNTDHGYILFYERIGGNGDEKTDSSDGV

SEQ ID NO: 10935 - DNA, 1380 bp, Sorghum bicolor
  misc_feature: Ceres ANNOT ID no. 6118071
  misc_feature: Encodes the peptide sequence at SEQ ID NO 10936
atgggctccattctaagtgcggcaaatactacggctaagtctatggatcatcatgagacatctgggacatatcctaataagagggtgaaggtatctacttatgagtatgggtcaaacccaaggattatcccgactcttcctgatgagatctcactccagattctggcaaggttaccacggattcattaccttaacttgaagatggtttctcaagcttggaaggcagcaatcattggttctgaactttcccagctgaggaaagagcttggcgtaagtgaagaatggttgtatgtactgacaaaggttgaggcaaacaaactccattggtatgccctcgatccagtgtttcagaaatggcagaggttgccaccgatgccttctttcgtcaatgaggaggaatccaataggacggcatcttctgggttccggatgtggaatgttgtgggatcaagcattaagattgctgatttcgtgaggggcttgttttggcgcaggaacagtttggaccagatgcccttttgtggttgttcagtgggtgttgctgatggttacttgtatgtcattggggggttttccaaagctgttgccctgaattgcgtttggagatacgacccttttctcaatttgtggcaggaagtgagcccaatgatcactgggcgggctttctgcaaggcaacatttttgaatggcaagttatatgtggttggtggagtcagtaggggtcggaatggcctgcttcctctgcgttcagctgaggcgtttgatcccaaaactggactgtggagtgagctaccagaaatgcctttcgcaaaagcgcaggtactccccacagccttcttggtcgatgtgctgaagcctatcgccacagggatggcaccctacaacgggaagctgtatgttcctcagagcttgtactcatggccgttcttttttgacattggaggtgagatctatgacccagacctgaatgcttggtcaacgatgcctgatggtctcggcgacggatggccagcaagacaggcaggcacgaaattgggtattgtgatcgatgacaaactttacaccctggagccttccggctctttggacagtggtcagataaaaagatacaactccgaagaggacacatgggtaactatcttgccacaagtcccggttaatgacttcactgatgcagaggccccttatttactcgccggtctccatggaaggctccatgttataacaaaggcggcaaacaacactcttcaagttatgcaggctgtagtacagaataactcggataacgcggtatctggagaaaatgtggtatggaccactgtggcttctaggaactttgggacggctgagcttgtcagctgccaggttctagatgtttaa

SEQ ID NO: 10936 - protein, 459 aa, Sorghum bicolor
  misc_feature: Ceres ANNOT ID no. 6118071
  misc_feature (172)..(217): Pfam Id: Kelch_1 Pfam Desc: Kelch motif
  misc_feature (219)..(268): Pfam Id: Kelch_1 Pfam Desc: Kelch motif
  misc_feature (219)..(268): Pfam Id: Kelch_2 Pfam Desc: Kelch motif
  misc_feature (41)..(88): Pfam Id: F-box Pfam Desc: F-box domain
  misc_feature (1)..(425): NCBI GI: 15219186 NCBI Desc: kelch repeat-containing f-box family protein [arabidopsis thaliana]
  misc_feature (163)..(268): NCBI GI: 4966346 NCBI Desc: contains two pf01344 kelch motif domains. [arabidopsis thaliana]
  misc_feature (40)..(262): NCBI GI: 92868686 NCBI Desc: cyclin-like f-box; serine/threonine protein phosphatase, bsu1 [medicago truncatula]
  misc_feature (25)..(266): NCBI GI: 86991196 NCBI Desc: kelch-motif containing protein [oryza sativa (indica cultivar-group)]
  misc_feature (25)..(266): NCBI GI: 86991198 NCBI Desc: kelch-motif containing protein [oryza sativa (indica cultivar-group)]
  misc_feature: The sequence is a functional homolog of SEQ ID NO. 440 in the 11/188,298 US application
  misc_feature: The sequence is a functional homolog of SEQ ID NO. 315 in the 11/188,298 US application
MGSILSAANTTAKSMDHHETSGTYPNKRVKVSTYEYGSNPRIIPTLPDEISLQILARLPRIHYLNLKMVSQAWKAAIIGSELSQLRKELGVSEEWLYVLTKVEANKLHWYALDPVFQKWQRLPPMPSFVNEEESNRTASSGFRMWNVVGSSIKIADFVRGLFWRRNSLDQMPFCGCSVGVADGYLYVIGGFSKAVALNCVWRYDPFLNLWQEVSPMITGRAFCKATFLNGKLYVVGGVSRGRNGLLPLRSAEAFDPKTGLWSELPEMPFAKAQVLPTAFLVDVLKPIATGMAPYNGKLYVPQSLYSWPFFFDIGGEIYDPDLNAWSTMPDGLGDGWPARQAGTKLGIVIDDKLYTLEPSGSLDSGQIKRYNSEEDTWVTILPQVPVNDFTDAEAPYLLAGLHGRLHVITKAANNTLQVMQAVVQNNSDNAVSGENVVWTTVASRNFGTAELVSCQVLDV

SEQ ID NO: 10937 - DNA, 999 bp, Sorghum bicolor
  misc_feature: Ceres ANNOT ID no. 6118078
  misc_feature: Encodes the peptide sequence at SEQ ID NO 10938
atggtcgcggcgggagatccggaatccttcttcgccacctcgcccccgctgcgcgacgccagcgctatcgccgccaacctgcaggagttcgttgcccgcaattcgcacgcctcatcagagggcggcgggcggcggcggatcgtttgcgtcacgtcgggcgggacgacggtgccgctggagcagcgatgcgtgcgctacatcgacaacttcagctccggccaccgcggcgccgcgtccaccgagtatttcttaaaggctggctatgcggtcattttcgtccatcggcgagggagttgccaacctttctctaggttcctgcctgatgattcatttctccagttctttgatgtcacaacagatttgaaggttcaagtggtcgagtcccaagcaacagtggtaaagaaagcaattggggattatcgcaaggctattgaaggaggctcgctgctgaaactcccattcactacgatatttgaatatcttcagttactgaagatggtggctacatctatgagttctgtgggtctccacgggatgttctatctcgctgcagctgtgtctgacttttatgttccatgggatagcatggaaaaacataagattcagtcagccggaggcccactggatatgaagctcagtcaagttccaaaaatgctttcagttctgcgaaaccaatgggccccgttggccttctgtatatccttcaagctggagacggattcagatattctagttcagaaagcagaaatggctctaaacaagtacaggatgaacgttgttgtggccaatcttcttgcaacgtacaaagaggaggtcgtcattatctcaaatggcgaaagcaataccattcgaaggtgcaacaaagatgaggatctggaggagcatataatcaagctcctagagaagagccactcaaaatatatttatagtagcacagaagggcgcaataagaatgattacggaaaggttataccgttaggcatcaagagtctggcatga

SEQ ID NO: 10938 - protein, 332 aa, Sorghum bicolor
  misc_feature: Ceres ANNOT ID no. 6118078
  misc_feature (41)..(288): Pfam Id: DFP Pfam Desc: DNA / pantothenate metabolism flavoprotein
  misc_feature (5)..(317): NCBI GI: 115475039 NCBI Desc: os08g0176100 [oryza sativa (japonica cultivar-group)]
  misc_feature (128)..(311): NCBI GI: 8778623 NCBI Desc: f5o11.7 [arabidopsis thaliana]
  misc_feature (37)..(316): NCBI GI: 49119251 NCBI Desc: mgc80633 protein [xenopus laevis]
  misc_feature (8)..(313): NCBI GI: 48101027 NCBI Desc: similar to ensangp00000013327 [apis mellifera]
  misc_feature (3)..(318): NCBI GI: 44986421 NCBI Desc: agr391wp [eremothecium gossypii]
MVAAGDPESFFATSPPLRDASAIAANLQEFVARNSHASSEGGGRRRIVCVTSGGTTVPLEQRCVRYIDNFSSGHRGAASTEYFLKAGYAVIFVHRRGSCQPFSRFLPDDSFLQFFDVTTDLKVQVVESQATVVKKAIGDYRKAIEGGSLLKLPFTTIFEYLQLLKMVATSMSSVGLHGMFYLAAAVSDFYVPWDSMEKHKIQSAGGPLDMKLSQVPKMLSVLRNQWAPLAFCISFKLETDSDILVQKAEMALNKYRMNVVVANLLATYKEEVVIISNGESNTIRRCNKDEDLEEHIIKLLEKSHSKYIYSSTEGRNKNDYGKVIPLGIKSLA

SEQ ID NO: 10939 - DNA, 1161 bp, Sorghum bicolor
  misc_feature: Ceres ANNOT ID no. 6118081
  misc_feature: Encodes the peptide sequence at SEQ ID NO 10940
atggcgccgccgcagcgctggccgccggagctgaacgaagacatcaccgtggagattctcctccgcatcccgccggacgagcccgcgcatctcatccgcgcctccgtcgtctgcaagctctggctccacgtcgtttccgaccccgcgttcctcagccgctacagcgctttccaccgaggtgccccgctgctcggcttcttttacaatctcgattccgcatggttcttccctggcttcgtccccaccacggcagcctcgccgccgccccagccggggcacagcgactgggttagatgggtccctgactgccgccacggccgcgtcctcctcaaagggattggcagcctctgcaaatgcatcctcatgagagggattggcagcaggacctttctcgtgtgggatccattctccaatcactgggaggaggtggaggcgcccagctccttgtccaccacattccaatccaacgcagtggtgctttgcgccttgcctggctgcgatcacagcagctgccgcggtggtccgttccatgtggtctttgtgggcgccgacaaattcgactacaccattgtccatgcacatgtttattcatcggagtctcgttcctggtgcacaacagcttctgcacaattagacggtacacgaaacttcttcgacaagaagcgtgctgttcttatcagagatggaatctactgcactgtgaatgatggtgctagaattctgaagtatgatttggtcgagcaccatttgtctttaatcggcatgccttacctgtacaaaaatgttccagtccttatgcagaatgaggatggttcgttggggattgctggtgtgttggattcaagactttacctttggtcgacagtggtgaatttagagggagttacaggatgggtacaacggagggtcatcgaacttaaggaaatattgcctgtggatgttatttctgaccaagctaatttgattggttttgctgagggtgtcgaggttttcttcataagcacaaatgttggtgccttcacatttgagctgaagtctcgcagggtgacaaaggtaggcaaacctagggattaccattgtgccacccccttcattagcttcttccgtccagatcgtgcttgcagcaaatggacaaagtcatcactagctcacccaaattaa

SEQ ID NO: 10940 - protein, 386 aa, Sorghum bicolor
  misc_feature: Ceres ANNOT ID no. 6118081
  misc_feature (6)..(56): Pfam Id: F-box Pfam Desc: F-box domain
  misc_feature (8)..(370): NCBI GI: 115437584 NCBI Desc: os01g0557400 [oryza sativa (japonica cultivar-group)]
  misc_feature (8)..(370): NCBI GI: 115470391 NCBI Desc: os07g0122900 [oryza sativa (japonica cultivar-group)]
  misc_feature (1)..(370): NCBI GI: 115475786 NCBI Desc: os08g0299900 [oryza sativa (japonica cultivar-group)]
  misc_feature (1)..(210): NCBI GI: 38567955 NCBI Desc: osjnbb0115i21.11 [oryza sativa (japonica cultivar-group)]
  misc_feature (24)..(370): NCBI GI: 115481210 NCBI Desc: os10g0158700 [oryza sativa (japonica cultivar-group)]
  misc_feature: The sequence is a functional homolog of SEQ ID NO. 456 in the 11/188,298 US application
MAPPQRWPPELNEDITVEILLRIPPDEPAHLIRASVVCKLWLHVVSDPAFLSRYSAFHRGAPLLGFFYNLDSAWFFPGFVPTTAASPPPQPGHSDWVRWVPDCRHGRVLLKGIGSLCKCILMRGIGSRTFLVWDPFSNHWEEVEAPSSLSTTFQSNAVVLCALPGCDHSSCRGGPFHVVFVGADKFDYTIVHAHVYSSESRSWCTTASAQLDGTRNFFDKKRAVLIRDGIYCTVNDGARILKYDLVEHHLSLIGMPYLYKNVPVLMQNEDGSLGIAGVLDSRLYLWSTVVNLEGVTGWVQRRVIELKEILPVDVISDQANLIGFAEGVEVFFISTNVGAFTFELKSRRVTKVGKPRDYHCATPFISFFRPDRACSKWTKSSLAHPN

SEQ ID NO: 10941 - DNA, 1605 bp, Sorghum bicolor
  misc_feature: Ceres ANNOT ID no. 6118092
  misc_feature: Encodes the peptide sequence at SEQ ID NO 10942
atggacggtggtgacggcggcaaggaggacggcaacaacaagcagcgcctcgagtgggccaccatgaacctggagcgcggcgtcgtcgtcggcgccggcgagaagaagggcggcaatgcgagccggaagccgccgataggcatcgtccggctcttcttggcctgcatggtctccggcggcatccagtacggctgggcgctgcagctctccctcctctcgccctactctcagactcttgggatctcgcacagctacgtgtcactgacatggatctgcggacctatcgccggatttgtggtgcaacccatcgtgggctactacagcgaccggtgcacgtcgaagatgggccggaggaggccattcatcctcgctggatgcatcatcatctgcctctctgtgatgatgatcggcttctcggcggacatcgggcggcgcctcggcgacaccaaggagcactgcagcacgttcaccggctcccgctggtacgccgccgccgtctacattgtcggcttctggttcctcgacttcgccaacaacaccgtccagggaccggctcgcgcgatgatggccgacctagcagctggacatcacggccccaacgttggccaggccatcttctccctgtggatggctctcggcagcgtgctcggatacttggccggcgccaacgcgaaatggcacgagtggcttccttggctcaaaactgcggcgtgctgcgatgcctgcgcgaacctcaagggcgccttcttgactgcggtgatcctcatcatagtcaccatgtcggtcaccttgtggctcgccggcgaggagctactcgacaaggccaacgtcgacgacgcctcgggcggcgcgtgctccgcgttcgtcgatctcttcaagagcctcaagaaccttccccctgccatgttcagcgtgctcgccgtcacggccgtcacctggctgtcgtggttcccgttcatccagtacaacacggactggatgggtcgggagatcttccacggcgagccgcagggcgcgggcggcaaggcggacctgtacgacgcgggcgtccgcgagggcgccgtgggcctcctcttctgctccgtcttgctgggcgtcacctccttcctcatccccaagctctgccggaagctcacgtcccgggtcgtctggtccatcagcaacctcatggtgttcgtcctcatgacggccatggtcgcgctcggcatcgtctccatgaagggctacaggccctcgctcgccgcctctctctccgccggccccgaccacaggttcaagagtggcgctctcgcgatcttcgcactcattggcatccctcaggccgtgctgttcagtgtgccatgggccgtggtgtctgaggttgccgctgaggagggcggtggccaaggtctcaccattggcgtcctcaacatcgccatcgtcctcccacagctggtgatcgcgctcagcgcaggccccatcgacggcgccttcaacaaagggaacaccccggccttgggcatcggcggcgtcttcgccctcatctgcgcggtcctggcgctcgtcctactcccaaagacgagaggtgtctccaacgccaccgtcatggcgggcggcggccactga

SEQ ID NO: 10942 - protein, 534 aa, Sorghum bicolor
  misc_feature: Ceres ANNOT ID no. 6118092
  misc_feature (54)..(481): Pfam Id: MFS_1 Pfam Desc: Major Facilitator Superfamily
  misc_feature (52)..(530): Pfam Id: Sugar_tr Pfam Desc: Sugar (and other) transporter
  misc_feature (5)..(532): NCBI GI: 50725247 NCBI Desc: sucrose transporter [oryza sativa (japonica cultivar-group)]
  misc_feature (5)..(532): NCBI GI: 29467456 NCBI Desc: sucrose transporter [oryza sativa (japonica cultivar-group)]
  misc_feature (5)..(532): NCBI GI: 67937444 NCBI Desc: sut5z [oryza sativa (japonica cultivar-group)]
  misc_feature (7)..(532): NCBI GI: 66269698 NCBI Desc: sucrose transporter bosut1 [bambusa oldhamii]
  misc_feature (24)..(532): NCBI GI: 54873545 NCBI Desc: sucrose transporter [saccharum hybrid cultivar]
  misc_feature: Useful for making plants with modulated heat sensitivity
  misc_feature: GREAT-hit functional homolog of the protein sequence given in SEQ ID NO 13009
  misc_feature: Useful for making plants with modulated heat sensitivity
  misc_feature: Functional homolog of the protein sequence given in SEQ ID NO 13009
MDGGDGGKEDGNNKQRLEWATMNLERGVVVGAGEKKGGNASRKPPIGIVRLFLACMVSGGIQYGWALQLSLLSPYSQTLGISHSYVSLTWICGPIAGFVVQPIVGYYSDRCTSKMGRRRPFILAGCIIICLSVMMIGFSADIGRRLGDTKEHCSTFTGSRWYAAAVYIVGFWFLDFANNTVQGPARAMMADLAAGHHGPNVGQAIFSLWMALGSVLGYLAGANAKWHEWLPWLKTAACCDACANLKGAFLTAVILIIVTMSVTLWLAGEELLDKANVDDASGGACSAFVDLFKSLKNLPPAMFSVLAVTAVTWLSWFPFIQYNTDWMGREIFHGEPQGAGGKADLYDAGVREGAVGLLFCSVLLGVTSFLIPKLCRKLTSRVVWSISNLMVFVLMTAMVALGIVSMKGYRPSLAASLSAGPDHRFKSGALAIFALIGIPQAVLFSVPWAVVSEVAAEEGGGQGLTIGVLNIAIVLPQLVIALSAGPIDGAFNKGNTPALGIGGVFALICAVLALVLLPKTRGVSNATVMAGGGH

SEQ ID NO: 10943 - DNA, 1860 bp, Sorghum bicolor
  misc_feature: Ceres ANNOT ID no. 6118098
  misc_feature: Encodes the peptide sequence at SEQ ID NO 10944
atgtggatgacaaagaagcttgccatcacggttctgctcatgcttacttctctgctgacagcacggtatttgatagagcacagtgcgaattcggggatatctcggtatcaaatcctccatctggttcacctggactggttcaagagcccagcggatgcacgagaaaccaccactctggaagtagcagtagtaacaacagcagatgctcctccagcttcaaacagctcggattccagaaactcctcccctgaagtgtttcagtggctatacacatggaaccagatgaagcagttagccaacatcaccaacggccttcctcatgcgagcgaggcgatcagcgatgggagaactgcatgggaaaacttgacagcatcagttcagaatgcaagctctcagcacagagagaaagagagactctgcccgtactcaattcgcagaatggatgcttccaagtcggagaatggcatctttaccattgatgtaccctgtgggctgattgtaggttcttcaataactcttataggaactcctggagtactctctggtaacttctggattgatcttgttgggacggcacttccaggggaatctgaaaagcctattgcactgcattacaatgtccgtctgaatggcgacaaggttactaaagatccagtgatagtgcagaataccttcaccgcaaacaatggctggggggttgaggatcgctgtcccagcactaactatagcaatgcaactgaagtggaagatctagagagatgtaatgccatggtgggcacagaagaggacataaataactcaaaacatcatacagctgccaaacatggagagccaagcaagtattttccatttaaacagggataccttgctattgcaacactgcgtgtaggatcggagggtatccatatgacagttgatgggaaacatgtcacttcatttgcatatagggcgggtttggaaccatggtatgtaactgaagtaggaatttctggtgatttcaaacttgtaagtgcgattgtaagcggcttgcccacatcagaagacttggagaactctaatattgaagcgttgaagtcaccacctattccagacgacaaagatgtagaccttctgattggcatcttttcaacagcaaacaacttcaagcgtaggatggcaattcgaaggacatggatgcaatatgacgctgtgcgccaaggagcagtagcagtccgatttttcgttggcctgcatacaaacctaatggtaaatgaggaactctggaatgaggcacaaacgtatggtgacatccaggtgttgccttttgttgattactacagcctgataacatggaagacactagcaatatgcatttatgggaccagttcactatcagccaagtatctgatgaaaacagatgatgatgcttttgtccgtgtagatgagatccaatccacagtaaaacagcttaatgtcagccatgggctactttatggtcgcataaattctgattccagtccccacagaaatcctgaaagcaaatggtacataagcgaagaggaatggcctgaagagaaatacccaccatgggctcatggaccaggatatgtagtttcacaagacattgcaagggcaatcaacaattggtataaagcaagtcgcttaaagatgttcaaactagaggatgtagcaatgggcatatgggtaaatgatatgaagaaagatggattaccagtcaaatatgaaacagacaagagaattaacattgacggatgcaatgatgggtacgttgttgctcactaccaagaaccaagacatctgctatgcatgtgggagaagctcctaacgacacaacaagcagaatgctgcagtactaagtaa

SEQ ID NO: 10944 - protein, 619 aa, Sorghum bicolor
  misc_feature: Ceres ANNOT ID no. 6118098
  misc_feature (382)..(578): Pfam Id: Galactosyl_T Pfam Desc: Galactosyltransferase
  misc_feature (156)..(340): Pfam Id: Gal-bind_lectin Pfam Desc: Galactoside-binding lectin
  misc_feature (1)..(617): NCBI GI: 115446881 NCBI Desc: os02g0577300 [oryza sativa (japonica cultivar-group)]
  misc_feature (313)..(513): NCBI GI: 9295733 NCBI Desc: t24p13.20 [arabidopsis thaliana]
  misc_feature (75)..(616): NCBI GI: 13605629 NCBI Desc: at3g06440/f24p17_7 [arabidopsis thaliana]
  misc_feature (75)..(539): NCBI GI: 145331986 NCBI Desc: galactosyltransferase family protein [arabidopsis thaliana]
  misc_feature (175)..(619): NCBI GI: 34393273 NCBI Desc: galactosyltransferase family-like protein [oryza sativa (japonica cultivar-group)]
  misc_feature: The sequence is a functional homolog of SEQ ID NO. 346 in the 11/188,298 US application
MWMTKKLAITVLLMLTSLLTARYLIEHSANSGISRYQILHLVHLDWFKSPADARETTTLEVAVVTTADAPPASNSSDSRNSSPEVFQWLYTWNQMKQLANITNGLPHASEAISDGRTAWENLTASVQNASSQHREKERLCPYSIRRMDASKSENGIFTIDVPCGLIVGSSITLIGTPGVLSGNFWIDLVGTALPGESEKPIALHYNVRLNGDKVTKDPVIVQNTFTANNGWGVEDRCPSTNYSNATEVEDLERCNAMVGTEEDINNSKHHTAAKHGEPSKYFPFKQGYLAIATLRVGSEGIHMTVDGKHVTSFAYRAGLEPWYVTEVGISGDFKLVSAIVSGLPTSEDLENSNIEALKSPPIPDDKDVDLLIGIFSTANNFKRRMAIRRTWMQYDAVRQGAVAVRFFVGLHTNLMVNEELWNEAQTYGDIQVLPFVDYYSLITWKTLAICIYGTSSLSAKYLMKTDDDAFVRVDEIQSTVKQLNVSHGLLYGRINSDSSPHRNPESKWYISEEEWPEEKYPPWAHGPGYVVSQDIARAINNWYKASRLKMFKLEDVAMGIWVNDMKKDGLPVKYETDKRINIDGCNDGYVVAHYQEPRHLLCMWEKLLTTQQAECCSTK

SEQ ID NO: 10945 - DNA, 1089 bp, Sorghum bicolor
  misc_feature: Ceres ANNOT ID no. 6118112
  misc_feature: Encodes the peptide sequence at SEQ ID NO 10946
atggagcacgacgtgcaccaccaccaccatcagcagccggaggaggccatggagctgccgccggggttccgattccaccccaccgacgaggagctcatcacgcactacctcgccaggaaggccgccgacccccgcttcgccccgcgcgccgtcggcgtggccgacctcaacaagtgcgagccatgggacctgccatatcgggcgacgatgggggagaaggagtggtacttcttctgcgtcaaggaccgcaagtacccgacggggctgaggacgaaccgggccaccgagtccggctactggaaggcgacgggtaaggacagggagatcttcaggggcaaggccctcgtcggcttgaagaagacgctcgtcttctacacggggagggctcccaggggcggcaagaccggctgggtcatgcacgagtaccgcctccatggcaagcacgccgccgccgccgccgccgccagcagcagcagcagcctcatcccgtcggtcagagctggcgcgtcaaaggacgactgggtgctgtgcagggtgttcaagaagagcatcgagccgccgtcgtcagtggccggcggcagcaagaggtcatcatcatcggttgcgtgcatggggatggaggacgtcgtggggccgtccaggtccatggcggacgacttcgccgcgtccacgctgcccccgctgatggacgtgtccggcggcagcggcggcaacatgtcactttcagcggcggcggcggctgcggcgtccatcgagctgacgacgccaccggcaccacacgtgacctgcttctccaacacgctggagggccacttcctgaccccaccaacctgcctcctcccctccgccgccgccaccgcctcgccgttcctggcgagcatggcgcagtacgacggcgacgcgggcgtgggcggcatggtgcacgagctcctgcaggaggccggcgggtggtacagcaagctgggcgagagggagcggctgagcggcggcgcgtcgcaggacaccggcgtcacctcggaggtgaaccccgccgagatctcctcgacgcggcaccacatggatcacgaggcctccttttggggcttctga

SEQ ID NO: 10946 - protein, 362 aa, Sorghum bicolor
  misc_feature: Ceres ANNOT ID no. 6118112
  misc_feature (19)..(145): Pfam Id: NAM Pfam Desc: No apical meristem (NAM) protein
  misc_feature (1)..(211): NCBI GI: 115446897 NCBI Desc: os02g0579000 [oryza sativa (japonica cultivar-group)]
  misc_feature (17)..(352): NCBI GI: 27529808 NCBI Desc: osnac1 protein [oryza sativa]
  misc_feature (12)..(362): NCBI GI: 38344965 NCBI Desc: osjnba0072f16.10 [oryza sativa (japonica cultivar-group)]
  misc_feature (12)..(362): NCBI GI: 116310448 NCBI Desc: h0219h12.10 [oryza sativa (indica cultivar-group)]
  misc_feature (17)..(362): NCBI GI: 27529810 NCBI Desc: osnac2 protein [oryza sativa]
  misc_feature: The sequence is a functional homolog of SEQ ID NO 151 in the 11/479,226US patent application
  misc_feature: The sequence is a functional homolog of SEQ ID NO 32 in the 10/412,699US patent application
  misc_feature: The sequence is a functional homolog of SEQ ID NO 326 in the 10/412,699US patent application
  misc_feature: The sequence is a functional homolog of SEQ ID NO 760 in the 11/479,226US patent application
  misc_feature: Useful for making plants with altered terpenoid content
  misc_feature: Useful for making plants with modulated growth and phenotype characteristics
  misc_feature: Functional homolog of the protein sequence given in SEQ ID NO 13140
  misc_feature: The sequence is a functional homolog of SEQ ID NO 32 in the 20040045049 US patent application
  misc_feature: The sequence is a functional homolog of SEQ ID NO 326 in the 20040045049 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MEHDVHHHHHQQPEEAMELPPGFRFHPTDEELITHYLARKAADPRFAPRAVGVADLNKCEPWDLPYRATMGEKEWYFFCVKDRKYPTGLRTNRATESGYWKATGKDREIFRGKALVGLKKTLVFYTGRAPRGGKTGWVMHEYRLHGKHAAAAAAASSSSSLIPSVRAGASKDDWVLCRVFKKSIEPPSSVAGGSKRSSSSVACMGMEDVVGPSRSMADDFAASTLPPLMDVSGGSGGNMSLSAAAAAAASIELTTPPAPHVTCFSNTLEGHFLTPPTCLLPSAAATASPFLASMAQYDGDAGVGGMVHELLQEAGGWYSKLGERERLSGGASQDTGVTSEVNPAEISSTRHHMDHEASFWGF

SEQ ID NO: 10947 - DNA, 546 bp, Sorghum bicolor
  misc_feature: Ceres ANNOT ID no. 6118119
  misc_feature: Encodes the peptide sequence at SEQ ID NO 10948
atgtacccgaaggcagacgagggtgcgcagccgctggccacgggcatccccatcagcggcgggcggggcggctactaccaggcgggcggcgcgacggcggcgttcgcggtgcaggcgcaggcggcgcccgtcgccgcctggtccacggggctctgcgactgcttcgacgactgcagcaactgctgcgtgacgtgcctgtgcccgtgcatcacgttcgggcagatcgcggagatcatcgaccggggctccacgtcgtgcggcaccagcggcgcgctgtacacgctcgtcatgctgctcaccggctgccagtgcgtctactcctgcttctaccgcgccaagatgcgcgcgcagtacggcctccgggagagcccctgcgccgactgctgcgtccactgctgctgcgagtgctgcgcgctctgccaggagttccgcgagctcaagaagcgggggttcgacatgaacatagggtggcatgcgaacatggagaggcaggggcgcaccgccgccaccatgccgccgctgatgcaccctgggatgacccgctga

SEQ ID NO: 10948 - protein, 181 aa, Sorghum bicolor
  misc_feature: Ceres ANNOT ID no. 6118119
  misc_feature (47)..(146): Pfam Id: PLAC8 Pfam Desc: PLAC8 family
  misc_feature (33)..(181): NCBI GI: 115458794 NCBI Desc: os04g0461600 [oryza sativa (japonica cultivar-group)]
  misc_feature (10)..(181): NCBI GI: 144924419 NCBI Desc: uncharacterized cys-rich domain [medicago truncatula]
  misc_feature (26)..(181): NCBI GI: 144924422 NCBI Desc: uncharacterized cys-rich domain [medicago truncatula]
  misc_feature (37)..(181): NCBI GI: 8272628 NCBI Desc: orfx [lycopersicon pennellii]
  misc_feature (37)..(181): NCBI GI: 27414001 NCBI Desc: fw2.2 [lycopersicon esculentum]
MYPKADEGAQPLATGIPISGGRGGYYQAGGATAAFAVQAQAAPVAAWSTGLCDCFDDCSNCCVTCLCPCITFGQIAEIIDRGSTSCGTSGALYTLVMLLTGCQCVYSCFYRAKMRAQYGLRESPCADCCVHCCCECCALCQEFRELKKRGFDMNIGWHANMERQGRTAATMPPLMHPGMTR

SEQ ID NO: 10949 - DNA, 717 bp, Sorghum bicolor
  misc_feature: Ceres ANNOT ID no. 6118121
  misc_feature: Encodes the peptide sequence at SEQ ID NO 10950
  misc_feature: Up-regulated in root tissues in response to salicylic acid treatment
  misc_feature: Up-regulated in shoot tissues in response to salicylic acid treatment
atgaagtgccgctccgattcgtcaggcggtggcgacgacccccggcccccgccgcccgctgccacgggcgttggcggctcgccctcgggcgagccgagtaagaagcagcggacggaggagccgcccccaggctccagcgtggcgggcgagtgctcgtcttcgtccacgcaggctccgctggcgccgctgttgccgcaggaagcaagagtgggcgatccggcgccgccgccgccgccaggtcccgagtccggagggggcgagcaggtgatgagggtgccggatctcggggaggacctggtgttcgaggtgctgatgcgggcggaggcccggacgctggcggccgcggcgtgcgtgagccgcgggtggcgcgtgctggcgcgggacgagcggctgtgggaggcggcgtgcgtgcgggattgggcctacactgggtcctccgagcagatgcttcgcaccgtcgtgctttcgctcggcggcttccggcgcctgcacgagatgtacatccggccggtccagcagcgtgctgctggagcgccgccgcctgggcagcagcagaggcggcagttgccggtgaggatgggccgggatcaggtccaagtctcactgtctctgctctcgacctcgttctttctgaatatgcctaatgctcctccaccacctcctcctaaggacaaggataaagatagagataagaatggaggtggccaatgtgggtga

SEQ ID NO: 10950 - protein, 238 aa, Sorghum bicolor
  misc_feature: Ceres ANNOT ID no. 6118121
  misc_feature (90)..(137): Pfam Id: F-box Pfam Desc: F-box domain
  misc_feature (16)..(238): NCBI GI: 75232260 NCBI Desc: f-box protein gid2 (gibberellin-insensitive dwarf protein 2) (protein gibberellin insensitive dwarf2)
  misc_feature (16)..(238): NCBI GI: 33411641 NCBI Desc: gid2 [oryza sativa (japonica cultivar-group)]
  misc_feature (41)..(177): NCBI GI: 118213814 NCBI Desc: gid2l [triticum aestivum]
  misc_feature (94)..(215): NCBI GI: 126256295 NCBI Desc: f-box protein [gossypium hirsutum]
  misc_feature (84)..(174): NCBI GI: 108706661 NCBI Desc: f-box domain containing protein [oryza sativa (japonica cultivar-group)]
  misc_feature: Up-regulated in root tissues in response to salicylic acid treatment
  misc_feature: Up-regulated in shoot tissues in response to salicylic acid treatment
MKCRSDSSGGGDDPRPPPPAATGVGGSPSGEPSKKQRTEEPPPGSSVAGECSSSSTQAPLAPLLPQEARVGDPAPPPPPGPESGGGEQVMRVPDLGEDLVFEVLMRAEARTLAAAACVSRGWRVLARDERLWEAACVRDWAYTGSSEQMLRTVVLSLGGFRRLHEMYIRPVQQRAAGAPPPGQQQRRQLPVRMGRDQVQVSLSLLSTSFFLNMPNAPPPPPPKDKDKDRDKNGGGQCG

SEQ ID NO: 10951 - DNA, 666 bp, Sorghum bicolor
  misc_feature: Ceres ANNOT ID no. 6118127
  misc_feature: Encodes the peptide sequence at SEQ ID NO 10952
atggatccggcgtccgaggagctcgagcgccgcagccgctacctcagctcgctcatccgccgcaccaagctcagcgccgccccggctcgagctccccctcctcagccggagccggagcccgaggtggcggtggcgccaccgaatccgaatccggagccggagccggagccggaggccgcggttgggaagcgcggggaggctaaggcggcggagccagtggccgaggagaaggaggaggaggagaagcgggaggccaaagaggcgggggacggcgagaaggggaaagagatcaaggcgaaggacgacgacagcaggaaggtgtcggtgcgggtgcgcgcggccgacatgcccctcccgctgcagcgccgcgcggtccgcctcgcctacgaagccatcgccgccatgccccgcctcgacagcaagcgccttgccctcgcgctcaagaaggaatttgatacagcatatggtcctgcttggcattgcattgttggaacaagctttggttcctatgtcacccactctctgggaggtttcttgtacttctctgtcgacaaggcctatattcttctcttcagaaccgctgttgagccactaggccatccaaggttaaggagagtagaacgatcatcgccctccatgcaaatatgtagaaccaatctgctgtaa

SEQ ID NO: 10952 - protein, 221 aa, Sorghum bicolor
  misc_feature: Ceres ANNOT ID no. 6118127
  misc_feature (104)..(194): Pfam Id: Dynein_light Pfam Desc: Dynein light chain type 1
  misc_feature (1)..(202): NCBI GI: 115458808 NCBI Desc: os04g0462600 [oryza sativa (japonica cultivar-group)]
  misc_feature (1)..(202): NCBI GI: 90265193 NCBI Desc: b0812a04.2 [oryza sativa (indica cultivar-group)]
  misc_feature (113)..(196): NCBI GI: 66796189 NCBI Desc: dynein light chain [vicia faba]
  misc_feature (68)..(196): NCBI GI: 140069144 NCBI Desc: dynein light chain, type 1 [medicago truncatula]
  misc_feature (150)..(200): NCBI GI: 144924424 NCBI Desc: dynein light chain, type 1 [medicago truncatula]
MDPASEELERRSRYLSSLIRRTKLSAAPARAPPPQPEPEPEVAVAPPNPNPEPEPEPEAAVGKRGEAKAAEPVAEEKEEEEKREAKEAGDGEKGKEIKAKDDDSRKVSVRVRAADMPLPLQRRAVRLAYEAIAAMPRLDSKRLALALKKEFDTAYGPAWHCIVGTSFGSYVTHSLGGFLYFSVDKAYILLFRTAVEPLGHPRLRRVERSSPSMQICRTNLL

SEQ ID NO: 10953 - DNA, 1524 bp, Sorghum bicolor
  misc_feature: Ceres ANNOT ID no. 6118518
  misc_feature: Encodes the peptide sequence at SEQ ID NO 10954
atggctgctgatggcacggaggtatctgccggcggggatggcggcggcaacaagcagccgcagatcagcattgtggggctgttcctcgcatgcatggtcgccggcggcgtgcagtacggatgggcgctgcagctctccctcctgaccccctacgtccagacactggggattcctcatgctcttacttcagtcatgtggctttgtggacctattgctggcttacttgtgcaaccctgcgtcggcctctacagtgacaaatgcacttctaagcttgggagacggagaccattcatctttacaggatgcatcgtcatctgtatatcagtgatagtcataggcttctcctccgacattggttacgctctcggtgacaccacggaagactgcaaggtttacacggggaagcggctgcacgcggccttgttcttcgtcatgggattctggctgctcgacttttccaacaacacggtgcagggacctgcgcgcgcgctcatggccgacctcgcaggcagccatgggccgagcacggcgaacgccatcttcgtgtcgtggatggcgatcggcaacatcctgggctactcctcggggtccaccgacaagtggcacacctggttcccgttcctgcagaccaaggcgtgctgcgaggcgtgcgccaacctcaaggccgccttcctggtgtcggtggcgttccttggcctgtccacggtggtgaccatgatcttcgccaccgaggagccactggacccggcggcggcgaagcagggcgaggacggggagccgtcgggcccgttcgccgtgttcaagggcatgaagaacctgcccccgggaatgccgcaggtgctcatcgtcaccggcctcacctggctctcgtggttccccttcatcctcttcgacaccgactggatgggccgcgagatgtaccacggcaagcctgacgggagccccacggaggtggccaactaccaggagggcgtccgccagggcgccttcggcctgctcctcaactccatcgtcctcggcgtcagctccttcctcatcgagcccatgtgccgcaagctcaccgccaaggtggtgtgggtgattagcagcttcctcgtctgtgtcgccatggccatggtcaccgtcctcagctcctgggcgctcggcgacatcggtggcaacgtccaggatgccgccgcggtcgataagggcctcaagggcaccgcgcttgccatcttcgtcttcctcggctttcccttcgccgtcctatgcagcgttcctttcgccgtgacggcacagctggcggcgaccaagggcggcgggcaggggctgtgcacgggtgtcctcaacatctccatcgtgctgcctcagatgatcatcgccgtcggctctgggccgtgggacgagctgttcggcaagggcaacatcccggcgttcggggctgccgctggcttcgccttcaccgctgccgttgcagggatcatcatgctgccaaagcagcccaagaccagcttccggtccgtctccatgggaggaggccattga

SEQ ID NO: 10954 - protein, 507 aa, Sorghum bicolor
  misc_feature: Ceres ANNOT ID no. 6118518
  misc_feature (28)..(467): Pfam Id: Sugar_tr Pfam Desc: Sugar (and other) transporter
  misc_feature (1)..(507): NCBI GI: 15718401 NCBI Desc: sucrose transporter [oryza sativa (japonica cultivar-group)]
  misc_feature (1)..(507): NCBI GI: 16152148 NCBI Desc: sucrose transporter [oryza sativa (indica cultivar-group)]
  misc_feature (10)..(507): NCBI GI: 9624451 NCBI Desc: sucrose transporter [oryza sativa (indica cultivar-group)]
  misc_feature (10)..(507): NCBI GI: 2723471 NCBI Desc: sucrose transporter [oryza sativa (japonica cultivar-group)]
  misc_feature (8)..(507): NCBI GI: 71890897 NCBI Desc: sucrose transporter 1 [hordeum vulgare subsp. vulgare]
  misc_feature: Useful for making plants with modulated heat sensitivity
  misc_feature: Functional homolog of the protein sequence given in SEQ ID NO 13009
MAADGTEVSAGGDGGGNKQPQISIVGLFLACMVAGGVQYGWALQLSLLTPYVQTLGIPHALTSVMWLCGPIAGLLVQPCVGLYSDKCTSKLGRRRPFIFTGCIVICISVIVIGFSSDIGYALGDTTEDCKVYTGKRLHAALFFVMGFWLLDFSNNTVQGPARALMADLAGSHGPSTANAIFVSWMAIGNILGYSSGSTDKWHTWFPFLQTKACCEACANLKAAFLVSVAFLGLSTVVTMIFATEEPLDPAAAKQGEDGEPSGPFAVFKGMKNLPPGMPQVLIVTGLTWLSWFPFILFDTDWMGREMYHGKPDGSPTEVANYQEGVRQGAFGLLLNSIVLGVSSFLIEPMCRKLTAKVVWVISSFLVCVAMAMVTVLSSWALGDIGGNVQDAAAVDKGLKGTALAIFVFLGFPFAVLCSVPFAVTAQLAATKGGGQGLCTGVLNISIVLPQMIIAVGSGPWDELFGKGNIPAFGAAAGFAFTAAVAGIIMLPKQPKTSFRSVSMGGGH

SEQ ID NO: 10955 - DNA, 645 bp, Sorghum bicolor
  misc_feature: Ceres ANNOT ID no. 6119023
  misc_feature: Encodes the peptide sequence at SEQ ID NO 10956
atggggcacccttacgcgccggccgaactggatctgccgggcttcgtgccgctgaagctgtcccaggccgagatcctcgtgtcctacctcggcgcctccctcttcgtcctcctcgccgtctggctcgtctccggaagatgtggcagattgtccaagaccgaccgtctgctcatgtgctggtgggcattcacagggttgacccacataatgatcgaggggccctttgtcttcactcctgatttcttcaagaaggagaaccccaatttcttcgatgaagtttggaaagagtatagtaagggggactctaggtatgttgctagggacgccgcaactgttactgttgaagggatcactgctgtattggaaggccctgcatcactgcttgctgtctatgctattggatcccggaagcccttcagccatattctccagtttgccgtctgtctaggtcagctctacggatgcttggtttactttatcaccgcatacttggatggcttcaacttctgggtcggtccattctacttctgggcatatttcattggtgcaaatagtttctggatttggataccgatgctcattgccataagatcctggaaggaaatatgcgcagcatttcaagctgaaaaggtgaagaccaattaa

SEQ ID NO: 10956 - protein, 214 aa, Sorghum bicolor
  misc_feature: Ceres ANNOT ID no. 6119023
  misc_feature (17)..(213): Pfam Id: EBP Pfam Desc: Emopamil binding protein
  misc_feature (1)..(212): NCBI GI: 46849989 NCBI Desc: sterol-8,7-isomerase [zea mays]
  misc_feature (3)..(213): NCBI GI: 18202916 NCBI Desc: probable 3-beta-hydroxysteroid-delta(8),delta(7)-isomerase (cholestenol delta-isomerase) (delta8-delta7 sterol isomerase) (d8-d7 sterol
  misc_feature (3)..(213): NCBI GI: 18202916 (continued) isomerase)
  misc_feature (1)..(213): NCBI GI: 126513554 NCBI Desc: c-8,7-sterol isomerase [hordeum vulgare]
  misc_feature (1)..(205): NCBI GI: 21554213 NCBI Desc: c-8,7 sterol isomerase [arabidopsis thaliana]
  misc_feature (1)..(205): NCBI GI: 4098989 NCBI Desc: phenylalkylamine binding protein homolog [arabidopsis thaliana]
  misc_feature: Useful for making plants with altered sterol content
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13509
  misc_feature: Useful for making plants with altered sterol content
  misc_feature: Useful for making plants with modulated nitrogen use efficiency
  misc_feature: Functional homolog of the protein sequence given in SEQ ID NO 13509
MGHPYAPAELDLPGFVPLKLSQAEILVSYLGASLFVLLAVWLVSGRCGRLSKTDRLLMCWWAFTGLTHIMIEGPFVFTPDFFKKENPNFFDEVWKEYSKGDSRYVARDAATVTVEGITAVLEGPASLLAVYAIGSRKPFSHILQFAVCLGQLYGCLVYFITAYLDGFNFWVGPFYFWAYFIGANSFWIWIPMLIAIRSWKEICAAFQAEKVKTN

SEQ ID NO: 10957 - DNA, 645 bp, Sorghum bicolor
  misc_feature: Ceres ANNOT ID no. 6119025
  misc_feature: Encodes the peptide sequence at SEQ ID NO 10958
atggggcacccttacgcgccggccgaactggatctgccgggcttcgtgccgctgaagctgtcccaggccgagatcctcgtgtcctacctcggcgcctccctcttcgtcctcctcgccgtctggctcgtctccggaagatgtggcagattatccaagaccgaccgtctgctcatgtgttggtgggcattcacagggttgacccacataatgatcgaggggccctttgtcttcactcctgatttcttcaagaaggagaaccccaatttcttcgatgaagtttggaaagagtatagtaagggggactctaggtatgttgctagggacgccgcaactgttactgttgaagggatcactgctgtattggaaggccctgcatcactgcttgctgtctatgctattggatcccggaagtccttcagccatattctccagtttgccgtctgtctaggtcagctctacggatgcttggtttactttatcactgcatacttggatggcttcaacttctgggtcggtccattctacttctgggcatatttcattggtgcaaatagtttctggatttggataccgatgctcattgccataagatcctggaaggaaatatgcgcagcatttcaagctgaaaaggtgaagaccaaataa

SEQ ID NO: 10958 - protein, 214 aa, Sorghum bicolor
  misc_feature: Ceres ANNOT ID no. 6119025
  misc_feature (17)..(213): Pfam Id: EBP Pfam Desc: Emopamil binding protein
  misc_feature (1)..(214): NCBI GI: 46849989 NCBI Desc: sterol-8,7-isomerase [zea mays]
  misc_feature (3)..(214): NCBI GI: 18202916 NCBI Desc: probable 3-beta-hydroxysteroid-delta(8),delta(7)-isomerase (cholestenol delta-isomerase) (delta8-delta7 sterol isomerase) (d8-d7 sterol
  misc_feature (3)..(214): NCBI GI: 18202916 (continued) isomerase)
  misc_feature (1)..(214): NCBI GI: 126513554 NCBI Desc: c-8,7-sterol isomerase [hordeum vulgare]
  misc_feature (1)..(214): NCBI GI: 21554213 NCBI Desc: c-8,7 sterol isomerase [arabidopsis thaliana]
  misc_feature (1)..(214): NCBI GI: 4098989 NCBI Desc: phenylalkylamine binding protein homolog [arabidopsis thaliana]
  misc_feature: Useful for making plants with altered sterol content
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13509
  misc_feature: Useful for making plants with altered sterol content
  misc_feature: Useful for making plants with modulated nitrogen use efficiency
  misc_feature: Functional homolog of the protein sequence given in SEQ ID NO 13509
MGHPYAPAELDLPGFVPLKLSQAEILVSYLGASLFVLLAVWLVSGRCGRLSKTDRLLMCWWAFTGLTHIMIEGPFVFTPDFFKKENPNFFDEVWKEYSKGDSRYVARDAATVTVEGITAVLEGPASLLAVYAIGSRKSFSHILQFAVCLGQLYGCLVYFITAYLDGFNFWVGPFYFWAYFIGANSFWIWIPMLIAIRSWKEICAAFQAEKVKTK

SEQ ID NO: 10959 - DNA, 693 bp, Sorghum bicolor
  misc_feature: Ceres ANNOT ID no. 6119027
  misc_feature: Encodes the peptide sequence at SEQ ID NO 10960
atgaagaagatcttcggcgccaagaaggacaagggacctcccccctccatccaggacgccaccgagcgaataaacaagcggggcgagacggtggacgagaagatcaagaagctggacgaggagctggccaggtacaaggagcagatccgcaagacccgccccggcccgtcccaggaagccatcaaggcgcgcgccatccgactcctcaagcacaagcgcatgtacgaggagcagcgcaacatgttgtacaaccaaacctacaatctcgaccaagttgcctttgctgccgatggcctcaaggacgctcagcagactatgaatgcaatgaaggcagcaaacaaggagctcaagggaatgatgaaaactgtcaaaattgatgaaattgataatatgcaagatgaaatgacagatctgatggatgtgagcaatgagatacaagaaactcttggtagaagctacaacatccctgatgacgttgatgaggaagaactgatgggggagctagatgccttggagtctgatatggagtttgagtcagctgcagtcccctcatatcttcaaccagaatctgattttgatgctgacctcaacttacctgctgcaccaactcgccctgcagcagtcccagcaggcggggtgcaggaggatgagctaggattgccatcagtgcctcgagcatctcttcgcagttag

SEQ ID NO: 10960 - protein, 230 aa, Sorghum bicolor
  misc_feature: Ceres ANNOT ID no. 6119027
  misc_feature (12)..(206): Pfam Id: Snf7 Pfam Desc: Snf7
  misc_feature (66)..(229): NCBI GI: 42572355 NCBI Desc: snf7 family protein [arabidopsis thaliana]
  misc_feature (1)..(224): NCBI GI: 18088721 NCBI Desc: snf7 domain containing 2 [homo sapiens]
  misc_feature (1)..(224): NCBI GI: 119578917 NCBI Desc: chromatin modifying protein 5, isoform cra_b [homo sapiens]
  misc_feature (1)..(224): NCBI GI: 119578916 NCBI Desc: chromatin modifying protein 5, isoform cra_a [homo sapiens]
  misc_feature (1)..(224): NCBI GI: 123993007 NCBI Desc: chromatin modifying protein 5 [synthetic construct]
MKKIFGAKKDKGPPPSIQDATERINKRGETVDEKIKKLDEELARYKEQIRKTRPGPSQEAIKARAIRLLKHKRMYEEQRNMLYNQTYNLDQVAFAADGLKDAQQTMNAMKAANKELKGMMKTVKIDEIDNMQDEMTDLMDVSNEIQETLGRSYNIPDDVDEEELMGELDALESDMEFESAAVPSYLQPESDFDADLNLPAAPTRPAAVPAGGVQEDELGLPSVPRASLRS

SEQ ID NO: 10961 - DNA, 681 bp, Sorghum bicolor
  misc_feature: Ceres ANNOT ID no. 6119035
  misc_feature: Encodes the peptide sequence at SEQ ID NO 10962
atgggcggagacgggcacacgtacgcgccggcggacctgcacctcccgggcttcgtgccgctgcagctgtcgcagggccagatcctcgccccctacctgggcaccgccgtcttcgtcgtcctcgccgtctggctcctctccggtaccgctaccaccgccacctgtgaaggtgccgcgggttatccaagacggacccgtctgctcatgtgctggtgggcgttcaccggcctcacccacattgtcatcgagggggccttcgtcttcaaccccggattcttcagcaaggagaaccccacctacttcgatgaagcctataaggagtacagcaaaggcgattccagatacgtcgctagggaccccgcgaccgtcaccgtcgaagggattacagctgtgttagaaggccctgcgtcactgcttgcagtctatgccattgcatcccacaagtcctatagtcatattcttcagttcactgtctgcctgggccaactctacgggtgccttgtttacttcatcactgcgtacttggctggcttcaacttctggatcactccattctatttctgggcatatttcattggtgcaaacagtttctgggtttggataccaacgctcattgccatgaggagctggaagatcatttgcgcagcatttcgaactgaaaaggcaaagaagacaagataa

SEQ ID NO: 10962 - protein, 226 aa, Sorghum bicolor
  misc_feature: Ceres ANNOT ID no. 6119035
  misc_feature (20)..(224): Pfam Id: EBP Pfam Desc: Emopamil binding protein
  misc_feature (6)..(223): NCBI GI: 18202916 NCBI Desc: probable 3-beta-hydroxysteroid-delta(8),delta(7)-isomerase (cholestenol delta-isomerase) (delta8-delta7 sterol isomerase) (d8-d7 sterol
  misc_feature (6)..(223): NCBI GI: 18202916 (continued) isomerase)
  misc_feature (5)..(226): NCBI GI: 46849989 NCBI Desc: sterol-8,7-isomerase [zea mays]
  misc_feature (6)..(226): NCBI GI: 126513554 NCBI Desc: c-8,7-sterol isomerase [hordeum vulgare]
  misc_feature (6)..(226): NCBI GI: 21554213 NCBI Desc: c-8,7 sterol isomerase [arabidopsis thaliana]
  misc_feature (6)..(226): NCBI GI: 4098989 NCBI Desc: phenylalkylamine binding protein homolog [arabidopsis thaliana]
  misc_feature: Useful for making plants with altered sterol content
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13509
  misc_feature: Useful for making plants with altered sterol content
  misc_feature: Useful for making plants with modulated nitrogen use efficiency
  misc_feature: Functional homolog of the protein sequence given in SEQ ID NO 13509
MGGDGHTYAPADLHLPGFVPLQLSQGQILAPYLGTAVFVVLAVWLLSGTATTATCEGAAGYPRRTRLLMCWWAFTGLTHIVIEGAFVFNPGFFSKENPTYFDEAYKEYSKGDSRYVARDPATVTVEGITAVLEGPASLLAVYAIASHKSYSHILQFTVCLGQLYGCLVYFITAYLAGFNFWITPFYFWAYFIGANSFWVWIPTLIAMRSWKIICAAFRTEKAKKTR

SEQ ID NO: 10963 - DNA, 663 bp, Sorghum bicolor
  misc_feature: Ceres ANNOT ID no. 6119039
  misc_feature: Encodes the peptide sequence at SEQ ID NO 10964
atgggcgaaaatggccacccttactcgccggcggagctggagctgccagggttcgtgccgcagcggctgtcgcagggccagatcctcgcgcctttcgtcggcaacgccgtcttctccgtcctcggcgcctggctcatttccggaagatgccgcggcggcggtagattatccaggaccgaccgcttgctcatgggctggtggctgttcgccgcgctgacttacatcgtcttagagtcacccttcctcttcacccctgatttcctcagcaaggaaaaccctaattacttcgacgagctatttaaggagtacagcaaaggtgactctagattcgccgctaggaactccacagtcctcgcgcttgaagtggtaaccatcgtgctggaaggacctgcagctcttcttgcagcctatgcgattgcatcccggaagtcgtacagccacatcctccagttcgccgtttctttggcccagctatacggacgcttgctttacttcatcaccgcgtacctggatggcttcaacttctgggtcagtccgtactacttctgggcatatttcatcggttccaacagttcatgggtgatcataccaactctcgtcgccacaagaagctggaagaagatttcagcagcatttcaagctgagaagatcaagaccagataa

SEQ ID NO: 10964 - protein, 220 aa, Sorghum bicolor
  misc_feature: Ceres ANNOT ID no. 6119039
  misc_feature (20)..(219): Pfam Id: EBP Pfam Desc: Emopamil binding protein
  misc_feature (5)..(218): NCBI GI: 46849989 NCBI Desc: sterol-8,7-isomerase [zea mays]
  misc_feature (1)..(220): NCBI GI: 18202916 NCBI Desc: probable 3-beta-hydroxysteroid-delta(8),delta(7)-isomerase (cholestenol delta-isomerase) (delta8-delta7 sterol isomerase) (d8-d7 sterol
  misc_feature (1)..(220): NCBI GI: 18202916 (continued) isomerase)
  misc_feature (6)..(220): NCBI GI: 126513554 NCBI Desc: c-8,7-sterol isomerase [hordeum vulgare]
  misc_feature (1)..(211): NCBI GI: 21554213 NCBI Desc: c-8,7 sterol isomerase [arabidopsis thaliana]
  misc_feature (1)..(211): NCBI GI: 4098989 NCBI Desc: phenylalkylamine binding protein homolog [arabidopsis thaliana]
  misc_feature: Useful for making plants with altered sterol content
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13509
MGENGHPYSPAELELPGFVPQRLSQGQILAPFVGNAVFSVLGAWLISGRCRGGGRLSRTDRLLMGWWLFAALTYIVLESPFLFTPDFLSKENPNYFDELFKEYSKGDSRFAARNSTVLALEVVTIVLEGPAALLAAYAIASRKSYSHILQFAVSLAQLYGRLLYFITAYLDGFNFWVSPYYFWAYFIGSNSSWVIIPTLVATRSWKKISAAFQAEKIKTR

SEQ ID NO: 10965 - DNA, 660 bp, Sorghum bicolor
  misc_feature: Ceres ANNOT ID no. 6119041
  misc_feature: Encodes the peptide sequence at SEQ ID NO 10966
atgggcggacatggccacccttactcgccggcggagctggagctgccagggttcgtgccgcagcggctgtcgcagggccagatcctcgcccctttcgtgggcaccgccgtcttctccgtcctcggcgcctggctcatctccggaagatgcggcggcggtagattatccaagaccgaccgcttgctcttgggctggtgggtgttcaccgcgctggctcacatcgtcttcgagccacccttcctcttcacccctgatttcctcagcaaggagaacccaaatttcttcgacgagatgtttaaagagtacagcaaaggtgactccagatacgcctctcggaacactgtagtcctcgcacttgaagtgataactgttgggttcaaaggccctgcatcgcttcttgcagtctatgcgattgcatcccggaagtcgtacagccacatcctccagttcgccgtttctctgagccagctatacggatgcttggtttacttcatcaccgcgtacttggatggcttcaacttctgggtcagtccgttctacttctgggcatatttcatcggttccaacagttcatgggtgatcataccgacgctcgtcgccacaaggagctggaagaagatttcggcagcatttcaagctgagaaggtcaagaccagataa

SEQ ID NO: 10966 - protein, 219 aa, Sorghum bicolor
  misc_feature: Ceres ANNOT ID no. 6119041
  misc_feature (20)..(218): Pfam Id: EBP Pfam Desc: Emopamil binding protein
  misc_feature (5)..(217): NCBI GI: 46849989 NCBI Desc: sterol-8,7-isomerase [zea mays]
  misc_feature (4)..(219): NCBI GI: 18202916 NCBI Desc: probable 3-beta-hydroxysteroid-delta(8),delta(7)-isomerase (cholestenol delta-isomerase) (delta8-delta7 sterol isomerase) (d8-d7 sterol
  misc_feature (4)..(219): NCBI GI: 18202916 (continued) isomerase)
  misc_feature (6)..(219): NCBI GI: 126513554 NCBI Desc: c-8,7-sterol isomerase [hordeum vulgare]
  misc_feature (6)..(210): NCBI GI: 21554213 NCBI Desc: c-8,7 sterol isomerase [arabidopsis thaliana]
  misc_feature (6)..(210): NCBI GI: 4098989 NCBI Desc: phenylalkylamine binding protein homolog [arabidopsis thaliana]
  misc_feature: Useful for making plants with altered sterol content
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13509
MGGHGHPYSPAELELPGFVPQRLSQGQILAPFVGTAVFSVLGAWLISGRCGGGRLSKTDRLLLGWWVFTALAHIVFEPPFLFTPDFLSKENPNFFDEMFKEYSKGDSRYASRNTVVLALEVITVGFKGPASLLAVYAIASRKSYSHILQFAVSLSQLYGCLVYFITAYLDGFNFWVSPFYFWAYFIGSNSSWVIIPTLVATRSWKKISAAFQAEKVKTR

SEQ ID NO: 10967 - DNA, 1140 bp, Sorghum bicolor
  misc_feature: Ceres ANNOT ID no. 6119045
  misc_feature: Encodes the peptide sequence at SEQ ID NO 10968
atgagctcgctctgtcctttcgcgcgagccaccaatggtggtggcgtatgccctgtgaaatctgataagagcaacgctggggtgtgccctgcaaaatctgacaagagcatcagcggcgtatgccctgtcactgggaaggatcatggtagcgagctcaaggaaagtagtgaccatggtgaggaaaagagcactgatcctcgtgttgtgccagcaaaatgcccatttggctatgactccaacatgttcaagcttggtccgctcagctgcattgtctgccaggcactgctccatgagagtagcaaatgcaagccgtgtgcccataaattctgcaaggcatgtatatcacgctttaaagactgcccactatgtggtgctgatatagagggtattgagcctgatgctgagcttcaaactcttgttgatcgcttcattgatggccatgccagaatcaagcgatcacatgctaaaggggatgtagaagcagcaggtggcaagaataaagtcatatatgaggatgtctccatggagagaggagcttttctggtgcagcaagctatgagggcttttcgcgcccagaacattgaaagtgcaaaatcaaggcttactatgtgtgcggatgacatcagggaggagttgaaatcttcagaagctaacctagacttatgttcacagcttggagctgtattaggaatgcttggggactgctgtcggaccttgggagatgttccttcagcaatcacttactatgaagaaagtgctgagttcctctcgaaaccccctgcaaaagatcttgagctggttcatactctctctgtttcactaaataaaattggtgaccttcgctactatgatggcgatcttcaatctgcaagaaactactatgcccgttcattggatgttcgcagaaatgcagtaaaagaacactctgcagtggcttctcaggtcattgatctagcaacttctcttgccaaagtcgcggatgtggatagaaatcttgggaatgaaagtgcagcagttgagggttttgaggaagcaattcaatgccttgagaagttgaagctggattctgaacaagctagccttgaacagcggcgcctttcggttcttgacttcctaaacaaccaattggcagataaataa

SEQ ID NO: 10968 - protein, 379 aa, Sorghum bicolor
  misc_feature: Ceres ANNOT ID no. 6119045
  misc_feature (1)..(379): NCBI GI: 115434008 NCBI Desc: os01g0104100 [oryza sativa (japonica cultivar-group)]
  misc_feature (87)..(249): NCBI GI: 29437111 NCBI Desc: checkpoint with forkhead and ring finger domains [mus musculus]
  misc_feature (87)..(168): NCBI GI: 41688511 NCBI Desc: ubiquitin ligase protein chfr (checkpoint with forkhead and ring finger domains protein)
  misc_feature (87)..(168): NCBI GI: 119575199 NCBI Desc: checkpoint with forkhead and ring finger domains, isoform cra_d [homo sapiens]
  misc_feature (87)..(168): NCBI GI: 15082330 NCBI Desc: chfr protein [homo sapiens]
MSSLCPFARATNGGGVCPVKSDKSNAGVCPAKSDKSISGVCPVTGKDHGSELKESSDHGEEKSTDPRVVPAKCPFGYDSNMFKLGPLSCIVCQALLHESSKCKPCAHKFCKACISRFKDCPLCGADIEGIEPDAELQTLVDRFIDGHARIKRSHAKGDVEAAGGKNKVIYEDVSMERGAFLVQQAMRAFRAQNIESAKSRLTMCADDIREELKSSEANLDLCSQLGAVLGMLGDCCRTLGDVPSAITYYEESAEFLSKPPAKDLELVHTLSVSLNKIGDLRYYDGDLQSARNYYARSLDVRRNAVKEHSAVASQVIDLATSLAKVADVDRNLGNESAAVEGFEEAIQCLEKLKLDSEQASLEQRRLSVLDFLNNQLADK

SEQ ID NO: 10969 - DNA, 1203 bp, Sorghum bicolor
  misc_feature: Ceres ANNOT ID no. 6119049
  misc_feature: Encodes the peptide sequence at SEQ ID NO 10970
atggcagagcaccaccagccccaacaacaagagatgaacgtggtccctactagcgggcttgacctgcctccagggttccgcttccaccctagtgacattgagattatcagcgactacttaatgaacaaggtgcgcaacacaaacttcacctgcatcgccattggagaggtcgatgtaaacaagaccgagccatgggacctcccagatcaagcaaaatggggcgagaaagagtggtacttcttcaaccaaaaggaccgcaagtatccaacggggctgagggcaaaccgggccacaaaggccggttattggaaagcaacaggaaaagacaaggaggtttacaaaaccacagaaggggtgttgatgttggtcggcatgaagaagacgctcgtcttctacaagggcagggctcctaggggtgataaaaccaactgggtgatgcatgagtataggctcgaaggcagcggtaggctcctcggtcccgcatccgcatctagctcaatagccactgctgccactgccacaaaagcttcaacttctgctcccatggatgagtgggtggtctgtcgtgtgtttgaaaagaccactgggattaagaagacgactgcaccatcttacgaggttgccatggctagcactgagattgatcagaatcagaataacatccaagcgatccccatccctatgtcgctacagctgccattgtctgtgcctatgcccatgcaatttcccatcattccagactttgctatggacccagtggccccctactaccctaatgctagcactgggattcctacgatgatgccgtctatgacaggtatcagtggcactagcgggctccagattaacaacgcccagttcagcaatccgataatcgcgtcgccacaaatgaacttctaccaccagatgggcatgggggctgtagctggccggatagacatgggggctgcagttggccaaatgggtatgggggcaggagctggccagatgggcatgggggcagcagttgcccagatggacatgggagcagctggagcgggtggctttgatgttgttgcgccagagagtaggccatcctcaatggtgtcacagaaggatgaccaggctaatgccgctgagatctcatcgatgatgtctgtgaccgacccagggtctgcaaccaccaccatagagatggatggcatatggaagtataagtattga

SEQ ID NO: 10970 - protein, 400 aa, Sorghum bicolor
  misc_feature: Ceres ANNOT ID no. 6119049
  misc_feature (22)..(152): Pfam Id: NAM Pfam Desc: No apical meristem (NAM) protein
  misc_feature (1)..(400): NCBI GI: 32527660 NCBI Desc: nam-related protein 1 [zea mays]
  misc_feature (20)..(153): NCBI GI: 30102618 NCBI Desc: at5g07680 [arabidopsis thaliana]
  misc_feature (20)..(153): NCBI GI: 21593288 NCBI Desc: nam (no apical meristem)-like protein [arabidopsis thaliana]
  misc_feature (20)..(182): NCBI GI: 42573407 NCBI Desc: no apical meristem (nam) family protein [arabidopsis thaliana]
  misc_feature (20)..(153): NCBI GI: 21537315 NCBI Desc: nam, no apical meristem,-like protein [arabidopsis thaliana]
  misc_feature: The sequence is a functional homolog of SEQ ID NO 106 in the 10/225,068US patent application
  misc_feature: The sequence is a functional homolog of SEQ ID NO 151 in the 11/479,226US patent application
  misc_feature: The sequence is a functional homolog of SEQ ID NO 155 in the 11/479,226US patent application
  misc_feature: The sequence is a functional homolog of SEQ ID NO 2216 in the 10/374,780US patent application
  misc_feature: The sequence is a functional homolog of SEQ ID NO 2348 in the 10/374,780US patent application
  misc_feature: The sequence is a functional homolog of SEQ ID NO 32 in the 10/412,699US patent application
  misc_feature: The sequence is a functional homolog of SEQ ID NO 326 in the 10/412,699US patent application
  misc_feature: The sequence is a functional homolog of SEQ ID NO 34 in the 10/412,699US patent application
  misc_feature: The sequence is a functional homolog of SEQ ID NO 340 in the 10/412,699US patent application
  misc_feature: The sequence is a functional homolog of SEQ ID NO 52 in the 10/903,236US patent application
  misc_feature: The sequence is a functional homolog of SEQ ID NO 760 in the 11/479,226US patent application
  misc_feature: The sequence is a functional homolog of SEQ ID NO 778 in the 11/479,226US patent application
  misc_feature: The sequence is a functional homolog of SEQ ID NO 780 in the 10/225,066US patent application
  misc_feature: Useful for making plants with modulated growth and phenotype characteristics
  misc_feature: The sequence is a functional homolog of SEQ ID NO 32 in the 20040045049 US patent application
  misc_feature: The sequence is a functional homolog of SEQ ID NO 326 in the 20040045049 US patent application
  misc_feature: The sequence is a functional homolog of SEQ ID NO 34 in the 20040045049 US patent application
  misc_feature: The sequence is a functional homolog of SEQ ID NO 340 in the 20040045049 US patent application
  misc_feature: Useful for making plants with altered carbohydrate content
  misc_feature: Functional homolog of the protein sequence given in SEQ ID NO 13622
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAEHHQPQQQEMNVVPTSGLDLPPGFRFHPSDIEIISDYLMNKVRNTNFTCIAIGEVDVNKTEPWDLPDQAKWGEKEWYFFNQKDRKYPTGLRANRATKAGYWKATGKDKEVYKTTEGVLMLVGMKKTLVFYKGRAPRGDKTNWVMHEYRLEGSGRLLGPASASSSIATAATATKASTSAPMDEWVVCRVFEKTTGIKKTTAPSYEVAMASTEIDQNQNNIQAIPIPMSLQLPLSVPMPMQFPIIPDFAMDPVAPYYPNASTGIPTMMPSMTGISGTSGLQINNAQFSNPIIASPQMNFYHQMGMGAVAGRIDMGAAVGQMGMGAGAGQMGMGAAVAQMDMGAAGAGGFDVVAPESRPSSMVSQKDDQANAAEISSMMSVTDPGSATTTIEMDGIWKYKY

SEQ ID NO: 10971 - DNA, 1131 bp, Sorghum bicolor
  misc_feature: Ceres ANNOT ID no. 6119058
  misc_feature: Encodes the peptide sequence at SEQ ID NO 10972
atgggcgcggaggcagggcatacgcagcagcagcctccctcctccctccgacccggcagggaggcggcggcggcggcggcgccacccgcggtgctggggctgcagctctcggcgctgatcgaccacgtcgcgcgcgtcgactggtccctcctcgaccgcgtctctggcgaccgcggcggctcgcagcaggtgtccattgaggagctgaatcatattcttgatgaagtgaatgcccacatccttccttcccgcaatgatctcactccaataactacaatagccggtggaagtgttgccaacacaatccgtgggctatcagctggttttgggatatcaactggaataattggagcttgtggagatgacaaccagggccttttgtttgtcaacaatatgagctttagtggtgtagatctcacaagattaagggccaaaaaagggcacaccgctcagtgtgtgtgcttggtcgatgcaagcggcaatcgcaccatgcggccatgcctatctagcgcagtcaagatacaggccaatgaatttagaaaggaggatttcaaaggctccaagtggcttattgtgagatatgcgcaacagaacatggaacaaattattgaagctattaggattgcgaaacaggaaggcctttccgtatcattagatttggccagttttgagatggttcgtgactctaggtctaaactcattaatcttttggagactggtaacattgacctttgctttgccaatgaggatgaagctagagaggttatagggggaggtctggaatcagatccagaggaggcacttgcgttcttgggcaagtattgcaaatgggctgtggtgacacttgcttcaaagggatgcatggcaaagcatggcaaacaggtggttcaagtgccggccatcggggagagcaacgcggtggacacaactggagcaggcgacctgttcgcgagcggcttcctgtacgggctggtgaaggggctgccgctggaggagtgctgcaaggttggggcgtgcagcggtgggtcggtgacacgggcgctcggcggggaggtgcggccggagaactggcagtggatgtacaagcagatgaacgccaggggcctgctgctccccgagctcaagaactga

SEQ ID NO: 10972 - protein, 376 aa, Sorghum bicolor
  misc_feature: Ceres ANNOT ID no. 6119058
  misc_feature (67)..(356): Pfam Id: PfkB Pfam Desc: pfkB family carbohydrate kinase
  misc_feature (25)..(355): NCBI GI: 75674417 NCBI Desc: pfkb [nitrobacter winogradskyi nb-255]
  misc_feature (31)..(355): NCBI GI: 27375915 NCBI Desc: probable sugar kinase [bradyrhizobium japonicum usda 110]
  misc_feature (25)..(355): NCBI GI: 85714194 NCBI Desc: pfkb [nitrobacter sp. nb-311a]
  misc_feature (31)..(355): NCBI GI: 92115643 NCBI Desc: pfkb [nitrobacter hamburgensis x14]
  misc_feature (37)..(355): NCBI GI: 82699084 NCBI Desc: ribokinase:carbohydrate kinase, pfkb [brucella melitensis biovar abortus 2308]
  misc_feature: The sequence is a functional homolog of SEQ ID NO. 349 in the 11/188,298 US application
  misc_feature: The sequence is a functional homolog of SEQ ID NO. 302 in the 11/188,298 US application
  misc_feature: The sequence is a functional homolog of SEQ ID NO. 299 in the 11/188,298 US application
MGAEAGHTQQQPPSSLRPGREAAAAAAPPAVLGLQLSALIDHVARVDWSLLDRVSGDRGGSQQVSIEELNHILDEVNAHILPSRNDLTPITTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIIEAIRIAKQEGLSVSLDLASFEMVRDSRSKLINLLETGNIDLCFANEDEAREVIGGGLESDPEEALAFLGKYCKWAVVTLASKGCMAKHGKQVVQVPAIGESNAVDTTGAGDLFASGFLYGLVKGLPLEECCKVGACSGGSVTRALGGEVRPENWQWMYKQMNARGLLLPELKN

SEQ ID NO: 10973 - DNA, 885 bp, Sorghum bicolor
  misc_feature: Ceres ANNOT ID no. 6119080
  misc_feature: Encodes the peptide sequence at SEQ ID NO 10974
atggcgtcggagaagagcaagatcctagtggtcggcgccacaggccacctcggcaggcacgtcgtggcggcgagcgcgcggcagggccaccccaccttggcgctggtcagggacaccgccccctccgacgcggccaaggcggcgctgctccagagcttccaggacgccggcgtgacgctcgtgaagggcgacctccacgaccaggctagcctgctcagcgccgtcgggctgcggacgtggctcatcgacgccatcaaggaggccggcaacgtcaagaggttcatcccgtcggagttcggccttgacgccgaccgctcggccgccgtggagccgacgaggtccatgttcgtcacggccaaggcggcgatccgccgcgccgtcgaggcagcgggcgtcccctacacgtacgtgtggacgggctacttcttcggctacgggctgcccggcatcgggcaggtgctggcccaagcaccacccgtcgacaaggccgtcgtcctcggcgacggcgacaccgatgtgtcgttcgtcgacgagggggacatcggaacctacacggtgctggccgccgacgacccgcgcgcggtgaacaggacgctgtacgtcaagccgccggccaacacgctgtcgcacaacgagctactggcgctctgggagaagaagaccggcaaaacgttccagcgggtgcatctcgccgaggacgccgtcctcaagcagatccaagaacttccgatcccgctggacattctactgtcaattgggcatgcggtgtacatcaagggggaacataagttcaagatcgaccaatcgtcggcggcggacgccggcgagctgtacccggacgtgaagtacaccacggtcgacgattacctcaacaggttactctga

SEQ ID NO: 10974 - protein, 294 aa, Sorghum bicolor
  misc_feature: Ceres ANNOT ID no. 6119080
  misc_feature (8)..(285): Pfam Id: NmrA Pfam Desc: NmrA-like family
  misc_feature (8)..(202): Pfam Id: Epimerase Pfam Desc: NAD dependent epimerase/dehydratase family
  misc_feature (1)..(294): NCBI GI: 1708421 NCBI Desc: isoflavone reductase homolog irl
  misc_feature (4)..(294): NCBI GI: 18250364 NCBI Desc: isoflavone reductase-like protein [oryza sativa]
  misc_feature (3)..(294): NCBI GI: 76559894 NCBI Desc: tpa: isoflavone reductase-like protein 5 [vitis vinifera]
  misc_feature (3)..(294): NCBI GI: 76559896 NCBI Desc: tpa: isoflavone reductase-like protein 6 [vitis vinifera]
  misc_feature (3)..(292): NCBI GI: 116077986 NCBI Desc: pterocarpan reductase [lotus japonicus]
MASEKSKILVVGATGHLGRHVVAASARQGHPTLALVRDTAPSDAAKAALLQSFQDAGVTLVKGDLHDQASLLSAVGLRTWLIDAIKEAGNVKRFIPSEFGLDADRSAAVEPTRSMFVTAKAAIRRAVEAAGVPYTYVWTGYFFGYGLPGIGQVLAQAPPVDKAVVLGDGDTDVSFVDEGDIGTYTVLAADDPRAVNRTLYVKPPANTLSHNELLALWEKKTGKTFQRVHLAEDAVLKQIQELPIPLDILLSIGHAVYIKGEHKFKIDQSSAADAGELYPDVKYTTVDDYLNRLL

SEQ ID NO: 10975 - DNA, 891 bp, Sorghum bicolor
  misc_feature: Ceres ANNOT ID no. 6119081
  misc_feature: Encodes the peptide sequence at SEQ ID NO 10976
atggaaaagagcaggatcctcatcattggtggcacaggccatatcggcaagcatattgttactgcaagcgtccggcttggccacccaactgctgtcctcaccagggattctgcaccatctgacccagctaaggcgcaactcatcaagagctttgttgattccggtgctgctatcatcaagggagatgtattagaccatggaagcctggttaaggctgttaagtctgccgatatagtcatctcagcagtgggcccccgccaagtcggcgagcaaacgaggatcattgctgcgatcaaggaggcaggcaatgtcaagaggtttgtgccatctgagtttggctctgacgtggaccgccttcacaccgtggatccggccgcgtcactgtatgctgtgaaagccaacctccggcggctgattgaggcggaggggatacctcacacctacatcagctgcaattgctttgcagagacctaccttccaagcattggtgatgtcacggccattcgtgctggtcctccagccaccaagatcactgtcctaggagacggcagtgccaaagctgtgttcgtggtggaaaatgacattgctgcctacacgatgagggcggtcgaggatccaaggaccctgaacaagatcctgtacatgaggcctcccgcgaacgtgttgtcccacaacgagctcatctcgatgtgggagaagaagaccggcaggaccttcagaaggaaagcggcgttccctctgaacatactgctgtccctggggctctccaccttcgtgaggggcgagcaggccaacttcgacatcgacctgtcggttggcgtggaggccacacagctttaccctgacgtcgcctacaccaccgttgatgagtacctcaacggccttatttaa

SEQ ID NO: 10976 - protein, 296 aa, Sorghum bicolor
  misc_feature: Ceres ANNOT ID no. 6119081
  misc_feature (6)..(287): Pfam Id: NmrA Pfam Desc: NmrA-like family
  misc_feature (2)..(293): NCBI GI: 1708421 NCBI Desc: isoflavone reductase homolog irl
  misc_feature (2)..(296): NCBI GI: 76559896 NCBI Desc: tpa: isoflavone reductase-like protein 6 [vitis vinifera]
  misc_feature (2)..(296): NCBI GI: 76559894 NCBI Desc: tpa: isoflavone reductase-like protein 5 [vitis vinifera]
  misc_feature (3)..(296): NCBI GI: 3243234 NCBI Desc: isoflavone reductase related protein [pyrus communis]
  misc_feature (2)..(296): NCBI GI: 7578895 NCBI Desc: phenylcoumaran benzylic ether reductase homolog fi1 [forsythia x intermedia]
MEKSRILIIGGTGHIGKHIVTASVRLGHPTAVLTRDSAPSDPAKAQLIKSFVDSGAAIIKGDVLDHGSLVKAVKSADIVISAVGPRQVGEQTRIIAAIKEAGNVKRFVPSEFGSDVDRLHTVDPAASLYAVKANLRRLIEAEGIPHTYISCNCFAETYLPSIGDVTAIRAGPPATKITVLGDGSAKAVFVVENDIAAYTMRAVEDPRTLNKILYMRPPANVLSHNELISMWEKKTGRTFRRKAAFPLNILLSLGLSTFVRGEQANFDIDLSVGVEATQLYPDVAYTTVDEYLNGLI

SEQ ID NO: 10977 - DNA, 1161 bp, Sorghum bicolor
  misc_feature: Ceres ANNOT ID no. 6119083
  misc_feature: Encodes the peptide sequence at SEQ ID NO 10978
atggctgacgaccagcagccgccgccgcagcggtactggttcccgtactggaccgcgccgccgcagccgccgccgcccgcgcctgctcctgctccgcggccgggcgtccggccgcagctgtcgaggcgggaatctcgcccggcaccgcagcagcagccatcgccgcctcctgcaacagcagcaacagcgtcgccgtcgcggcggccgtcgtcgcacccgcaacaggcggcgacgccggggtccagaggcgctggcggtggtgctggtggccctgctccaccaccggcccagccgcagccgacgcggctgtccagcaggccgtccccgtcgcctgcccgcgctccgccactctcgcccgttcgagagcccaatgctccagcgccggcgccggcgccggtactggttgccagagagaacaggccgccttctcctcttcatcctactcctactgcgcatgatgttcctacgcaaaaagacatcaccgttccgcaagagaaaaccatccatgaaccgcttgtagcatccaaggcacaaagcaaggccccggagaaagaaaaagccaaggagaaagagaaggagaaggaaaaggataaagagaagaaggagaaggagaaggagaaagagaaggatcacaaagataagaaggacaaggataaagaaaaggatcacaaggacaaagagaaggaaggtagccagctgcacaaggagctcaaggcgggcgtcgcggacatggtgcagaagctcagctctacggcgccgtcgtcgaccggcggcggccacgagcgcgctggatcggcggcggcgggaacgaccatcatcacgctggccggcgagaacaagggcgcgtccatgaaggtagacagcagcgccgtggccgacggcaggggggacgcggcggcgggcggcaaggagcgccgcggccacaagctcgacggcagcgtcgtcggcagcagcgggaaggagcagggtgcgggcggcaaagggctgacggcgttcgtcaacagcaacgtgcaggtgatcaacaactcgctgatgctgcagagctcctgcaacggcggcgaccccggggtgcacctcaagctgtccaccaaggccaagaagaaggacggcgagggagctggtgggggcaagagtggctccgctgctgcgccaaaaaaatga

SEQ ID NO: 10978 - protein, 386 aa, Sorghum bicolor
  misc_feature: Ceres ANNOT ID no. 6119083
  misc_feature (19)..(254): NCBI GI: 9629749 NCBI Desc: 24 [equid herpesvirus 4]
  misc_feature (20)..(167): NCBI GI: 41400384 NCBI Desc: plus agglutinin [chlamydomonas reinhardtii]
  misc_feature (2)..(183): NCBI GI: 60678627 NCBI Desc: plus agglutinin [chlamydomonas incerta]
  misc_feature (6)..(163): NCBI GI: 6523547 NCBI Desc: hydroxyproline-rich glycoprotein dz-hrgp [volvox carteri f. nagariensis]
  misc_feature (15)..(228): NCBI GI: 38455896 NCBI Desc: a12 protein [pneumocystis carinii f. sp. muris]
MADDQQPPPQRYWFPYWTAPPQPPPPAPAPAPRPGVRPQLSRRESRPAPQQQPSPPPATAATASPSRRPSSHPQQAATPGSRGAGGGAGGPAPPPAQPQPTRLSSRPSPSPARAPPLSPVREPNAPAPAPAPVLVARENRPPSPLHPTPTAHDVPTQKDITVPQEKTIHEPLVASKAQSKAPEKEKAKEKEKEKEKDKEKKEKEKEKEKDHKDKKDKDKEKDHKDKEKEGSQLHKELKAGVADMVQKLSSTAPSSTGGGHERAGSAAAGTTIITLAGENKGASMKVDSSAVADGRGDAAAGGKERRGHKLDGSVVGSSGKEQGAGGKGLTAFVNSNVQVINNSLMLQSSCNGGDPGVHLKLSTKAKKKDGEGAGGGKSGSAAAPKK

SEQ ID NO: 10979 - DNA, 375 bp, Sorghum bicolor
  misc_feature: Ceres ANNOT ID no. 6119093
  misc_feature: Encodes the peptide sequence at SEQ ID NO 10980
atgtccgccatggagaccgacatcaacgcgccgccgccgcccgccccggccggcgaggggtcatccgcggccggtccgtcctcctccacctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagccagcgcgaccagcgaggagtgcaccgtcgcttggggtgtctgtaatcatgcttttcacttccattgcatcagcaggtggcttaagactcgccaagtgtgcccattagacaacagtgagtgggagttccagaaatatggccactag

SEQ ID NO: 10980 - protein, 124 aa, Sorghum bicolor
  misc_feature: Ceres ANNOT ID no. 6119093
  misc_feature (1)..(124): NCBI GI: 115434042 NCBI Desc: os01g0106800 [oryza sativa (japonica cultivar-group)]
  misc_feature (1)..(124): NCBI GI: 83701143 NCBI Desc: ring-box protein [arachis hypogaea]
  misc_feature (13)..(124): NCBI GI: 82470793 NCBI Desc: rbx1-like protein [petunia inflata]
  misc_feature (4)..(124): NCBI GI: 31747517 NCBI Desc: ring box protein [populus tomentosa]
  misc_feature (26)..(124): NCBI GI: 55240588 NCBI Desc: ensangp00000010437 [anopheles gambiae str. pest]
  misc_feature: The sequence is a functional homolog of SEQ ID NO. 424 in the 11/188,298 US application
  misc_feature: The sequence is a functional homolog of SEQ ID NO. 271 in the 11/188,298 US application
MSAMETDINAPPPPAPAGEGSSAAGPSSSTSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 10981 - DNA, 1419 bp, Sorghum bicolor
  misc_feature: Ceres ANNOT ID no. 6119094
  misc_feature: Encodes the peptide sequence at SEQ ID NO 10982
atggctgcactcaaggcgtcgttccggggggagctcagcgccgtctccttcctcgactcaagcaggggacctttcgtccagcacaaagtggattttacgtttcaaaggaagggcaaacgagctatttcactgagaaggacatgctgttctatgcaacaggctccaccgccagcatggcctgggagagctgttgctgagcctgaccggaggtcatgggatggcccaaagcctatctcgattgttggatcaactggttccataggaacacagacattggacattgttgctgagaatcctgataagttcagagttgttgctcttgctgctggatccaatgtcacgcttctagctgatcaggtcaaaacattcaaacctaagttggttgctgtaagaaacgaagcattagttgatgaactaaaagaagccttagctgattgcgaagagaagccagaaattattcctggggagcaaggagtcatagaagtcgctcgacacccagatgcagttacagttgtcacagggatagtagggtgtgcagggctgaagcctacagttgctgcaatcgaagctggtaaagacatagcattggcaaacaaggagacacttattgcaggtggtccttttgtgcttccccttgcacacaaacacaatgtgaaaattcttcctgctgattctgagcactctgcaatatttcagtgtatacaaggcttgtccaaaggagcacttcgtcgcattattctaactgcatcaggtggtgctttcagggactggccagttgacaggctgaaagatgtaaaagttgctgacgctttaaagcatccaaactggaatatgggaaagaagatcacagtagattctgctactttattcaacaagggtttagaagttattgaagcgcattatttatttggtgctgaatatgatgacattgagattgtgatccacccacagtctatcatacactctatggttgaaacccaggattcatctgtcctagctcaattgggttggccggatatgcggataccaatcttatacaccttatcgtggccagatagaatctattgctctgaggtcacatggccccgccttgatctttgcaagttgggttcactgacgttcaaagctcctgacaatgtaaaatacccatcaatggacctagcgtatgcagctgggcgggctgggggcaccatgacaggagttctgagtgctgctaatgagaaggccgtggagttgttcattgatgaaaagattagctacctggacatattcaaggtggtggaacttacatgtgacgcgcatcggaacgagctggtaagaagtccttcactcgaggagatcatccattatgatctgtgggcgaggagatatgcagctagcctacaaccatcttctggcctgagccctgtccctgcataa

SEQ ID NO: 10982 - protein, 472 aa, Sorghum bicolor
  misc_feature: Ceres ANNOT ID no. 6119094
  misc_feature (78)..(206): Pfam Id: DXP_reductoisom Pfam Desc: 1-deoxy-D-xylulose 5-phosphate reductoisomerase
  misc_feature (220)..(303): Pfam Id: DXP_redisom_C Pfam Desc: 1-deoxy-D-xylulose 5-phosphate reductoisomerase C-terminal
  misc_feature (3)..(471): NCBI GI: 110808217 NCBI Desc: 1-deoxy-d-xylulose 5-phosphate reductoisomerase, chloroplast precursor (dxp reductoisomerase) (1-deoxyxylulose-5-phosphate reductoisomerase)
  misc_feature (3)..(471): NCBI GI: 110808217 (continued) (2-c-methyl-d-erythritol 4-phosphate synthase)
  misc_feature (3)..(471): NCBI GI: 17225989 NCBI Desc: 1-deoxy-d-xylulose 5-phosphate reductoisomerase precursor [oryza sativa]
  misc_feature (3)..(469): NCBI GI: 15679908 NCBI Desc: 1-deoxy-d-xylulose-5-phosphate reductoisomerase [lycopersicon esculentum]
  misc_feature (3)..(469): NCBI GI: 111227950 NCBI Desc: 1-deoxy-d-xylulose-5-phosphate reductoisomerase [nicotiana tabacum]
  misc_feature (3)..(472): NCBI GI: 133753347 NCBI Desc: 1-deoxy-d-xylulose 5-phosphate reductoisomerase [croton stellatopilosus]
  misc_feature (3)..(471): SWISSPROT Homolog: EC 1.1.1.267 1-deoxy-D-xylulose 5-phosphate reductoisomerase, chloroplast precursor
  misc_feature: The sequence is a functional homolog of SEQ ID NO 2 in US patent 7067647
MAALKASFRGELSAVSFLDSSRGPFVQHKVDFTFQRKGKRAISLRRTCCSMQQAPPPAWPGRAVAEPDRRSWDGPKPISIVGSTGSIGTQTLDIVAENPDKFRVVALAAGSNVTLLADQVKTFKPKLVAVRNEALVDELKEALADCEEKPEIIPGEQGVIEVARHPDAVTVVTGIVGCAGLKPTVAAIEAGKDIALANKETLIAGGPFVLPLAHKHNVKILPADSEHSAIFQCIQGLSKGALRRIILTASGGAFRDWPVDRLKDVKVADALKHPNWNMGKKITVDSATLFNKGLEVIEAHYLFGAEYDDIEIVIHPQSIIHSMVETQDSSVLAQLGWPDMRIPILYTLSWPDRIYCSEVTWPRLDLCKLGSLTFKAPDNVKYPSMDLAYAAGRAGGTMTGVLSAANEKAVELFIDEKISYLDIFKVVELTCDAHRNELVRSPSLEEIIHYDLWARRYAASLQPSSGLSPVPA

SEQ ID NO: 10983 - DNA, 1380 bp, Sorghum bicolor
  misc_feature: Ceres ANNOT ID no. 6119099
  misc_feature: Encodes the peptide sequence at SEQ ID NO 10984
atggcggagcagtctcccagctccgcgccgcagggtggttctggtgggaatgaatccttcgataatcttgtaattcaagctccacagctgatgagggaggattacatacagaatgctgtgaagtttctttcacatccgagagtgaagggttctccagtatttcacaggcgttccttcctggaaaagaaaggccttacaagtgaagaaattgatgaggcctttcgtagggttcctgaccctaagacaaatggaactgatgctgcagctgctagtatgcaacaagcaaacaatcccagtcaatctgttgcgctgcagccttatacagaagttcaaccgcaagcagctactaccactgccactgttggacctattgccccaaatacaaatgtgcagtttagctgggtcaacgcactccttggtgcaggtctttttcttggattaggggctagtgctgctataaccctcaagaaatttttcatccctagtctaaaatcttggacccgtagagttgttgctgaaggagatgaaaatgcaaacgatgaacttgcttccaaactttgtgaagaaattagggaagccataaaagtttctacgtcagccttttctgatattgctagaacaaaccaagaagtgcttgcttcaaaagatgaagataggaaggtgcttatgaagttaacagaaacatttgagtcacaagcaaatgtgtttaaatcattgaatgagaccttaaatcatatcagggagaatcagttttcacggcgcaaccaattggaagagcatgttcagcctgcaccatggaatgggccaattgactatcaagggagagcttttcagcaaactaatatgtatgcaacgccaccaaacaacagttttgacccagggaggaattcattcatgccattagctgctgaaccttcttatggaccatttccaggatcctactctgagcagcgcgtgcagaggcctggtgggtatggattccagccacagacaagcaacgaccgattgagcgttggcacacggggcagctaccaagggggttcttccaatcaccatgctggcaatgccatggatgacccggcagcggttgcggcagaattccagcgccgctgggttcccccgcagccaccgggcgtcattatgccagaggctgcggcggccatccggcaggccaggttggttccgaggcagcagcctggtgatgggcacctgagtactgatgttccgagaccattggagtctgccatggcaacaacagagcacgtgaacggtgcccctgaagcacctggtggagagttgccaagccacgatggtggtaccatgactgctaatgccagcagctgtggtgggagtgaagagcagcagcaggaagccgcttga

SEQ ID NO: 10984 - protein, 459 aa, Sorghum bicolor
  misc_feature: Ceres ANNOT ID no. 6119099
  misc_feature (31)..(163): Pfam Id: Pex14_N Pfam Desc: Peroxisomal membrane anchor protein (Pex14p) conserved region
  misc_feature (1)..(217): NCBI GI: 115434046 NCBI Desc: os01g0107000 [oryza sativa (japonica cultivar-group)]
  misc_feature (24)..(399): NCBI GI: 11094252 NCBI Desc: pex14 [arabidopsis thaliana]
  misc_feature (24)..(399): NCBI GI: 11121113 NCBI Desc: peroxin pex14 [arabidopsis thaliana]
  misc_feature (31)..(258): NCBI GI: 126139896 NCBI Desc: peroxisomal membrane protein per10 (peroxin-14) [pichia stipitis cbs 6054]
  misc_feature (32)..(221): NCBI GI: 111609732 NCBI Desc: peroxin 14 [penicillium chrysogenum]
MAEQSPSSAPQGGSGGNESFDNLVIQAPQLMREDYIQNAVKFLSHPRVKGSPVFHRRSFLEKKGLTSEEIDEAFRRVPDPKTNGTDAAAASMQQANNPSQSVALQPYTEVQPQAATTTATVGPIAPNTNVQFSWVNALLGAGLFLGLGASAAITLKKFFIPSLKSWTRRVVAEGDENANDELASKLCEEIREAIKVSTSAFSDIARTNQEVLASKDEDRKVLMKLTETFESQANVFKSLNETLNHIRENQFSRRNQLEEHVQPAPWNGPIDYQGRAFQQTNMYATPPNNSFDPGRNSFMPLAAEPSYGPFPGSYSEQRVQRPGGYGFQPQTSNDRLSVGTRGSYQGGSSNHHAGNAMDDPAAVAAEFQRRWVPPQPPGVIMPEAAAAIRQARLVPRQQPGDGHLSTDVPRPLESAMATTEHVNGAPEAPGGELPSHDGGTMTANASSCGGSEEQQQEAA

SEQ ID NO: 10985 - DNA, 1926 bp, Sorghum bicolor
  misc_feature: Ceres ANNOT ID no. 6119105
  misc_feature: Encodes the peptide sequence at SEQ ID NO 10986
atgatcgcgtcgcagccgcgccgggtgcggcccctcgccgccgtctccctggtgctgttcctcctcctcctgtacagccgctccgacgggggctcgccgcgcgccgcgcggctcctgggctcccgatcgcacccggcgcgtcgcaggttcctctccgatgccgaccctgccggccccgccgcatccagcgccgccgcgaatccttcgggggccgccgctacgctgagtggcgagcagccggaggacccttccgtggcgtgcgcgggcatcgcgcggcacgaggggttcgggacgcagtgcgagttcctccgcgcccacccgcagtgcagctccggcgggttcgtcgactacctggccttcttctactgcagatgcgagaggttcagggtgctggggtacgcggtgctcggggtatgcctggccgcgctcttctatatgctgggcaataccgccgccgactacttctgctgcagccttgagaagatgtcggcgctgctgcggctcccgcccaccgtggctggcgtgacgctgctcccctttggtaatggcgcccccgacgtgttcgctagcattgccgcgtttatggggagtggtgctggtgatgttgggctgaacagcgtgctgggtggagctgtgttcgtcacctgtgttgtggttggggcagtgtcattgtgcgttgcggagaagaatgtgcagattgataggaggtgctttgtgagggatgttggcttctttctggtgactctgctcgctttgtctgtagtgctgatcgttgggaaggtgactgtttggggagctatgatgtttgtgtcgatttatgcagtctatgcatttgttgtggctgcaaatgaggtattgaggaaacatgccaggaggctgaagtttgatgtggtcacaccattactgcctgtgagggcaagtatatttgaacaaggagcagaggaggatgagtcagtgtacagttcacttcttgaggaggatgcagatggtgaggcgacccaaataaatacatccttgcctcagtggatgtgggcttctcatgtggccatctactcaaatcatggaaatagagttggttcgcctgacagctcaaggccattgtggggttggaatgaggaagaagtggataacgccacgttcaatatttccaagctgttttcgtttatggagcttcccttgacgataccaagaaggttgacaattccgatagtggaggaagaccgttggtcgaaagaatatgctgttgcaagtgcttgcttggcgcctgttcttttggcatttttatggagcagtcaggatacagtatccacaaaggttagcatagcagcatatgtcgtggctgtaattctggggatcgcacttgctgccctggctttcatgttcaccagtaatgagcgtcctccacgtagatttttgctcccatgggtttttggaggttttgtgatgagcatcatctggttctacatcattgctaatgaactggttgcacttttggttgctttgggtgtcatactggggattaatccttcaatacttgggctaacagtgttagcatgggggaattcaatgggtgacttgatgtcaaatgtcgctttagcgatgaatggaggcgacggcgtgcagattgccatgtctggatgttatgcaggacctatgtttaacacacttgctggtttgggtatatcgatgctgcttggagcttggtcaacggcacccaattcgtatgttcttccgcaagactactctcttatttacacaatgagctttcttgttgctggattgatctgggctcttgttatgctgccgagaggtgacatgcggcctaacaagatacttggagttggcctcattgccctttactcaatttttctttttgttagggtaagcaatgctgtcggcatattgccactgcctggcttgagttag

SEQ ID NO: 10986 - protein, 641 aa, Sorghum bicolor
  misc_feature: Ceres ANNOT ID no. 6119105
  misc_feature (146)..(280): Pfam Id: Na_Ca_ex Pfam Desc: Sodium/calcium exchanger protein
  misc_feature (485)..(627): Pfam Id: Na_Ca_ex Pfam Desc: Sodium/calcium exchanger protein
  misc_feature (383)..(635): NCBI GI: 18087575 NCBI Desc: at5g17860/mva3_210 [arabidopsis thaliana]
  misc_feature (385)..(635): NCBI GI: 92894848 NCBI Desc: sodium/calcium exchanger membrane region [medicago truncatula]
  misc_feature (391)..(634): NCBI GI: 18483233 NCBI Desc: k-exchanger-like protein [sorghum bicolor]
  misc_feature (390)..(634): NCBI GI: 124359718 NCBI Desc: sodium/calcium exchanger membrane region [medicago truncatula]
  misc_feature (384)..(640): NCBI GI: 47571313 NCBI Desc: na+/ca2+ k+ independent exchanger [homo sapiens]
MIASQPRRVRPLAAVSLVLFLLLLYSRSDGGSPRAARLLGSRSHPARRRFLSDADPAGPAASSAAANPSGAAATLSGEQPEDPSVACAGIARHEGFGTQCEFLRAHPQCSSGGFVDYLAFFYCRCERFRVLGYAVLGVCLAALFYMLGNTAADYFCCSLEKMSALLRLPPTVAGVTLLPFGNGAPDVFASIAAFMGSGAGDVGLNSVLGGAVFVTCVVVGAVSLCVAEKNVQIDRRCFVRDVGFFLVTLLALSVVLIVGKVTVWGAMMFVSIYAVYAFVVAANEVLRKHARRLKFDVVTPLLPVRASIFEQGAEEDESVYSSLLEEDADGEATQINTSLPQWMWASHVAIYSNHGNRVGSPDSSRPLWGWNEEEVDNATFNISKLFSFMELPLTIPRRLTIPIVEEDRWSKEYAVASACLAPVLLAFLWSSQDTVSTKVSIAAYVVAVILGIALAALAFMFTSNERPPRRFLLPWVFGGFVMSIIWFYIIANELVALLVALGVILGINPSILGLTVLAWGNSMGDLMSNVALAMNGGDGVQIAMSGCYAGPMFNTLAGLGISMLLGAWSTAPNSYVLPQDYSLIYTMSFLVAGLIWALVMLPRGDMRPNKILGVGLIALYSIFLFVRVSNAVGILPLPGLS

SEQ ID NO: 10987 - DNA, 651 bp, Sorghum bicolor
  misc_feature: Ceres ANNOT ID no. 6119112
  misc_feature: Encodes the peptide sequence at SEQ ID NO 10988
atgaagagcagaagcagcagcatgagtaacaacagcggcagcacgacgacgacgacggcagtgcagcggaaggaggtcgagaggaggaggaggcagcagatgaagagcctctgcgtcaagctcgcctccctcatccccaaagaacactactcctccaaggatgctatgacccagctgggtagcctagacgaagcagcgacgtacataaagaaactcaaggagagggtggaggagctgcggcagaagaggacctctgcacggctcttggctgcggctgctggcatgagacgaggcggaggaggagcaggtggcgcctcgacgtcgccggcggcgacgaccacagcgagcggtggcgcggggtcatcagaagaagccggtgaccacatgccggtggcgccgccggcggtggtggaggttcggcagcacagcgacgggtcgagcctggacgtggtgctcatcagcagcgtggagcgacccttcaagctgcacgaggtggtcaccgtgctgcaggaagaaggcgccgagaccatcaacgccaacttctccgtcgccggcaccaaaatcttctacaccatacactgcagggcctttagcccaagaatcggtatagaggtttcaagaatttctgaaagattaagagcattgggatga

SEQ ID NO: 10988 - protein, 216 aa, Sorghum bicolor
  misc_feature: Ceres ANNOT ID no. 6119112
  misc_feature (22)..(73): Pfam Id: HLH Pfam Desc: Helix-loop-helix DNA-binding domain
  misc_feature (2)..(215): NCBI GI: 115434060 NCBI Desc: os01g0108400 [oryza sativa (japonica cultivar-group)]
  misc_feature (145)..(213): NCBI GI: 124359694 NCBI Desc: helix-loop-helix dna-binding [medicago truncatula]
  misc_feature (162)..(213): NCBI GI: 5091554 NCBI Desc: t10o24.23 [arabidopsis thaliana]
  misc_feature (8)..(108): NCBI GI: 22328838 NCBI Desc: basic helix-loop-helix (bhlh) family protein [arabidopsis thaliana]
  misc_feature (137)..(215): NCBI GI: 79340924 NCBI Desc: transcription factor [arabidopsis thaliana]
MKSRSSSMSNNSGSTTTTTAVQRKEVERRRRQQMKSLCVKLASLIPKEHYSSKDAMTQLGSLDEAATYIKKLKERVEELRQKRTSARLLAAAAGMRRGGGGAGGASTSPAATTTASGGAGSSEEAGDHMPVAPPAVVEVRQHSDGSSLDVVLISSVERPFKLHEVVTVLQEEGAETINANFSVAGTKIFYTIHCRAFSPRIGIEVSRISERLRALG

SEQ ID NO: 10989 - DNA, 1227 bp, Sorghum bicolor
  misc_feature: Ceres ANNOT ID no. 6119142
  misc_feature: Encodes the peptide sequence at SEQ ID NO 10990
atgtccggaaccggttgcctccccgccgacggcgcggcggccctaaccagggtctgccgcgacggcgcggcggcctcgcggctcaagacggggtccctgctcgccatcctcgtcgccagcgccgtcggcatctgcctccccgtcgcgctcacgcgcgccttccgcggcagccccaactacgcgcggggcctgctcctcgtcaagtgctacgcggcgggggtcatcctctccacctcgctcgtccacgtgctccccgacgcgcacgccgcgctcgccgactgcgccgtcgcctcgcgcaggccctggagggacttccccttcgcgggcctcttcaccctcgtcggcgcgctgctcgcgctcctcgtcgacctctccgcttcctcccacctcgaggcccacgcccacgtcggcgccgacgccgacgcccaccacggccacggccaccaggaaacgccatacaccccaatccccaagaaggttcctgtgttcgagctcgccggcgagatgagccccaagaagcgcgctttcttggatgacgaccgagaagaggaccccgcgccgcacgccgccaccaacggcggcgccgacccggaccgcgacgacgtggcgctcttcgggcccaagaagggcgcgcgcagcgacgaggtcccggtcgtcgtcgctgccggctgccatggcgtcgctcatgaagtggtggaggtaggggaggggcccggggaggacgaggaggagaccaggaggaagcagaagatggtgtccaaagtgctggagattgggatagtcttccactccgtcatcatcggggttacaatggggatgtcccaggatgtctgtgcaatccgtccacttgtggttgcgctatccttccatcaggtgttcgaggggatgggactcggcggatgcatcgcacaggctggttttgggatggcaacagttggctacatgtgcataatgttctcagtgacgacaccattgggaattcttcttggaatgctagtgttccatatgactggttacgatgatagcaatccaaatgccttaataatggaagggattcttggttcactttcggctggaattctcatttatatggcactagtcgatctaatttctcttgattttttccataacaagatgatgtcagcatctttgaaactgaagaaggcatgttacattgcgttggtgcttggatctgcttctatgtcagtattagctctctgggcatag

SEQ ID NO: 10990 - protein, 408 aa, Sorghum bicolor
  misc_feature: Ceres ANNOT ID no. 6119142
  misc_feature (26)..(405): Pfam Id: Zip Pfam Desc: ZIP Zinc transporter
  misc_feature (232)..(408): NCBI GI: 40782197 NCBI Desc: zinc transporter zip6 [arabidopsis halleri subsp. halleri]
  misc_feature (225)..(408): NCBI GI: 32966053 NCBI Desc: iron transporter fe2 [oryza sativa (japonica cultivar-group)]
  misc_feature (230)..(408): NCBI GI: 47169681 NCBI Desc: iron regulated transporter-like protein [oryza sativa (japonica cultivar-group)]
  misc_feature (222)..(408): NCBI GI: 89994167 NCBI Desc: zinc transporter protein zip7 [hordeum vulgare]
  misc_feature (225)..(408): NCBI GI: 38036108 NCBI Desc: metal transport protein [medicago truncatula]
  misc_feature: The sequence is a functional homolog of SEQ ID NO. 287 in the 11/188,298 US application
MSGTGCLPADGAAALTRVCRDGAAASRLKTGSLLAILVASAVGICLPVALTRAFRGSPNYARGLLLVKCYAAGVILSTSLVHVLPDAHAALADCAVASRRPWRDFPFAGLFTLVGALLALLVDLSASSHLEAHAHVGADADAHHGHGHQETPYTPIPKKVPVFELAGEMSPKKRAFLDDDREEDPAPHAATNGGADPDRDDVALFGPKKGARSDEVPVVVAAGCHGVAHEVVEVGEGPGEDEEETRRKQKMVSKVLEIGIVFHSVIIGVTMGMSQDVCAIRPLVVALSFHQVFEGMGLGGCIAQAGFGMATVGYMCIMFSVTTPLGILLGMLVFHMTGYDDSNPNALIMEGILGSLSAGILIYMALVDLISLDFFHNKMMSASLKLKKACYIALVLGSASMSVLALWA

SEQ ID NO: 10991 - DNA, 1077 bp, Sorghum bicolor
  misc_feature: Ceres ANNOT ID no. 6119183
  misc_feature: Encodes the peptide sequence at SEQ ID NO 10992
atggagtcctgtagcttccgcgccgcaacagcgccttctccctttccgtccgcgccatcctcctcctcctcatcatccccgcgcgcccgatccctcatactccgatttcccagaccaagaaaagggaggaagattggggtgcgcaggagagcgtccgggtttgatgccttcccgcccctccccggcaaggtcttcgtcgatgaggcaatcggagcggaatacggggagggcttcgaaacatttcggatggatggaccactcaaggttgatgtggattatctgaatgaaaaattgcaagaatgcttccttcaaaggataaggcatgctatgaagccggatgaggcgtttggtctaattttttcgtgggacaatgttattgctgacacagactcgctaaagttgaatgcttggagtcagcttgctctggaggaaggtaaggatatcccaagtgctgctcatgtccggaagagcattcttcatggtgctgctgaccatgttcttagaaaggttttgtactgggcaaaagaggaagataaaatggaaaaaatgaaggcacgccttatagagttatactatgaaaacctgttcaaactggatacacctgtagaaggattgagagaatggctggatgctgttcagactgcagggataccttgtgctgttgcatcatcccttgacaggagatgcatgatcgaagctttggatcggatggcactaagcaaatatttcaaggcgattgtgactgacgaagatgatatggactcaatagcaaataggtttctgtcagctgctatgaagttggatcgtaaaccctcaaagtgtgttgtgtttgaggacgacccaaggggcgtcacagccgcccacaactgtactatgatggcagttgcattgattggtgctcatccagcgtatgagttggtacaggccgatcttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctga

SEQ ID NO: 10992 - protein, 358 aa, Sorghum bicolor
  misc_feature: Ceres ANNOT ID no. 6119183
  misc_feature (115)..(300): Pfam Id: Hydrolase Pfam Desc: haloacid dehalogenase-like hydrolase
  misc_feature (4)..(358): NCBI GI: 18399067 NCBI Desc: haloacid dehalogenase-like hydrolase family protein [arabidopsis thaliana]
  misc_feature (4)..(358): NCBI GI: 42572363 NCBI Desc: haloacid dehalogenase-like hydrolase family protein [arabidopsis thaliana]
  misc_feature (4)..(358): NCBI GI: 22137294 NCBI Desc: at3g10970/f9f8_21 [arabidopsis thaliana]
  misc_feature (4)..(358): NCBI GI: 145332024 NCBI Desc: haloacid dehalogenase-like hydrolase family protein [arabidopsis thaliana]
  misc_feature (1)..(358): NCBI GI: 144924282 NCBI Desc: had-superfamily hydrolase subfamily ia, variant 3 [medicago truncatula]
MESCSFRAATAPSPFPSAPSSSSSSSPRARSLILRFPRPRKGRKIGVRRRASGFDAFPPLPGKVFVDEAIGAEYGEGFETFRMDGPLKVDVDYLNEKLQECFLQRIRHAMKPDEAFGLIFSWDNVIADTDSLKLNAWSQLALEEGKDIPSAAHVRKSILHGAADHVLRKVLYWAKEEDKMEKMKARLIELYYENLFKLDTPVEGLREWLDAVQTAGIPCAVASSLDRRCMIEALDRMALSKYFKAIVTDEDDMDSIANRFLSAAMKLDRKPSKCVVFEDDPRGVTAAHNCTMMAVALIGAHPAYELVQADLAIAKYSELSVINLRRLFANKGISFMDLQKQIIEKSPPKRRLTVDTIF

SEQ ID NO: 10993 - DNA, 1065 bp, Sorghum bicolor
  misc_feature: Ceres ANNOT ID no. 6119186
  misc_feature: Encodes the peptide sequence at SEQ ID NO 10994
atgggtgtcggcggggagaagttccagctggggacggtgggggcgctgagcctctccgtggtgtcctccgtctccattgtcatctgcaacaaggctctcatgagctccctcggctttaacttcgccactaccttgacaagctggcatctgctggttacattctgctcccttcatgtagcattgtggatgaagttctttgagcataagcctttcgattcaagaactgtcatgggatttggagtacttaatggaatctccattggactcctcaacttgagtcttggcttcaactctgttgggttttaccagatgactaagctggcaatcatcccgtgcactgtcattttagagacacttttcttcaggaagaagttcagtcggagtatccagatgtccctttctgtgctccttctcggtgttggtgttgcaactgtcactgatctgcaactcaatgctgtcggatccatactgtccttgctggcaattatcacgacttgcattgctcaaattatgactaacaccatccagaagaagttcaaggtctcgtcaacccaactgctttaccagtcttgcccttaccaatcactgaccctgtttctcattggcccctttcttgatggctttttgactaaccaaaatgtctttgcttttaattatacatctcaagttgtgtttttcatcgtgttgtcgtgcttgatatcggtctcagtgaacttcagcacttttcttgtgatcggaaagacatctcctgttacttaccaagtcctgggccatcttaaaacctgccttgttcttacctttggttatgttttgcttcacgatccatttagctggagaaacatacttggaatcctaattgcagtagttggaatggtcttgtattcatacttctgcacagtggagacccagcaaaaaaacaccgaagtctccccacagcaggtgaaagaaagcgaggcagcccctttgatctcagattctttgagcaaagctgaaaacgggggcggtggtgttgatgacgagcctttgaaggtacccatgtggagctcaaagtattcacgggagtga

SEQ ID NO: 10994 - protein, 354 aa, Sorghum bicolor
  misc_feature: Ceres ANNOT ID no. 6119186
  misc_feature (154)..(296): Pfam Id: TPT Pfam Desc: Triose-phosphate Transporter family
  misc_feature (8)..(333): NCBI GI: 48717036 NCBI Desc: phosphate translocator-like [oryza sativa (japonica cultivar-group)]
  misc_feature (8)..(224): NCBI GI: 115468244 NCBI Desc: os06g0506200 [oryza sativa (japonica cultivar-group)]
  misc_feature (104)..(323): NCBI GI: 42570326 NCBI Desc: transporter-related [arabidopsis thaliana]
  misc_feature (15)..(295): NCBI GI: 145355238 NCBI Desc: dmt family transporter: glucose-6-phosphate/phosphate [ostreococcus lucimarinus cce9901]
  misc_feature (11)..(173): NCBI GI: 115440755 NCBI Desc: os01g0823200 [oryza sativa (japonica cultivar-group)]
  misc_feature: The sequence is a functional homolog of SEQ ID NO. 484 in the 11/188,298 US application
  misc_feature: The sequence is a functional homolog of SEQ ID NO. 360 in the 11/188,298 US application
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNTEVSPQQVKESEAAPLISDSLSKAENGGGGVDDEPLKVPMWSSKYSRE

SEQ ID NO: 10995 - DNA, 1872 bp, Sorghum bicolor
  misc_feature: Ceres ANNOT ID no. 6119187
  misc_feature: Encodes the peptide sequence at SEQ ID NO 10996
atgaagagaaaggcgcagtcaggaaaatcccgctcatggtggtgggacagtcatattagttcacaaaattctaagtggctctctgagaatctagaaggagagttctctgcagaaaaagctgaggcattttacgagaagcggcctttacttattactcatgtggagaacttctatcgcatgtatcgtgctcttgctgcgcgatatgacagtgtaactggagaactgcgcaaaaacattccatcatctcttcaatcatatggctcttttggtgtctctgaatcagattctgagacacaatgttcctcatctccagagtacgacatgcaagaaaatatgccacagcaaaagcaaaagcctggaccagatttccttgatatttccattggctctggcgttagctctgatgtatcaaagaagggtagtgaaaggtcttcatcatcttcagattctgattcagagcttgatgaggccaaagaggaaaatggcagtattttttatgccctgagccaaaaaattaatgagctagaagaagagcttcaagaagcaaggggaaagcttgatgctttagaggaaaagcatgcacattgccagagtgatttgagtaccaactcaaaagttgctgaacatgaagaaaaactgcatatttcagatgtggaatccaacaaccttcagaaggatccagaagaaagggattctgctttagagagctcaacagaagtcaacagcgaaaaggaaacattggaagctgcgctgtttgagcgcaaaaatgagattgaaatgctgaaaggtgcaatggcctcagctgctaagcagtttgaggttgaattggcacatcgtgatcttgaaattgataagtgcaaggatgagcttggagtactctcagagaagtatttgcatgataagtctactctcgaggatgagcttacaaagctccatgcagtcatcaagaatatggaaggtgacctagaaaaaaattcacaggagaaattgcagctcaagtctcggattaaagaacttgagcaggcagctcacagcttagaatattcagcttccgagatagttaggctgcaagaaataataaggaataaacaagaaggattagaaaaggttgcagaggagaaagaagtgctcaaagaacgtgctaacgaatttgaacaacttttaagggcccttgaggtctcaggtacagaggctgcaaagctaccagaaactatcaagaacctggaagcccagctagaaagagccttagaagagaaatcagtacttgaagaccagatgaagcagctggagcaggttatgtctgaatctttggagaaacattcacatgagcagtcctctcttactgcagatcttttgaagttatctgaggcaaacgcttctcttgaaaacaaattgtccgctgtggcagcagagcttatgcaagtttatgctgacaaggaagaagaatctcttgaaaatgagaagcggatttctgtcctcaatcaagatattgctgatctcaggagaaagcttgaattattgtcatctgagaaagccacagttgatgatgagttggccaaactgctagctgatattacgactcgtgacgaaaagatgaagcagatggatgaccacttaactcagcttcagtttgagcatgccaagctgatggcagagtttgacactgcacacaggtccttgtcagagctgcggactcaggtttctgagctggaagaagaggtagagaagcagaagcttgtgatatccgagagtgcagagggaaagcgggaggccatcaggcagctctgcttctccattgaacactaccgcagcgggtatcaggagctgaggcagctgttgcaaggccacaggccggttgtgatggcaacctga

SEQ ID NO: 10996 - protein, 623 aa, Sorghum bicolor
  misc_feature: Ceres ANNOT ID no. 6119187
  misc_feature (12)..(69): Pfam Id: KIP1 Pfam Desc: KIP1-like protein
  misc_feature (1)..(560): NCBI GI: 92898312 NCBI Desc: trna-binding arm [medicago truncatula]
  misc_feature (3)..(521): NCBI GI: 30697046 NCBI Desc: kinase interacting protein-related [arabidopsis thaliana]
  misc_feature (3)..(475): NCBI GI: 145362059 NCBI Desc: kinase interacting protein-related [arabidopsis thaliana]
  misc_feature (12)..(609): NCBI GI: 115450881 NCBI Desc: os03g0161100 [oryza sativa (japonica cultivar-group)]
  misc_feature (7)..(611): NCBI GI: 4587570 NCBI Desc: strong similarity to gi2244833 centromere protein homolog from arabidopsis thaliana chromosome 4 contig gbz97337. ests gbt20765 and gbaa586277 come from this gene
MKRKAQSGKSRSWWWDSHISSQNSKWLSENLEGEFSAEKAEAFYEKRPLLITHVENFYRMYRALAARYDSVTGELRKNIPSSLQSYGSFGVSESDSETQCSSSPEYDMQENMPQQKQKPGPDFLDISIGSGVSSDVSKKGSERSSSSSDSDSELDEAKEENGSIFYALSQKINELEEELQEARGKLDALEEKHAHCQSDLSTNSKVAEHEEKLHISDVESNNLQKDPEERDSALESSTEVNSEKETLEAALFERKNEIEMLKGAMASAAKQFEVELAHRDLEIDKCKDELGVLSEKYLHDKSTLEDELTKLHAVIKNMEGDLEKNSQEKLQLKSRIKELEQAAHSLEYSASEIVRLQEIIRNKQEGLEKVAEEKEVLKERANEFEQLLRALEVSGTEAAKLPETIKNLEAQLERALEEKSVLEDQMKQLEQVMSESLEKHSHEQSSLTADLLKLSEANASLENKLSAVAAELMQVYADKEEESLENEKRISVLNQDIADLRRKLELLSSEKATVDDELAKLLADITTRDEKMKQMDDHLTQLQFEHAKLMAEFDTAHRSLSELRTQVSELEEEVEKQKLVISESAEGKREAIRQLCFSIEHYRSGYQELRQLLQGHRPVVMAT

SEQ ID NO: 10997 - DNA, 405 bp, Sorghum bicolor
  misc_feature: Ceres ANNOT ID no. 6119188
  misc_feature: Encodes the peptide sequence at SEQ ID NO 10998
atgggaggctgtgcgggaaaggcacgtcgtgatgacgaagaaagtttttatttcaaaggtggaaatgtgcatgttataacaactaaagagggctgggagcagaagattgcagaagcaaacagagatgggaaaaccgttgtggcaaatttcagtgcttcctggtgtgggccatgccgtgtcattgcttctgtctatgctgagatgtcaaagacttatcctcaactcatgttcttgacaatagacgtcgacgacctgatggaattcagcacgtcctgggacatccgtgcaaccccgacattcttcttcctcaagaacgggcagcagatcgacaagctcgtcggcgcgaacaaacctgagctcgagaggaaagtggtagcagccgctggtgccgccagttcgtcctag

SEQ ID NO: 10998 - protein, 134 aa, Sorghum bicolor
  misc_feature: Ceres ANNOT ID no. 6119188
  misc_feature (22)..(127): Pfam Id: Thioredoxin Pfam Desc: Thioredoxin
  misc_feature (1)..(133): NCBI GI: 24637227 NCBI Desc: thioredoxin h-like protein [zea mays]
  misc_feature (1)..(126): NCBI GI: 27543511 NCBI Desc: thioredoxin h [leymus chinensis]
  misc_feature (1)..(126): NCBI GI: 24637225 NCBI Desc: thioredoxin h-like protein [hordeum vulgare subsp. vulgare]
  misc_feature (1)..(126): NCBI GI: 1085952 NCBI Desc: protein s1 - phalaris coerulescens
  misc_feature (1)..(126): NCBI GI: 1086147 NCBI Desc: protein s2 - phalaris coerulescens
MGGCAGKARRDDEESFYFKGGNVHVITTKEGWEQKIAEANRDGKTVVANFSASWCGPCRVIASVYAEMSKTYPQLMFLTIDVDDLMEFSTSWDIRATPTFFFLKNGQQIDKLVGANKPELERKVVAAAGAASSS

SEQ ID NO: 10999 - DNA, 603 bp, Sorghum bicolor
  misc_feature: Ceres ANNOT ID no. 6119193
  misc_feature: Encodes the peptide sequence at SEQ ID NO 11000
atggccggtcaggggtgcaagataaccgcagtggcgctgctgcctctgctcatcctcctgccgctggcgatgctctcttccatggcgtcggctacgggccgctcgccggcagcgctgagcggcgagggcttcccggtgctgaggaaggtcccaactggaccaagcaatgagaccagcgacccgccgccgccaccgtatcaagtgcccgagagccccgtcgtcgactttccagtgctgaggaaggtcccaactggaccaagcaacgagaccagcgatccgccgccgccaccgtatcaagtgcccgagagccccgtcgtcgactttccagtgctgagaaaggtcccaactggaccaagcaacgagactagcgatccgccgccgccaccatctcatgtggctgagagccccgtcgtcgacttcccggtgctgaggaaggtcccaactggaccaagcaacgacaccagcgacccgccgccgccgccatcatctcaagtggctgagagccctatcgtcgactttccggtgctaagaaaagttccctccggaccaagcaacataacaagcgatccaccgccgccgccttcagtggccgcgagcgcttga

SEQ ID NO: 11000 - protein, 200 aa, Sorghum bicolor
  misc_feature: Ceres ANNOT ID no. 6119193
  misc_feature (10)..(179): NCBI GI: 115461749 NCBI Desc: os05g0117300 [oryza sativa (japonica cultivar-group)]
  misc_feature (21)..(193): NCBI GI: 115486507 NCBI Desc: os11g0657400 [oryza sativa (japonica cultivar-group)]
  misc_feature (48)..(199): NCBI GI: 66845451 NCBI Desc: actin associated protein [aspergillus fumigatus af293]
  misc_feature (16)..(198): NCBI GI: 15241187 NCBI Desc: proline-rich extensin-like family protein [arabidopsis thaliana]
  misc_feature (45)..(194): NCBI GI: 21992 NCBI Desc: extensin [volvox carteri]
MAGQGCKITAVALLPLLILLPLAMLSSMASATGRSPAALSGEGFPVLRKVPTGPSNETSDPPPPPYQVPESPVVDFPVLRKVPTGPSNETSDPPPPPYQVPESPVVDFPVLRKVPTGPSNETSDPPPPPSHVAESPVVDFPVLRKVPTGPSNDTSDPPPPPSSQVAESPIVDFPVLRKVPSGPSNITSDPPPPPSVAASA

SEQ ID NO: 11001 - DNA, 1299 bp, Sorghum bicolor
  misc_feature: Ceres ANNOT ID no. 6119197
  misc_feature: Encodes the peptide sequence at SEQ ID NO 11002
atggcgacctgcagggagagcggcgggttggtggcggtgcggtgcgccggaaggatcggggtggtggcctcggtggccatgaacctcgcgtggatcgccatgtacatccgccgccgctacttcggcgccggcggcggcggatctgacaacaacggccgcggcgtcaccacggtggagccgtccaaagggaaaccgccggtcactgaggactcaattgttaacctggaccatggtgacccgactatgtatgaggagttctggcgtgggacaggagatagcgcctccattttcatccctggttggcaaacaatgagctacttctccgacctcggcggcatttgttggttcgtcgagcccggcttcgagcgcgaggtccggcgtctccaccggctcgtcggaaatgccatggtcgacgggtaccatgtgctcgtcgggacaggctccacgcagctctttcaggccgtgctgtacgcactctcacctgcaagcgacggcacgcccatgaacgtcgtctcaccggcaccatactactcgtcatacccatctgtgaccaactttctgaactctgggctttaccgttggggtggtgatgccaatacatttgatggtgacacctgtattgagctcgtctgctcgccaaacaaccctgatggtagcatcagaaaagctgtcatcaaatccaagtctagcaaggctgtttatgacttcgcctactactggccacagtacgcacccatcaccgaggcagctggacatgatatcatgttattcactgtatccaaatgcaccggccatgccggcactagactggggtgggcattggtgaaggatactgaggtggcccagaaaatgattaagtttatagagctcaacacaattggcgtatccaaggactcccaacttcgtgccgctaagattattggggcaatctgtaacggctatgagctatcatctgctggtaaaacaagccacctcttccattttgctaaggaaaaaatggcggaacgttggattagactccgtgcagctgtggcagcctcagacatttttactctcccaaatgagctatcaggctattgtagtttttccaaggaggcagtcaccgccaatcctccatttgcatggcttcgctgcaagaaggatgatattgaagatttggagggctttctgcgtgggaaaaagataatcactcgaggtggcacaaagtttggagtggatgggagggttgtcagggttagtatggttgacacagaccaagccttcaatgtgttcatcaatcgtctcgccacaatgaagtga

SEQ ID NO: 11002 - protein, 432 aa, Sorghum bicolor
  misc_feature: Ceres ANNOT ID no. 6119197
  misc_feature (73)..(432): Pfam Id: Alliinase_C Pfam Desc: Allinase
  misc_feature (70)..(424): Pfam Id: Aminotran_1_2 Pfam Desc: Aminotransferase class I and II
  misc_feature (8)..(431): NCBI GI: 115462323 NCBI Desc: os05g0169300 [oryza sativa (japonica cultivar-group)]
  misc_feature (68)..(432): NCBI GI: 92874174 NCBI Desc: alliinase egf-like; allinase, c-terminal [medicago truncatula]
  misc_feature (70)..(432): NCBI GI: 9295708 NCBI Desc: f26f24.17 [arabidopsis thaliana]
  misc_feature (70)..(432): NCBI GI: 15220705 NCBI Desc: alliinase family protein [arabidopsis thaliana]
  misc_feature (226)..(432): NCBI GI: 115434754 NCBI Desc: os01g0169800 [oryza sativa (japonica cultivar-group)]
MATCRESGGLVAVRCAGRIGVVASVAMNLAWIAMYIRRRYFGAGGGGSDNNGRGVTTVEPSKGKPPVTEDSIVNLDHGDPTMYEEFWRGTGDSASIFIPGWQTMSYFSDLGGICWFVEPGFEREVRRLHRLVGNAMVDGYHVLVGTGSTQLFQAVLYALSPASDGTPMNVVSPAPYYSSYPSVTNFLNSGLYRWGGDANTFDGDTCIELVCSPNNPDGSIRKAVIKSKSSKAVYDFAYYWPQYAPITEAAGHDIMLFTVSKCTGHAGTRLGWALVKDTEVAQKMIKFIELNTIGVSKDSQLRAAKIIGAICNGYELSSAGKTSHLFHFAKEKMAERWIRLRAAVAASDIFTLPNELSGYCSFSKEAVTANPPFAWLRCKKDDIEDLEGFLRGKKIITRGGTKFGVDGRVVRVSMVDTDQAFNVFINRLATMK

SEQ ID NO: 11003 - DNA, 1206 bp, Sorghum bicolor
  misc_feature: Ceres ANNOT ID no. 6119267
  misc_feature: Encodes the peptide sequence at SEQ ID NO 11004
atgcagagcatggcggcgtcctgctcgtcgtcgtcctcctcctcctcctctagagcctgggccgcggcgcgccgctcgccctcgcccccatccctcgccttctcgtcctcctcctccttcccctcttcttctcatggctgccgctggccagtcgccccgcgcggcattcgcggggtcctgcggccgctgccctcgcccctgctcgcgccgtgcgtcgccagggccggcgccgcggccgcggcgtcgccgccggccgccggtaagccggagggcgccgccggcatttcgcggacgctgcagctcggggccatgatcctcgtctggtacctcctcaacatctacttcaacatctacaacaagctggttctgaaagcgatacccttcccttacaccatcaccaccttccatttcgcatccggatccttcttcatcacactcatgtggctgctcaatctgcatcccaaaccgaggctctccctcaaacagtatgcaaagctcctgcctttggctttgatccacatgcttggaaatgttttcaccaatatgagtttgggcaaggtggctgtctccttcacgcacaccgtcaaggccatggaacccttcttctcggtcctcctctctgtcctgttcctaggacagacaccttctctgttggtattaggttcactcgtccctgttgttggtggagttgtattggcgtccatgactgaagtttctttcaactggattgggttctggagtgctatggcttcgaatcttacgaatcaatcacgaaatgtttacagcaagaaaattctcgctgataaagaggacagtttggatgacataaatctcttctcgataataactatcatggcattcttgttatctgctccactgatgctatctgtagaaggcatcaagtttagcccatcgtatctacaaagtgctggagtcagtgtaaaagaattatgtgtaagagcggcacttgctggcacatgtttctatttttaccaacaggtttcatacagtttattggctagagtatctcctgtgacccattcggtagccaactctcttaaacgtgtggtggtcattgtgtcatctgttctcttcttcagaactccaatttcacctataaacgccttaggaaccggtgttgctcttgctggagtttttctgtactctcagttcaaaaagttaaaaccaaagactaaggctgcatga

SEQ ID NO: 11004 - protein, 401 aa, Sorghum bicolor
  misc_feature: Ceres ANNOT ID no. 6119267
  misc_feature (244)..(390): Pfam Id: TPT Pfam Desc: Triose-phosphate Transporter family
  misc_feature (16)..(401): NCBI GI: 1778147 NCBI Desc: phosphate/phosphoenolpyruvate translocator precursor
  misc_feature (19)..(401): NCBI GI: 118196907 NCBI Desc: plastid phosphoenolpyruvate/phosphate translocator [brassica napus]
  misc_feature (63)..(401): NCBI GI: 1778141 NCBI Desc: phosphate/phosphoenolpyruvate translocator precursor; ppt [arabidopsis thaliana]
  misc_feature (63)..(401): NCBI GI: 7546829 NCBI Desc: phosphate/phosphoenolpyruvate translocator [arabidopsis thaliana]
  misc_feature (63)..(401): NCBI GI: 21554233 NCBI Desc: phosphate/phosphoenolpyruvate translocator precursor [arabidopsis thaliana]
  misc_feature: The sequence is a functional homolog of SEQ ID NO. 360 in the 11/188,298 US application
MQSMAASCSSSSSSSSSRAWAAARRSPSPPSLAFSSSSSFPSSSHGCRWPVAPRGIRGVLRPLPSPLLAPCVARAGAAAAASPPAAGKPEGAAGISRTLQLGAMILVWYLLNIYFNIYNKLVLKAIPFPYTITTFHFASGSFFITLMWLLNLHPKPRLSLKQYAKLLPLALIHMLGNVFTNMSLGKVAVSFTHTVKAMEPFFSVLLSVLFLGQTPSLLVLGSLVPVVGGVVLASMTEVSFNWIGFWSAMASNLTNQSRNVYSKKILADKEDSLDDINLFSIITIMAFLLSAPLMLSVEGIKFSPSYLQSAGVSVKELCVRAALAGTCFYFYQQVSYSLLARVSPVTHSVANSLKRVVVIVSSVLFFRTPISPINALGTGVALAGVFLYSQFKKLKPKTKAA

SEQ ID NO: 11005 - DNA, 405 bp, Sorghum bicolor
  misc_feature: Ceres ANNOT ID no. 6119278
  misc_feature: Encodes the peptide sequence at SEQ ID NO 11006
atgtccggaggagacatggcggcgcaggcgggcggagacgcgcagcagcagcagcagcaggccgtcggcgggaaccggattcaggtgtccagctccaagaagccgctattcttctacgtcaatctcgctaagaagtacatgcagcagcacggcgacgtcgagctttccgcgctcgggctggccatatcaacggttgtaaccattgcagagatactgaagaacaatggtcttgctgtcgagaagaagattagaacatccacggttgaaatcattgacgaaacgaaagcccgaccaatccaaaaggctaagattgagatagtgctgggaaagactgataagtttgaggaattgatggcggccaatgttggagatgcaaacgcaggagatggcgaggaacaaacctag

SEQ ID NO: 11006 - protein, 134 aa, Sorghum bicolor
  misc_feature: Ceres ANNOT ID no. 6119278
  misc_feature (23)..(92): Pfam Id: Alba Pfam Desc: Alba
  misc_feature (25)..(133): NCBI GI: 52696238 NCBI Desc: chain b, x-ray structure of gene product from arabidopsis thaliana at2g34160
  misc_feature (70)..(133): NCBI GI: 115444903 NCBI Desc: os02g0202500 [oryza sativa (japonica cultivar-group)]
  misc_feature: Useful for making plants with modulated nitrogen use efficiency
  misc_feature: Functional homolog of the protein sequence encoded by LOCUS at2g34160
  misc_feature: Useful for making plants with modulated nitrogen use efficiency
  misc_feature: Functional homolog of the protein sequence given in SEQ ID NO 13593
MSGGDMAAQAGGDAQQQQQQAVGGNRIQVSSSKKPLFFYVNLAKKYMQQHGDVELSALGLAISTVVTIAEILKNNGLAVEKKIRTSTVEIIDETKARPIQKAKIEIVLGKTDKFEELMAANVGDANAGDGEEQT

SEQ ID NO: 11007 - DNA, 3222 bp, Sorghum bicolor
  misc_feature: Ceres ANNOT ID no. 6119283
  misc_feature: Encodes the peptide sequence at SEQ ID NO 11008
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
atggcggccaacaaggggatggtggcgggctcgcacaaccgcaacgagttcgtcatgatccgacacgacggcgacgcgcccgccccggctaagcccgcgaagagcgcgagtgggcaggtctgccagatttgtggcgacactgttggcgtttcagccactggtgatgtctttgttgcctgcaatgagtgtgccttccctgtctgccgcccttgctacgagtacgagcgcaaggaggggaaccaatgctgccctcagtgcaagactagatacaagagacagaaaggtagccctcgagttcatggtgatgaggaggaggaagatgttgatgacctggacaatgaattcaacaatgggaaaggcccagagtggcaactgcaaggagatgatgctgatctgtcttcatctgctcgccatgagccacatcatcggattccacgcctgacaactggccaacagatgtctggagagatccctgatgcttctcctgaccgtcattctatccgcagtccaacatcaagctatgttgatccaagcgtcccagttcctgtgcggattgtggacccctcaaaggacttgaattcttatgggcttaatagtgttgactggaaggaaagagttgagagctggagagttaaacaggacaaaaatatgatgcaagtgactaataaatatccagaggctagaggaggaggaggagacatggaggggactggctcaaatggagaagatatgcaaatggttgatgatgcacggctacctttgagccgtattgtgccaattccctcaaaccagctcaacctttaccggatagtgatcattctccgtcttatcatcctgtgcttcttcttccaatatcgtgtcagtcatccagtgaataatgcttatggattgtggctagtatctgttatctgtgaggtctggtttgccttgtcttggcttcttgatcagttcccaaaatggtatccaatcaaccgtgagacatatcttgacaggcttgcattgaggtatgatagagagggagagccgtcacagctggctcccattgatgtcttcgtcagtacagtggatccattgaaggaacctccactgatcacggccaacactgttttgtccattcttgctgtggattaccctgtcgacaaagtgtcatgctatgtttctgatgatggttcagctatgctgacatttgagtctctctcagaaaccgcagaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaagtaagaatcaatgcccttgttgccaaagcacagaaagtgcctgaagaggggtggaccatggctgatggaactgcttggcctgggaataatcctagggaccatcctggcatgattcaggtgttcttggggcacagtggtggtcttgacactgatggaaatgaattaccgcgtcttgtctatgtctctcgtgaaaagagaccaggcttccagcatcacaagaaggctggtgcaatgaatgcactgattcgtgtatctgctgtgctgacaaatggtgcctatcttctcaatgtggattgtgaccattacttcaacagcagcaaagctcttagagaagcaatgtgcttcatgatggatccggctctaggaaggaaaacttgttatgtacaatttccacaaagattcgatggcattgacatgcacgatcgatatgctaatcggaacatagttttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagaaaaagaacaaaagttatatggatagtcaaagccgtattatgaagagaacagaatcttcagctcccatcttcaacatggaagacatcgaagagggtattgaaggttatgaggatgaaaggtcagtgcttatgtcccagaggaaattggagaaacgctttggtcagtctccaattttcattgcatccacctttatgactcaaggtggcataccaccttcaacaaacccagcttctctactaaaggaagctatccatgtaatcagctgtgggtatgaggacaaaactgaatggggaaaagagattggctggatctatggttcagttacagaggatattctgactgggtttaaaatgcatgcaagaggatggcaatcaatctactgcatgccaccacgaccttgtttcaagggttctgcaccaatcaatctctctgatcgtcttaatcaggtgctccgttgggctcttgggtcagtggaaattttgctcagcagacattgtcctatctggtatggttacaatggccgactgaagcttttggagaggctggcttacatcaacaccattgtttatccaatcacatccattccgcttattgcctattgtgttcttcctgctatctgtctccttaccaataaatttatcattcctgagattagtaactatgctgggatgttcttcattcttcttttcgcctccatttttgccactggtatattggaactcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcattcctccgaccactgttcttgtcattaacctggtcggaatggtggcaggaatttcgtatgccatcaacagcggttaccaatcctggggtccgctctttggaaagctgttcttctcgatctgggtgatcctccatctgtaccccttcctgaagggtctcatgggcaggcagaaccgcacaccaacaatcgtcattgtctggtccatcctcctcgcgtccatcttctccttgctgtgggtgaagatcgatcctttcatctccccgacacagaaagctgccgccttggggcaatgcggtgtgaactgctga

SEQ ID NO: 11008 - protein, 1073 aa, Sorghum bicolor
  misc_feature: Ceres ANNOT ID no. 6119283
  misc_feature (253)..(1068): Pfam Id: Cellulose_synt Pfam Desc: Cellulose synthase
  misc_feature (1)..(1073): NCBI GI: 9622876 NCBI Desc: cellulose synthase-2 [zea mays]
  misc_feature (1)..(1073): NCBI GI: 9622874 NCBI Desc: cellulose synthase-1 [zea mays]
  misc_feature (1)..(1073): NCBI GI: 66269680 NCBI Desc: cellulose synthase bocesa1b [bambusa oldhamii]
  misc_feature (1)..(1073): NCBI GI: 66269678 NCBI Desc: cellulose synthase bocesa1a [bambusa oldhamii]
  misc_feature (1)..(1073): NCBI GI: 66269682 NCBI Desc: cellulose synthase bocesa2 [bambusa oldhamii]
  misc_feature (1)..(1071): SWISSPROT Homolog: EC 2.4.1.12 Cellulose synthase A catalytic subunit 1 [UDP-forming]
  misc_feature: Useful for making plants with altered cell wall content and/or composition
  misc_feature: GREAT-hit functional homolog of the protein sequence encoded by LOCUS at2g25540
  misc_feature: GREAT-hit functional homolog of the protein sequence encoded by LOCUS at4g32410
  misc_feature: Useful for making plants with altered cell wall content and/or composition
  misc_feature: Useful for making plants with modulated biomass
  misc_feature: Functional homolog of the protein sequence given in SEQ ID NO 13627
  misc_feature: The sequence is a functional homolog of SEQ ID NO 26 in US patent 7312377
  misc_feature: The sequence is a functional homolog of SEQ ID NO 6 in US patent 7285702
  misc_feature: Useful for making plants with altered carbohydrate content
  misc_feature: Functional homolog of the protein sequence given in SEQ ID NO 13628
  misc_feature: The sequence is a functional homolog of SEQ ID NO 2 in US patent 7049481
  misc_feature: Useful for making plants with modulated plant growth and development
  misc_feature: Functional homolog of the protein sequence given in SEQ ID NO 13629
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MAANKGMVAGSHNRNEFVMIRHDGDAPAPAKPAKSASGQVCQICGDTVGVSATGDVFVACNECAFPVCRPCYEYERKEGNQCCPQCKTRYKRQKGSPRVHGDEEEEDVDDLDNEFNNGKGPEWQLQGDDADLSSSARHEPHHRIPRLTTGQQMSGEIPDASPDRHSIRSPTSSYVDPSVPVPVRIVDPSKDLNSYGLNSVDWKERVESWRVKQDKNMMQVTNKYPEARGGGGDMEGTGSNGEDMQMVDDARLPLSRIVPIPSNQLNLYRIVIILRLIILCFFFQYRVSHPVNNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDMHDRYANRNIVFFDINMKGLDGIQGPVYVGTGCCFNRQALYGYDPVLTEADLEPNIVVKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 11009 - DNA, 1524 bp, Sorghum bicolor
  misc_feature: Ceres ANNOT ID no. 6119287
  misc_feature: Encodes the peptide sequence at SEQ ID NO 11010
atggagcccgtggcggcggaggaaggagaggacccacggtggaggcggagtaacaccgattgcgtctccttcctcgcttcccgcttcgcctgcaccaagggggctaattgcgagttccggcactgcgagggcgcgcggttcaaccagagctgctggtactggttccgaggcaactgcgtcaacccgagctgcactttccgccaccccccattggaaagcttaaaccgaaccaaacccttggcagatccacttgtttcatatgcttctgcttctatcaaggcagctaatccttgttatttctactacaactcgtattgtaagaaaggtgacagttgttccttcctacatgatcctattactcgtaacaatgtcggaatttcttctgaagctctcacttctaatcttgctaaaaatagcactcctgctggcaatgagatgattgaatcatcgaaagatgctcttgttaatccttgccaaggcagccctgaccgcacaaaggatcaccagtcaggacttccagcctcaagcagtcccaaacataatggacttattctcaatgcacctcaaacatcaattgatacagtgggatacatgaaaagcttcacactgtctgatcagagttcaggagattcagggattgaacatgctgaatatgatatatcgcgtgattcctcccctgggtttgatgttcttgttgatgacggactttctaacatgattgatcttgagcatcaatccacacaagaaagggacacagaggtgcttcatgtgaaacatcatgttggagactccattgtttatggtctggattattatgatgcagagtacaatgaacaaggacttcgtggctttgagcatggcagttgtcttgattattttgaaggagttcaagggcatgaccgtgtgaccacttcaggacatatgttgcataatagaataaatcttgtaaatccctcttgtgaagagcatgtaccaagattcttcaatccaagaagcttaatggactcacatgttggctctaatcatcagaactctcagattggacacatttcaaagcgaccacctgagagaagaggtgctaagggcaacaatggccgcaataagagatgtcgtattcatgaagccaggaatggttccgaagagatcgacactagaccaactcatgacatgcaaaattcattgataggagattgttctcggcctcttgcctgtgcaaccttcagaggacagaagaagaagagtagaaaaaaacaacgtcatgctcgttctgctggaccatctaaatattctactgcaaatgtgaagcacctggatcctgaagattttatgggtccaaagacacttgctcagataaaagaagagaagtgtagatccaagtcaagtgctagtcatcccactgttcacatgcctcatgggagtgggagatcgtcctcaaatgattttgaggggcctaaatctctgagtgagcttctcaaggtcaaggggaggacttctgttgatagggaatcatgctgtagcaagtaa

SEQ ID NO: 11010 - protein, 507 aa, Sorghum bicolor
  misc_feature: Ceres ANNOT ID no. 6119287
  misc_feature (11)..(200): NCBI GI: 92881980 NCBI Desc: zinc finger, ccch-type [medicago truncatula]
  misc_feature (51)..(168): NCBI GI: 76157055 NCBI Desc: sjchgc04818 protein [schistosoma japonicum]
  misc_feature (20)..(72): NCBI GI: 45219861 NCBI Desc: riken cdna 5730454b08 [mus musculus]
MEPVAAEEGEDPRWRRSNTDCVSFLASRFACTKGANCEFRHCEGARFNQSCWYWFRGNCVNPSCTFRHPPLESLNRTKPLADPLVSYASASIKAANPCYFYYNSYCKKGDSCSFLHDPITRNNVGISSEALTSNLAKNSTPAGNEMIESSKDALVNPCQGSPDRTKDHQSGLPASSSPKHNGLILNAPQTSIDTVGYMKSFTLSDQSSGDSGIEHAEYDISRDSSPGFDVLVDDGLSNMIDLEHQSTQERDTEVLHVKHHVGDSIVYGLDYYDAEYNEQGLRGFEHGSCLDYFEGVQGHDRVTTSGHMLHNRINLVNPSCEEHVPRFFNPRSLMDSHVGSNHQNSQIGHISKRPPERRGAKGNNGRNKRCRIHEARNGSEEIDTRPTHDMQNSLIGDCSRPLACATFRGQKKKSRKKQRHARSAGPSKYSTANVKHLDPEDFMGPKTLAQIKEEKCRSKSSASHPTVHMPHGSGRSSSNDFEGPKSLSELLKVKGRTSVDRESCCSK

SEQ ID NO: 11011 - DNA, 804 bp, Sorghum bicolor
  misc_feature: Ceres ANNOT ID no. 6119291
  misc_feature: Encodes the peptide sequence at SEQ ID NO 11012
atgatgctgagggcccggggagcggcgggggcgctgctccgcctcgccggcgctggagctggaactggcgtacagaggggcggggtcactccgctagcgcgcgcggcgttagctcgcggcttcctggatttccgcaagacggggaacaaggaggccatggagcaggagaaggagaagaagaaggccaggcttaccgatgaaatgagtagaggctacttcgcagacattgctgagatccgcaagaatgccggcaagattgcgatggcgagtaaggtcatcatcccggaggcagatgctgtgaagtttcctgatcttgctgtggattcccctgctggaggggcgctgcatctgcctcttgttgtgcctgctctgcaaggcgatgatggtgaggctggagaccatgtgattcccggtgcttctttggtgtgcctttccttccgtgcaagctcgctgaaaatggcagagtcatggagtttacctttcctggatgcattcggtgctgccaagaatgtgcatgtttatgaggtctcatttatagattcttggctattatcattgagtcctgtgagacgagcatttctcaaggtgatgaggaaatctaacaatccacagagacatgttgtctatggtttcggggaccattatgacttccggaagaagcttcaaattataaaccttctcactggatacatatacctggttgatagcctgggaagaataagatggcaaggctttggatccgcaacacaagaagagctgttgtcacttacagcgtgtacctccattttgttagatgaaaaatga

SEQ ID NO: 11012 - protein, 267 aa, Sorghum bicolor
  misc_feature: Ceres ANNOT ID no. 6119291
  misc_feature (22)..(263): Pfam Id: ATP-synt_10 Pfam Desc: ATP10 protein
  misc_feature (86)..(267): NCBI GI: 6579209 NCBI Desc: t23g18.8 [arabidopsis thaliana]
MMLRARGAAGALLRLAGAGAGTGVQRGGVTPLARAALARGFLDFRKTGNKEAMEQEKEKKKARLTDEMSRGYFADIAEIRKNAGKIAMASKVIIPEADAVKFPDLAVDSPAGGALHLPLVVPALQGDDGEAGDHVIPGASLVCLSFRASSLKMAESWSLPFLDAFGAAKNVHVYEVSFIDSWLLSLSPVRRAFLKVMRKSNNPQRHVVYGFGDHYDFRKKLQIINLLTGYIYLVDSLGRIRWQGFGSATQEELLSLTACTSILLDEK

SEQ ID NO: 11013 - DNA, 2064 bp, Sorghum bicolor
  misc_feature: Ceres ANNOT ID no. 6119296
  misc_feature: Encodes the peptide sequence at SEQ ID NO 11014
atgtcgggacctaataaagctccatttagtggagtggctgaggatttgaaaggaagagcagcttgctacaaacaagactggaaccatggatttcgttctggtttaaggatattggcacctacgctctacatattctttgcatccgcagttcctgttatagcctttggggagcaattgagcaaagatacagatggtacactaaccacagttgagacattagcatcaactgctatttgtggaatcatacaatcaataataggcggacagccactattgatcgtgggagttgcagaaccgactattatcatgtacacctatatctacaattttgccaaaaaccaaccaaacctgggagaaaaaatgtttcttccatgggctgcatgggtttgcatctggacggctgtgatgctgttcctcatggcaatgtttaacgttgcagctattctaaacagatttacaaggttttctggagaactttttggaatgttaatcacagttttgttcatgcaagaggcaatcaaggggatgttgggtgaattcagtgcccctgaggggaatgaccaaagtcaaccaatattccagttccagtggctatatattaatggtctgcttggactaatcttttcaatgggtgtactatatacttcattatctagcgggagcgcaagatcatcgctctacggcactggatggcaaaggagcttaattgctgactatggtgttccactgattgtcatactgtggacagcattgtcatattcattgccaagcaagatcccttcaggggtccctaggaggctcttcaccccacttccttgggaacccaagtcgctccagcattggacagtggcaaaagatctgttttcagtccctccagcacatatattcctggctattgtgcctgctgcgatggttgcagggctctatttctttgaccacagtgtagcttcacagatggctcagcagaaggaatttaatttgaagaacccatcagcctaccattatgacattttggtcctgagcttgacaaccttgatctgtggtcttcttggcattcctccatctaatggagtacttccccagtctcccatgcatacaagaagcctagctgtcctcaagaggcagttgcttcgcaaaaagatggtccaaactgccaaggagggcatgatgaataatgctaccagttctgaagtttatggcaaaatgcaagatgttttcataaaaatggaccatggaggcgacactgtttctgcgcacaaagaactgaaggacttgaaggatgcaattattccggaggggaacggagcagggacagtgcctgaagtatttgatcctgaaaagcatgtagatgcctacttgcctgtccgggtgaacgagcagagagtgagcaatctgttgcagtccctgttgattgctggttgtatcggaattacgcctctcattcagaggataccgacatcagtcctctggggttacttcgcctatatgtccatcgacagccttcctgggaaccagttctgggagaggataaaacttcttttcatcacgcctcaaaggcgctacaaggttcttgaaggagcacacgcatccttcatggagtcagtgcctttcaacacaatatgtgccttcacagccttccagctaatctatctgttgatcgtctttgggatgacatggataccagtagcaggaatcctcttcccgctgctcttcttcttcctcattgtcatcaggcaacatttgattccgaaatatttcgatccgagccacctgagggaattagatgcagccgagtacgaagaactcgaaggttttacgcctgatccgtcagtgtgtgaggacgagtctgttcgaagccgagatgctcagcctggatatgcttctgaaatactggaggaattcacgactcaccgtggagagctgaaacgcaggaactctagcttccgtgatgggagactactccagcttaactctgtcaggatgacaagagagctttctcgggctccttctcggatagagctttctcgggctccttctcgggttccaagagtcatggaacaataa

SEQ ID NO: 11014 - protein, 687 aa, Sorghum bicolor
  misc_feature: Ceres ANNOT ID no. 6119296
  misc_feature (8)..(546): Pfam Id: HCO3_cotransp Pfam Desc: HCO3- transporter family
  misc_feature (1)..(670): NCBI GI: 89892354 NCBI Desc: boron transporter [oryza sativa (japonica cultivar-group)]
  misc_feature (6)..(658): NCBI GI: 89892352 NCBI Desc: boron transporter [oryza sativa (japonica cultivar-group)]
  misc_feature (6)..(652): NCBI GI: 115434832 NCBI Desc: os01g0175600 [oryza sativa (japonica cultivar-group)]
  misc_feature (6)..(658): NCBI GI: 55295941 NCBI Desc: band 3 anion transport protein -like [oryza sativa (japonica cultivar-group)]
  misc_feature (42)..(658): NCBI GI: 115434834 NCBI Desc: os01g0175700 [oryza sativa (japonica cultivar-group)]
MSGPNKAPFSGVAEDLKGRAACYKQDWNHGFRSGLRILAPTLYIFFASAVPVIAFGEQLSKDTDGTLTTVETLASTAICGIIQSIIGGQPLLIVGVAEPTIIMYTYIYNFAKNQPNLGEKMFLPWAAWVCIWTAVMLFLMAMFNVAAILNRFTRFSGELFGMLITVLFMQEAIKGMLGEFSAPEGNDQSQPIFQFQWLYINGLLGLIFSMGVLYTSLSSGSARSSLYGTGWQRSLIADYGVPLIVILWTALSYSLPSKIPSGVPRRLFTPLPWEPKSLQHWTVAKDLFSVPPAHIFLAIVPAAMVAGLYFFDHSVASQMAQQKEFNLKNPSAYHYDILVLSLTTLICGLLGIPPSNGVLPQSPMHTRSLAVLKRQLLRKKMVQTAKEGMMNNATSSEVYGKMQDVFIKMDHGGDTVSAHKELKDLKDAIIPEGNGAGTVPEVFDPEKHVDAYLPVRVNEQRVSNLLQSLLIAGCIGITPLIQRIPTSVLWGYFAYMSIDSLPGNQFWERIKLLFITPQRRYKVLEGAHASFMESVPFNTICAFTAFQLIYLLIVFGMTWIPVAGILFPLLFFFLIVIRQHLIPKYFDPSHLRELDAAEYEELEGFTPDPSVCEDESVRSRDAQPGYASEILEEFTTHRGELKRRNSSFRDGRLLQLNSVRMTRELSRAPSRIELSRAPSRVPRVMEQ

SEQ ID NO: 11015 - DNA, 1260 bp, Sorghum bicolor
  misc_feature: Ceres ANNOT ID no. 6119317
  misc_feature: Encodes the peptide sequence at SEQ ID NO 11016
atggagatacaaacttcagggaagcccattgatgtgctgatggagaaggttcttcgcatgaacattctgtcttctgattactttaaggagctctataggttgaagacctatcatgaggtcattgatgagatctacaacacagttgaacacgtggagccttggatgactggcaattgcagaggcccctccactgcattctgtcttctatacaagttcttcactatgaagcttactgtcaaacagatgcatggtttgttgaagcatcttgactccccatacattagagctattggtttcttgtatcttcgctatgttgcagacccaaagattctgtggacatggtatgagccctatttgagggatgatgaggagttctcccctggatctaatggccgcaagacaaccatgggtgtttatgtgcgtgatcttatacttggacagtactactttgatagtcttctaccaagaattcctctcccagtaactcgtcagattacagccaatcttgagaagatgaaattgcccactaaactttctggggcaactggggactctagtcgtcagggatcagaagatactgcacgtcgtcctccttcagtgaaagcttctctgtcagtttcctttggacagcgtgctccacatcgggcttccaccagagattcatccccagttcggcgaacagtcacccatgatgatcatcgaagatcatactcaccatctcatcgcagtggtagccgtgagggtcctgaccgtgaccgttctgaccgagaattggatcgttctagccgtgatcgtgacagagaccaagatcgttcaagcagggaccggtatcgttcaagccgagaccttgaccgtgacaaggacgccagagattatcatcgccatgagcgtgatagcagggatcgtgagtattaccggtccaggcgttcagaagaaagacgggacgacagaagagatcatgaaagcagcaggcacaggcgctctaactctcgccacagaagtcgtagtcgtagtcgaagccggagcaggaggagtcgaagccggagccggagccggagtcggagcaggaatgagcagcgatccagcccattcagggatgcaaataaagagaaggcagccactgtgtcaagcaacctagcaaagctgaaggacttgtacggtgacataactgagaagaaggaagacagtgatgctgaaaagcttcaccgtgattcatgtgctgaggaggtcatcaggctgggaggccctcgatggaggtaa

SEQ ID NO: 11016 - protein, 419 aa, Sorghum bicolor
  misc_feature: Ceres ANNOT ID no. 6119317
  misc_feature (1)..(169): Pfam Id: PRP38 Pfam Desc: PRP38 family
  misc_feature (1)..(419): NCBI GI: 115462403 NCBI Desc: os05g0178900 [oryza sativa (japonica cultivar-group)]
  misc_feature (63)..(399): NCBI GI: 55665680 NCBI Desc: novel protein (flj10330) [homo sapiens]
  misc_feature (63)..(399): NCBI GI: 30794464 NCBI Desc: riken cdna 1110021e09 [mus musculus]
  misc_feature (14)..(409): NCBI GI: 47087297 NCBI Desc: zgc:63496 [danio rerio]
  misc_feature (63)..(320): NCBI GI: 116122433 NCBI Desc: ensangp00000020689 [anopheles gambiae str. pest]
MEIQTSGKPIDVLMEKVLRMNILSSDYFKELYRLKTYHEVIDEIYNTVEHVEPWMTGNCRGPSTAFCLLYKFFTMKLTVKQMHGLLKHLDSPYIRAIGFLYLRYVADPKILWTWYEPYLRDDEEFSPGSNGRKTTMGVYVRDLILGQYYFDSLLPRIPLPVTRQITANLEKMKLPTKLSGATGDSSRQGSEDTARRPPSVKASLSVSFGQRAPHRASTRDSSPVRRTVTHDDHRRSYSPSHRSGSREGPDRDRSDRELDRSSRDRDRDQDRSSRDRYRSSRDLDRDKDARDYHRHERDSRDREYYRSRRSEERRDDRRDHESSRHRRSNSRHRSRSRSRSRSRRSRSRSRSRSRSRNEQRSSPFRDANKEKAATVSSNLAKLKDLYGDITEKKEDSDAEKLHRDSCAEEVIRLGGPRWR

SEQ ID NO: 11017 - DNA, 2529 bp, Sorghum bicolor
  misc_feature: Ceres ANNOT ID no. 6119378
  misc_feature: Encodes the peptide sequence at SEQ ID NO 11018
atgagcgtggtggggttcgacctcggcaatgagagctgcatcgtggcggtcgcgcggcagcgcggcatcgacgtggtcctcaacgaggagtccaagcgcgagacacccgccatcgtctgcttcggggacaagcagaggttcatcggcaccgccggcgccgcgtcctccaccatgaaccccaaaaactccatctctcagatcaagcgcctgctcggccgcaagttctccgaccccgagctgcagagcgatctcgcctccttcccgttccgtgtcacggagggccccgatggttttcccctggtccacgcacggtacctgggcgaggagcggaccttcacccccacccagctgcttgccatggtgctgtccaatttgaagggcattgctgagggtaacctgaataccgcagttgttgattgttgcattggtatcccggtctacttcacggatctgcagcgcagggctgttcttgatgctgctactattgcgggtctccggccattgcgattgttccatgagacgacagccactgccctggcatatggtatttataagactgatctcccggagaatgaccagttgaacgttgcatttgttgatgtcggccatgcaagcatgcaggtcagcgttgtcggttacaagaaaggacagctcaagatgttgtcgcatacgtatgaccggtctcttggcgggagggactttgatgaggccctgtttaagcactttgcagctaaatttaaagaggaatataagattgatgtgtaccagaatgcgcgtgcatgcattaggttgcgcgtggcatgtgagaaacttaagaaggtgctgagcgccaacccagaggccccactgaacatcgagtgcttgatggatgagaaggatgtgcggggttttatcaagagggaggagttcgaacagatcagtgcctctgtgctggaacgcgtgaaaggaccactggagaaggccttggctgaagctgggttgactactgaaaatgtgcactttgttgaggttgtcggatctggttctcgtgttccggctataatcaagataattactgaattttttgggaaggagccaagacggaccatgaatgcaagtgagtgtgttgcgcgaggatgcgctcttcagtgtgctattctcagccccactttcaaagtgcgagaattccaggttaatgatgggtttcctttctcaattgcattgtcatggaatggagactcccagaatataccccaacaaacccttgtattcccaaaggggaatgcaattcctagcaccaaagctcttaccttctttaaatccagtacttttgaagttgatgttttgtatgtcgacccagatgactcacaaatttcacaaaaaataagcacttacacaattggccctttccaaacctccaaaggagagaaggccaaactgaaagtgaaagtgcgtctcaacatccatgggactgttacagttgattcggcaatgatgctggaggaggaggatgtggaagttccagtctcatctgcaaatgaagctccaaaggatactatgaagatggacacagatgatgcaccaagtgatgctgctgctggatctgatgtgaatatgcaggagcctaaaagtgctgagaccactgaggctgctcctgctgctgaaaatggagcacaagatactgagcaaaaatctgttccgatggaaactgatgcaaaggttgagctgtcgaaaaagaaagttaagaaaactactgttccagtccatgagttggtctatggggccttggctgcaattgacctgcagaaggctgtagagaaagagtatgagatggctcttcaagacagagtaatggaagaaacaaaggagaagaagaatgctgtcgaagcttatgtgtatgacatgcgtaacaagctatatgacaagtacagtgattttgtcacacctgaggacaaggaaggtttgattgctaagcttcaggaggttgaagactggctctatgaagatggtgaggatgagaccaagggagtttatattgctaaactagaagaacttaagaaggttggtgatcctatcgaggcgcgcttcaaagaatgggagattagaagttctgctgttagtcaactggtatactgcatcaatagcttcagagaagctgcactgtctaatgaccagaagtttgaacacatagacgtgtcagaaaagcaaaaggtcattaatgagtgttcggaagcagagacttggctaatagagaaaaagcagcagcaggatgctctgccaaagcatgctaatccggtccttcttgccgctgaccttaagaagaaagctgaaacacttgacaggttctgcaagccgattatgacgaaaccgaagccagctcctaagccacagactccgcctccggtagaaacccaggctcctgagcctcagacgccagagcagcagcaatcaaatggcgaaagcgcagccagcgagggagctgcagaggagcctccagccgagcagatggacacagacaaacctgagggagccacagatccctcggcctag

SEQ ID NO: 11018 - protein, 842 aa, Sorghum bicolor
  misc_feature: Ceres ANNOT ID no. 6119378
  misc_feature (3)..(691): Pfam Id: HSP70 Pfam Desc: Hsp70 protein
  misc_feature (1)..(821): NCBI GI: 1495251 NCBI Desc: heat-shock protein [arabidopsis thaliana]
  misc_feature (1)..(573): NCBI GI: 1568627 NCBI Desc: heat shock protein 110 [strongylocentrotus franciscanus]
  misc_feature (1)..(832): NCBI GI: 1098541 NCBI Desc: osmotic stress protein 94
  misc_feature (1)..(832): NCBI GI: 30525062 NCBI Desc: heat shock protein 4 [cyprinus carpio]
  misc_feature (1)..(616): NCBI GI: 4835791 NCBI Desc: strong similarity to gbz70314 heat-shock protein from arabidopsis thaliana and is a member of the pf00012 hsp70 protein family
MSVVGFDLGNESCIVAVARQRGIDVVLNEESKRETPAIVCFGDKQRFIGTAGAASSTMNPKNSISQIKRLLGRKFSDPELQSDLASFPFRVTEGPDGFPLVHARYLGEERTFTPTQLLAMVLSNLKGIAEGNLNTAVVDCCIGIPVYFTDLQRRAVLDAATIAGLRPLRLFHETTATALAYGIYKTDLPENDQLNVAFVDVGHASMQVSVVGYKKGQLKMLSHTYDRSLGGRDFDEALFKHFAAKFKEEYKIDVYQNARACIRLRVACEKLKKVLSANPEAPLNIECLMDEKDVRGFIKREEFEQISASVLERVKGPLEKALAEAGLTTENVHFVEVVGSGSRVPAIIKIITEFFGKEPRRTMNASECVARGCALQCAILSPTFKVREFQVNDGFPFSIALSWNGDSQNIPQQTLVFPKGNAIPSTKALTFFKSSTFEVDVLYVDPDDSQISQKISTYTIGPFQTSKGEKAKLKVKVRLNIHGTVTVDSAMMLEEEDVEVPVSSANEAPKDTMKMDTDDAPSDAAAGSDVNMQEPKSAETTEAAPAAENGAQDTEQKSVPMETDAKVELSKKKVKKTTVPVHELVYGALAAIDLQKAVEKEYEMALQDRVMEETKEKKNAVEAYVYDMRNKLYDKYSDFVTPEDKEGLIAKLQEVEDWLYEDGEDETKGVYIAKLEELKKVGDPIEARFKEWEIRSSAVSQLVYCINSFREAALSNDQKFEHIDVSEKQKVINECSEAETWLIEKKQQQDALPKHANPVLLAADLKKKAETLDRFCKPIMTKPKPAPKPQTPPPVETQAPEPQTPEQQQSNGESAASEGAAEEPPAEQMDTDKPEGATDPSA

SEQ ID NO: 11019 - DNA, 582 bp, Sorghum bicolor
  misc_feature: Ceres ANNOT ID no. 6119401
  misc_feature: Encodes the peptide sequence at SEQ ID NO 11020
atggtgagcgccgaggtcggcatcgactacgtgctgtggacggaggccgaggtgtccggccgcgtgggcgaggtcgccgccgagctcgcggccgacctgcgcgcgcagccggagcccgccgtcgtcgtgggcgtcgccacgggcgcgttcctcttcctcgccgacctcgtccgccgcgtcgacgtgcggctcgcggtcgacttcgtgcgcgtcgagtcctacggggccggcacagagtccagcggcaagccacgtatcacgtccgacctcaaggtcgacgtggccggcaaacacgtcgtcgtggttgaagatattgtggacacagggaatactctgtcctgtctcattgctcatttggagaagaaaggtgcatcatccatatcggtttgtactttccttgacaaaccagcaagaaggaaagtcagtgttcagttagtgggggatggaaaattctaccgaggctttgagtgcccagactactttgttgttggctacggtttggattatgcggagctctaccgtaacctgccttatgtcggagttctcaagcccgagatgtacaaaaaggattcaagcaattag

SEQ ID NO: 11020 - protein, 193 aa, Sorghum bicolor
  misc_feature: Ceres ANNOT ID no. 6119401
  misc_feature (7)..(152): Pfam Id: Pribosyltran Pfam Desc: Phosphoribosyl transferase domain
  misc_feature (2)..(181): NCBI GI: 11935213 NCBI Desc: hypoxanthine-guanine phosphoribosyltransferase 1 [arabidopsis thaliana]
  misc_feature (2)..(165): NCBI GI: 7239502 NCBI Desc: similar to the hypoxanthine-guanine phosphoribosyltransferase from bacillus firmus gi1813472. est gbai996342 comes from this gene. [arabidopsis thaliana]
  misc_feature (8)..(188): NCBI GI: 121535065 NCBI Desc: hypoxanthine phosphoribosyltransferase [thermosinus carboxydivorans nor1]
  misc_feature (8)..(188): NCBI GI: 76258802 NCBI Desc: hypoxanthine phosphoribosyl transferase [chloroflexus aurantiacus j-10-fl]
  misc_feature (8)..(188): NCBI GI: 77683649 NCBI Desc: hypoxanthine phosphoribosyl transferase [alkaliphilus metalliredigenes qymf]
MVSAEVGIDYVLWTEAEVSGRVGEVAAELAADLRAQPEPAVVVGVATGAFLFLADLVRRVDVRLAVDFVRVESYGAGTESSGKPRITSDLKVDVAGKHVVVVEDIVDTGNTLSCLIAHLEKKGASSISVCTFLDKPARRKVSVQLVGDGKFYRGFECPDYFVVGYGLDYAELYRNLPYVGVLKPEMYKKDSSN

SEQ ID NO: 11021 - DNA, 1935 bp, Sorghum bicolor
  misc_feature: Ceres ANNOT ID no. 6119407
  misc_feature: Encodes the peptide sequence at SEQ ID NO 11022
atggcggacggccaccacttcaacaatatctcactcggcggccgtggcggcggcaaccctgggcagttcaaactttactccggaggcttggcatggaagaagcaaggaggaggaaagatcattgaggttgataaaggtgatatcacttctgtggcttggatgaggattcctaaatcttatcagcttagcgttggaacaaaggagggcctctgttacagattttttggctttcgtgaacaggatgttagtagcctgactaatttcatagagaagagcactggaatcacaccagaagagaagcaactttctgttactgggcataattggggcggaatagaaataaatgggagtatgctttgctttaatgttggttcaaaggaagcgtttgaagtctctctagcagatgtggcacagactcagatgcaagggaaaacagatgttgtcctagagttccatgtagatgatactactggggcaaatgagaaagattctttgatggatttaagtttccatgttccgacttcaaatacgcaattcgttggagatgagcatcgtacttcagctcagatgttatggcaggctatctcggttgaaattgatggtggtggctcatcagagatggctgttgttacatttgatggaattgcaattcttacaccaaggggtcgatacagtgttgagcttcatcagtcattcttgcgactccaaggacaagctaatgatttcaaaatccaatatagtagtattcttcgcctatttgttttaccaaagtcacacaatccacatacctttgtggttatcacacttgatccaccaattcggaaagggcaaactttatatcctcacattgttattcagtttgagacagaggcagtggttgaaagggaactggcattaagtggtgaggttttggctgagaagtacaaggataggcttgagagctcttacaggggtctaatacatgaggtattctccaaggtccttcgtggcttatctggtgctaaagtgacaaggccaagtacattccgcagttgccaagatggatatgcagtcaaatcatcacttaaagctgaagatggtttgctttatccactcgaaaagggcttcttctttctgccaaagcccccaacactaattcctcatgatgagattgagtatgttgagtttgagcgtcatggtgctggaggtgcaagcatatcatctcattacttcgaccttttggttaagctcacaaatgatcaagaacatctcttcagaaacatccaaaggaatgaataccataacctcttcaacttcatcagtggtaagcatttgaaaattctgaatcttggagatggccaaggtagaactagtggtgttactgctgttcttcagagcacggatgatgattctgttgatccacatctggagcggataaaaaatcaggctggtaatgatgaaagcgatgaagaggatgaagattttgtggcagacaaggacgatagtggatctccaacggatgattctgatgcggatggctctgatgctagtatgagtggaggagacaaggagaaaccttccaagaaggaagctagtagctcaaaggaagctagtagctcaaagccgcctgtgaagaagaagcagaagagtgggcctgatgaaggttctcaaaaaaagaggccaaagaagaagaaagatcccaatgcccctaagagagctatagccccattcatgtacttctcaaaggctgagcgagctaatatcaagagcagcaatcctgaactggctaccacagagattgcaaagaagctcggagaaaggtggcaaaagatgacagctgaggagaggcagccatatgtggagcagtcccaagtcgacaagcaacgctatgcagaagagtctgcagcttaccgtggtgcagccgctcagcagggctctggtgctggatcggaatga

SEQ ID NO: 11022 - protein, 644 aa, Sorghum bicolor
  misc_feature: Ceres ANNOT ID no. 6119407
  misc_feature (219)..(436): Pfam Id: SSrecog Pfam Desc: Structure-specific recognition protein (SSRP1)
  misc_feature (359)..(503): Pfam Id: Rtt106 Pfam Desc: Histone chaperone Rttp106-like
  misc_feature (563)..(631): Pfam Id: HMG_box Pfam Desc: HMG (high mobility group) box
  misc_feature (1)..(644): NCBI GI: 75253362 NCBI Desc: fact complex subunit ssrp1-b (facilitates chromatin transcription complex subunit ssrp1-b) (recombination signal sequence recognition protein 1-b)
  misc_feature (1)..(642): NCBI GI: 21314337 NCBI Desc: early drought induced protein [oryza sativa (indica cultivar-group)]
  misc_feature (1)..(642): NCBI GI: 75263890 NCBI Desc: fact complex subunit ssrp1-a (facilitates chromatin transcription complex subunit ssrp1-a) (recombination signal sequence recognition protein 1-a) (early drought-induced protein
  misc_feature (1)..(642): NCBI GI: 75263890 (continued) r1g1a)
  misc_feature (1)..(644): NCBI GI: 8920409 NCBI Desc: ssrp1 protein [zea mays]
  misc_feature (1)..(631): NCBI GI: 75218951 NCBI Desc: fact complex subunit ssrp1 (facilitates chromatin transcription complex subunit ssrp1) (recombination signal sequence recognition protein 1)
MADGHHFNNISLGGRGGGNPGQFKLYSGGLAWKKQGGGKIIEVDKGDITSVAWMRIPKSYQLSVGTKEGLCYRFFGFREQDVSSLTNFIEKSTGITPEEKQLSVTGHNWGGIEINGSMLCFNVGSKEAFEVSLADVAQTQMQGKTDVVLEFHVDDTTGANEKDSLMDLSFHVPTSNTQFVGDEHRTSAQMLWQAISVEIDGGGSSEMAVVTFDGIAILTPRGRYSVELHQSFLRLQGQANDFKIQYSSILRLFVLPKSHNPHTFVVITLDPPIRKGQTLYPHIVIQFETEAVVERELALSGEVLAEKYKDRLESSYRGLIHEVFSKVLRGLSGAKVTRPSTFRSCQDGYAVKSSLKAEDGLLYPLEKGFFFLPKPPTLIPHDEIEYVEFERHGAGGASISSHYFDLLVKLTNDQEHLFRNIQRNEYHNLFNFISGKHLKILNLGDGQGRTSGVTAVLQSTDDDSVDPHLERIKNQAGNDESDEEDEDFVADKDDSGSPTDDSDADGSDASMSGGDKEKPSKKEASSSKEASSSKPPVKKKQKSGPDEGSQKKRPKKKKDPNAPKRAIAPFMYFSKAERANIKSSNPELATTEIAKKLGERWQKMTAEERQPYVEQSQVDKQRYAEESAAYRGAAAQQGSGAGSE

SEQ ID NO: 11023 - DNA, 2586 bp, Sorghum bicolor
  misc_feature: Ceres ANNOT ID no. 6119447
  misc_feature: Encodes the peptide sequence at SEQ ID NO 11024
atggcgacagctggagctcagccgcggcgacacccagaaaccctcttgcccttcccccctccgcatccaatcccccaccacccggtgcacgagacgagatcgcgggtgcacgcagttgcccaggaagaaggcaaggtcgcctcaaaaaagcagaaatcagagaatgaagaccaggaaaggggccagcatgtgccctccaagaacaaaaagcctgtggacaataaagggcaagacggggaatcagaggcaccaacgaagagcaagaagctcaaagctgatgaatctgagcccaatgggagggaagctgccgcaagagactttgcagagttttgcaaggccctaggagaacacctctccctggacgacatgcgcaatatccttgaagccaatgagcaagatgcttctggatcggaggatgcagtcgttctaagatgtgaggatatgatgttctatgggcctctcgagaagtgcccagtatgtggtggtcagcttgaatttaaggggtggaaatacaggtgcactgggaactacagcgagtgggcacgctgtactttcagtagtaacgacccttcaaggaggagtggtcctatagaagttcctgatgacataaaagatgattttatccgcaagtggctgaaacaacatgaaggaaaggagttccctaaacgtgatgttgatgaagaggcccatatcttctccggcatgatgattgccttgtctggacggatgtcacgctcacatggttacttcaaggagcagattatgaaacatggagggaaggtcaataattccgtgcttggggttacctgtgtagtggcttctccagctgagagagataaaggtggctctggaggattcgctgaagcactggagcgtggaactcctattgttagtgagaattggataattgatagtattgagaagaaggaagttcagcctttagctgcctatgatattgtttctgatgttgttccggaaggccgaggactcccactgggccaacttgatccaagtgaggaggccattgagaccttagctgcagaggttaaacttgctggcaagagatctgtccacaaggactctaaactcgagaaagatggtggatgtgtctttgagaaggatggcataatctacaactgtgcttttgctgtatgcgatctaggatgccagatgaatgagttatgcatcatgcagctgattatggtccctgaaaatcgtttgcacctattctacaagaaaggtccaattggtcatgaccagatggcagaggaacgagtggaggattttggtagccgtatcaatgatgctattaaagaatttgttcggctatttgaggaggttactggaaatgagtttgagccttgggaaaggcagaagaagtttgagaagaagagtatgaagatgtatcccttggacatggatgttggtgtagatgtgcgtcatggaggtgcagcacttcgtcagttgggttctgcagcagcacattgcaagcttgatccttctgtttctttccttgtgaaacagttatgtggccaagagatttataggtatgctttgatggagatggcccaggacctgcctgaccttcccatagggatgcttactgatctccatctgaagagaggggaggatatgctgcttcagataagaggagatgcagagtcagtggcagagtctggcccagaagcagatgcattctggactgaagtcagcagcaaatggttcactctgttccccacaactcgaccgtacacgatgagggggtttgagcagattgctgacaatgtagcatcaggttttgagacagtacgtgatataaacgacgcatctcatctcattggggatgtctttagttcgactttggatgatccgctgtctgaatgctacaagaagctcggttgttcgatcaatcctgttactgaggattcagaagactacaagatgattctgaagtacctagagaaaacatacgagcctgtcaaggtggaggatgtggtttatggtgtgtccgtggagaggatatatgctgttgaatccagtgcatttccttcttacgagaaaataaagaatctgccaaacaaaattcttctctggtgtgggactagaagctcgaacttgcttaggcacctgcataaaggattccttcctgctgtctgtcatcttcctgtgccagggtacatgtttggcaaagccatagtctgttcagacgcagcagctgaagctgctcgctacggcttcactgcagtggaccgcccagaagggtacctggtcctggcggtggcctctctaggagaggagatcaaagaagtgaccggaacaccaggcgcagaggaggcacgagtctttgaagagaagaagatgggcgtgaaaggcgtcgggaggaagacgaccgacgagtcggagcacatctcctggagggacggtgtgatagtcccctgcggcaagctggtgccgtcggcgaacaaggacggcccgctcgagtacaacgagtatgccgtgtacgaccccaagcaggtgagcatctgcttcctggttggggtgaagtacgaggagcagaacatggaggtggtgccggacgaggagtga

SEQ ID NO: 11024 - protein, 861 aa, Sorghum bicolor
  misc_feature: Ceres ANNOT ID no. 6119447
  misc_feature (632)..(849): Pfam Id: PARP Pfam Desc: Poly(ADP-ribose) polymerase catalytic domain
  misc_feature (141)..(194): Pfam Id: PADR1 Pfam Desc: PADR1 (NUC008) domain
  misc_feature (373)..(462): Pfam Id: WGR Pfam Desc: WGR domain
  misc_feature (227)..(306): Pfam Id: BRCT Pfam Desc: BRCA1 C Terminus (BRCT) domain
  misc_feature (29)..(860): NCBI GI: 115446483 NCBI Desc: os02g0530600 [oryza sativa (japonica cultivar-group)]
  misc_feature (29)..(860): NCBI GI: 118573102 NCBI Desc: poly [adp-ribose] polymerase 3 (parp-3) (adprt 3) (nad(+) adp-ribosyltransferase 3) (poly[adp-ribose] synthetase 3)
  misc_feature (69)..(852): NCBI GI: 5802246 NCBI Desc: seed maturation protein pm38 [glycine max]
  misc_feature (49)..(860): NCBI GI: 9758653 NCBI Desc: seed maturation protein pm38 protein [arabidopsis thaliana]
  misc_feature (75)..(860): NCBI GI: 79517236 NCBI Desc: nad+ adp-ribosyltransferase [arabidopsis thaliana]
  misc_feature (29)..(860): SWISSPROT Homolog: EC 2.4.2.30 Poly [ADP-ribose] polymerase 3
MATAGAQPRRHPETLLPFPPPHPIPHHPVHETRSRVHAVAQEEGKVASKKQKSENEDQERGQHVPSKNKKPVDNKGQDGESEAPTKSKKLKADESEPNGREAAARDFAEFCKALGEHLSLDDMRNILEANEQDASGSEDAVVLRCEDMMFYGPLEKCPVCGGQLEFKGWKYRCTGNYSEWARCTFSSNDPSRRSGPIEVPDDIKDDFIRKWLKQHEGKEFPKRDVDEEAHIFSGMMIALSGRMSRSHGYFKEQIMKHGGKVNNSVLGVTCVVASPAERDKGGSGGFAEALERGTPIVSENWIIDSIEKKEVQPLAAYDIVSDVVPEGRGLPLGQLDPSEEAIETLAAEVKLAGKRSVHKDSKLEKDGGCVFEKDGIIYNCAFAVCDLGCQMNELCIMQLIMVPENRLHLFYKKGPIGHDQMAEERVEDFGSRINDAIKEFVRLFEEVTGNEFEPWERQKKFEKKSMKMYPLDMDVGVDVRHGGAALRQLGSAAAHCKLDPSVSFLVKQLCGQEIYRYALMEMAQDLPDLPIGMLTDLHLKRGEDMLLQIRGDAESVAESGPEADAFWTEVSSKWFTLFPTTRPYTMRGFEQIADNVASGFETVRDINDASHLIGDVFSSTLDDPLSECYKKLGCSINPVTEDSEDYKMILKYLEKTYEPVKVEDVVYGVSVERIYAVESSAFPSYEKIKNLPNKILLWCGTRSSNLLRHLHKGFLPAVCHLPVPGYMFGKAIVCSDAAAEAARYGFTAVDRPEGYLVLAVASLGEEIKEVTGTPGAEEARVFEEKKMGVKGVGRKTTDESEHISWRDGVIVPCGKLVPSANKDGPLEYNEYAVYDPKQVSICFLVGVKYEEQNMEVVPDEE

SEQ ID NO: 11025 - DNA, 1233 bp, Sorghum bicolor
  misc_feature: Ceres ANNOT ID no. 6119449
  misc_feature: Encodes the peptide sequence at SEQ ID NO 11026
atgataacccaccatccctccctgctccgcccatctatcctcacccaccgtgccggcgtcctcggtcggcgcccaacactgaacgccttcctgtccacaaccgtcgcctccgctacgccgcctctccgcttgcggtctctgcgcgccaccgccggtggaacttcgccggtcagtggcgatggaggcaaacgcgcggtgccgcctcccacgcttggggccgccctgctcggcttcgtgcgtagcaacttcctcccgcttgctctcattggtgggatcatattgggtctcctagatcctactcttggatgccttgctcacaaatactccctgtcaaagtacggcacttttgggatatttgttatctcaggactgaccctacgcactagggagcttggtgcagcattagaagcttggcctgctggactatatggactaggatctattttgctgtttacaccctttcttgctcagtttattatgcaagttcagttctcccctcgtgaatttatcactgggttagctatattttgctgcatgccaacaacactatcaagtggagtcacactaacacagcttgttggcggtaactctgcacttgctcttgcaatgacagttgcatccaatttacttggtattataattgtacctctttctcttgcaaaatacattggcactggtgttggggtttccttgcctactgagcaattattcaaaagtctggtcaccagccttctaatccctcttattatagggaaggttgctcgagaaacctcaaaaggtattgctgattttgttgatggaaatcgacaaggcttttcagttgcaagtgctgttctcctcagcctagtcccatggattcaagtaagtagatcaagatcactgatcttatctgttcaagtaaaatcctttgctgttgccgttactattggagtgcttcttcatcttgctctgctggctttcaatgctgcaatgttggagatcttgtcacgtcttgaacagaaaggggagtcagtctttgcaaagaaagagtatgcacgagctgtcattttggtggctagtcagaaaacgttgccagtgttggttgctgtggttgagcagcttggaggagcgttcggggagtctggatttctggtcatcccttgtgttgctgcacacattaaccagatcattattgattctatcatagtaaattggtggcgccagaaggatcaacaatttacttctgcaaagtaa

SEQ ID NO: 11026 - protein, 410 aa, Sorghum bicolor
  misc_feature: Ceres ANNOT ID no. 6119449
  misc_feature (115)..(298): Pfam Id: SBF Pfam Desc: Sodium Bile acid symporter family
  misc_feature (78)..(393): NCBI GI: 145343497 NCBI Desc: bass family transporter: sodium ion/bile acid [ostreococcus lucimarinus cce9901]
  misc_feature (75)..(407): NCBI GI: 71480739 NCBI Desc: p7 [xenopus laevis]
  misc_feature (75)..(407): NCBI GI: 89272913 NCBI Desc: novel protein [xenopus tropicalis]
  misc_feature (75)..(407): NCBI GI: 56159731 NCBI Desc: p7 [rattus norvegicus]
  misc_feature (75)..(396): NCBI GI: 51010923 NCBI Desc: zgc:92251 [danio rerio]
MITHHPSLLRPSILTHRAGVLGRRPTLNAFLSTTVASATPPLRLRSLRATAGGTSPVSGDGGKRAVPPPTLGAALLGFVRSNFLPLALIGGIILGLLDPTLGCLAHKYSLSKYGTFGIFVISGLTLRTRELGAALEAWPAGLYGLGSILLFTPFLAQFIMQVQFSPREFITGLAIFCCMPTTLSSGVTLTQLVGGNSALALAMTVASNLLGIIIVPLSLAKYIGTGVGVSLPTEQLFKSLVTSLLIPLIIGKVARETSKGIADFVDGNRQGFSVASAVLLSLVPWIQVSRSRSLILSVQVKSFAVAVTIGVLLHLALLAFNAAMLEILSRLEQKGESVFAKKEYARAVILVASQKTLPVLVAVVEQLGGAFGESGFLVIPCVAAHINQIIIDSIIVNWWRQKDQQFTSAK

SEQ ID NO: 11027 - DNA, 888 bp, Sorghum bicolor
  misc_feature: Ceres ANNOT ID no. 6119465
  misc_feature: Encodes the peptide sequence at SEQ ID NO 11028
atggcgccgccgccgccgccgctgtgctccgcttccccgcggccgcttcgagccccaggccagcctccccgagacgacgtccgcccgccgccgcggacggtcgtcgtggccgcgggcacccgtgtgagcggagcggaggcccgcgcgtcgctggtcctggccctggcctcgcaggcgctctccgcctcgcagcgccgctttgccgacctcgccgttgagtccgccaagtacgccttcccgtcccgccgcttcgagccccgcaccctcgaggaggccctcatgtccgtgcctgatctcgagacagttcctttccgcgtcctgaagcgcgaagcagagtacgagatcagagaagtggagtcatacttcgttgctgaaacaacgatgcccggaagatctgggtttgatttcaacggatcatctcagtcattcaacgtgctggcatcttatttattcggtaagaacacagcctccgagcaaatggaaatgacaacacctgtttttactcggaagggtgagtcaaacggtgaaacgatggacatgacgaccccagtgataacaaagtcagctggtaaaaataaatggaaaatgtcatttgtgatgccagcgaagtatggttccaacttgcctcgcccaaaagatccttccgtgactatcaaggaggtgcccagcaaaatagttgctgttgcagccttttcaggtttggttactgatgatgatataaacatgagggaatctaaattgcgtgaatctctccataaagataccgagtttagagtgaaagatgattcagtggtggaagttgcacagtacaatccacctttcacacttccattcacaaggcgaaatgaaatagcactggaggttgagaggaatgatatagccttatga

SEQ ID NO: 11028 - protein, 295 aa, Sorghum bicolor
  misc_feature: Ceres ANNOT ID no. 6119465
  misc_feature (98)..(289): Pfam Id: SOUL Pfam Desc: SOUL heme-binding protein
  misc_feature (8)..(292): NCBI GI: 50253033 NCBI Desc: soul heme-binding protein-like [oryza sativa (japonica cultivar-group)]
  misc_feature (42)..(289): NCBI GI: 92867677 NCBI Desc: soul heme-binding protein; bacterial regulatory factor, effector [medicago truncatula]
  misc_feature (104)..(288): NCBI GI: 67938490 NCBI Desc: soul heme-binding protein [chlorobium phaeobacteroides bs1]
  misc_feature (103)..(289): NCBI GI: 110597279 NCBI Desc: soul heme-binding protein [chlorobium ferrooxidans dsm 13031]
  misc_feature (103)..(289): NCBI GI: 68549322 NCBI Desc: soul heme-binding protein [pelodictyon phaeoclathratiforme bu-1]
MAPPPPPLCSASPRPLRAPGQPPRDDVRPPPRTVVVAAGTRVSGAEARASLVLALASQALSASQRRFADLAVESAKYAFPSRRFEPRTLEEALMSVPDLETVPFRVLKREAEYEIREVESYFVAETTMPGRSGFDFNGSSQSFNVLASYLFGKNTASEQMEMTTPVFTRKGESNGETMDMTTPVITKSAGKNKWKMSFVMPAKYGSNLPRPKDPSVTIKEVPSKIVAVAAFSGLVTDDDINMRESKLRESLHKDTEFRVKDDSVVEVAQYNPPFTLPFTRRNEIALEVERNDIAL

SEQ ID NO: 11029 - DNA, 828 bp, Sorghum bicolor
  misc_feature: Ceres ANNOT ID no. 6119467
  misc_feature: Encodes the peptide sequence at SEQ ID NO 11030
atggcaactaccaagaaaagtgcgttgtgtgttgcactgatgtattcttgcttcctcgtgcaccatgcatgtgaccatggtggtgtgacctttggttacagtggaagtactggcccaaaatattggggaagcttaagccctaatttcacactttgctcaaaaggaatacaacaatctccgatcgagatcgtgaaggatgaagcagtctatgttccacagttggagcctcttgaaagggattatacagctacaaatgcaaccattgttgataatgtcttcaacatcgcggtgcgctacaatgacaccgctgagactgtgaaggtgggtgggataaagtataagctaaagcaattgcattggcattccccatcggagcacaccatcaacggcgaaaggtttgcgatggagcttcacatggttcacgtaactgaagacggaaatgttactgttgtggccatcctttatcgatatggcaaaccagaccctttccttttccagataaaggaacagttggctgagttgtatgcagagggctgcaaggcggagaaaggcgatcctctccctattggagtggtggacatgacagaactgagacagggcgcggatatatattacagatacgttggatccctcactgcacctccatgcactgagaatgtgatctggaacattcttggcgaggtaagagaaatgactaaggaacaggctgctgatctgatggctcctttggaagggagttacaggcacaactccagaccactgcagcaattgaatggtcgcatggttcagctctatgacaagtcactgaaaatccgaaaaatgatgtag

SEQ ID NO: 11030 - protein, 275 aa, Sorghum bicolor
  misc_feature: Ceres ANNOT ID no. 6119467
  misc_feature (31)..(265): Pfam Id: Carb_anhydrase Pfam Desc: Eukaryotic-type carbonic anhydrase
  misc_feature (1)..(267): NCBI GI: 116310342 NCBI Desc: osigba0134p10.2 [oryza sativa (indica cultivar-group)]
  misc_feature (28)..(273): NCBI GI: 7669946 NCBI Desc: carbonic anhydrase (cah1) [arabidopsis thaliana]
  misc_feature (28)..(228): NCBI GI: 30693691 NCBI Desc: carbonic anhydrase family protein [arabidopsis thaliana]
  misc_feature (9)..(267): NCBI GI: 46917479 NCBI Desc: tuber storage protein [dioscorea batatas]
  misc_feature (9)..(267): NCBI GI: 7271963 NCBI Desc: dioscorin b [dioscorea alata]
MATTKKSALCVALMYSCFLVHHACDHGGVTFGYSGSTGPKYWGSLSPNFTLCSKGIQQSPIEIVKDEAVYVPQLEPLERDYTATNATIVDNVFNIAVRYNDTAETVKVGGIKYKLKQLHWHSPSEHTINGERFAMELHMVHVTEDGNVTVVAILYRYGKPDPFLFQIKEQLAELYAEGCKAEKGDPLPIGVVDMTELRQGADIYYRYVGSLTAPPCTENVIWNILGEVREMTKEQAADLMAPLEGSYRHNSRPLQQLNGRMVQLYDKSLKIRKMM

SEQ ID NO: 11031 - DNA, 681 bp, Sorghum bicolor
  misc_feature: Ceres ANNOT ID no. 6119497
  misc_feature: Encodes the peptide sequence at SEQ ID NO 11032
atgtcgacgacgacggaggcggcggcgaagagtggcacagccgcaccggtgaggtgccagcggatcggctgtgacgccgtattcaccgacgacgacaaccccgagggctcctgccaataccacccctcccctatgtttcatgacggcatgaaagagtggagctgctgcaagcaaagaagccatgatttcagcttatttttgcagatacctggatgcacaacaggaaagcatacaaccgaaaaaccaattacaaaagctgtttcaactaataaccctataaaggcaacaccaatccaggcctctaagcagggtgtgggagttgaagcgtgtgcaaggtgtcgtcaaggtttcttttgctctgatcatggatcacagcccaagccacaaaaaccatctgctactgatgatacaaacaaggaacctgttgagaaatcctctgttccaccgcccaagaaaaggatcgatataaatgaaccgaggatatgtaaaaataaaggatgtggtaaatcctacaaggagaaggataaccatgattctgcatgtgactaccatccaggtcctgctgttttccatgacaggatgagagggtggaaatgctgtgatattcatgtcaaggaatttgatgagtttatggagatacctccatgcacaaagggttggcataatgctgacgcggtgtga

SEQ ID NO: 11032 - protein, 226 aa, Sorghum bicolor
  misc_feature: Ceres ANNOT ID no. 6119497
  misc_feature (15)..(78): Pfam Id: CHORD Pfam Desc: CHORD
  misc_feature (158)..(222): Pfam Id: CHORD Pfam Desc: CHORD
  misc_feature (1)..(226): NCBI GI: 6581046 NCBI Desc: rar1 [hordeum vulgare]
  misc_feature (1)..(226): NCBI GI: 124514111 NCBI Desc: rar1 [triticum aestivum]
  misc_feature (13)..(224): NCBI GI: 92869868 NCBI Desc: chord [medicago truncatula]
  misc_feature (12)..(223): NCBI GI: 10177869 NCBI Desc: rar1 [arabidopsis thaliana]
  misc_feature (12)..(223): NCBI GI: 21618175 NCBI Desc: rar1 [arabidopsis thaliana]
  misc_feature: Useful for making plants with modulated biotic stress sensitivity
  misc_feature: Functional homolog of the protein sequence given in SEQ ID NO 13651
MSTTTEAAAKSGTAAPVRCQRIGCDAVFTDDDNPEGSCQYHPSPMFHDGMKEWSCCKQRSHDFSLFLQIPGCTTGKHTTEKPITKAVSTNNPIKATPIQASKQGVGVEACARCRQGFFCSDHGSQPKPQKPSATDDTNKEPVEKSSVPPPKKRIDINEPRICKNKGCGKSYKEKDNHDSACDYHPGPAVFHDRMRGWKCCDIHVKEFDEFMEIPPCTKGWHNADAV

SEQ ID NO: 11033 - DNA, 321 bp, Sorghum bicolor
  misc_feature: Ceres ANNOT ID no. 6119502
  misc_feature: Encodes the peptide sequence at SEQ ID NO 11034
atggtgtcaagacctgtagtacttgtcttcctgttggtggtactcatagtcacgtcccagtttgaatggaagcaacagcttgtaaatgagttggaatctaaagcttgcaaccagaaacatgtttcaagtagagaagagcttgtcaaggatcagataatcttcgctcaagaaaagatgattcagaaattgaataattttatccagaatcttcagcaacagttgctgcaatgtcgtggcaacaataggacagtcaatccttctggaacttctttgacatcttatattagtgagatccagaggccgcggatgatagatgactga

SEQ ID NO: 11034 - protein, 106 aa, Sorghum bicolor
  misc_feature: Ceres ANNOT ID no. 6119502
MVSRPVVLVFLLVVLIVTSQFEWKQQLVNELESKACNQKHVSSREELVKDQIIFAQEKMIQKLNNFIQNLQQQLLQCRGNNRTVNPSGTSLTSYISEIQRPRMIDD

SEQ ID NO: 11035 - DNA, 1935 bp, Sorghum bicolor
  misc_feature: Ceres ANNOT ID no. 6119507
  misc_feature: Encodes the peptide sequence at SEQ ID NO 11036
  misc_feature: Up-regulated in root tissues in response to methyl jasmonate treatment
atgtcattgcatattgggcggctttcccaagatgttcggcaaagttatcttgaacatctgttccagaggtttggtcgttgcactgtgaacctgaaagatggatatgggtttgctgtgtatgattctgatgatgatgcaactcgagccatgagggccctgcatgggaaatatgtttgtggggagcgcattactgttaattggtcaaagcagcagcccagattttctcagagtttcaggagaagttcgagatttgttgaattgtctcgcggaaggaacttcagagatgctagggacaacattaggttcagggatcctctagctcggaataatcaaccagcgaatcatgatcagagtcatgattctgatgctgtgctcaaaaaggaatctggtaaatttgctgagattgtcaatgatgctgaagaaaacattggtgatgatccaggggaggtgaagagggacgaaggtggtacaaatgatgaaggtccaggggaggtgaaaactgacgatggtggtacagctgatgcagatataatcgagcatgatagatgggctgggaaaggtacccctggtggagatggtgatgattttgaccgctatgagccttatcatggatatgaaaggcaagaagaaacggaaaatgtgattaaagcaagttcttatgattctcgtgaacacaaacatttttcagagaagtggcaagagcactctgacaagcatgttgacataagccatgataaatcaagatctcctccaacctgttacagttgtggtgttgctggccatattgcacgtaattgccctcgtggaatagatgataacttcataccaaggagagatggactgaactttaaggaaaaatggcagctgaggcagagaagatttgggtcaccctcgaggaggcgaccagaatttcctattcatccattggaccaaacaaatcataaagttcaagatggtaggaagccatttgctgagaggaatatgcaaatgcattggcccagagacagcaggagacatgcccactacagtgaaaacatgccacaaacaaacaaggaagggcgcaagagaagcagatctgaaaggtcacgggggtcatcgccctcttcagaaccttcaaggcgctctaaccatgctaatcttaagagatctcattccaacaggacttcctcagattcaagatctaaatccccccgatcccgacctcgatttaaagcacattcgccaacttattctgcacattctagttcaaaatcatctcaaccagctcagcatgaaggatcaaggtcaaatatcaaccatcctgttccattttcagtatctgcttcaccacagcacaagtcatctcctgatatagagaacaaaaatctagttggtctgatgaattctcaattggaggacaacttggagttcaggacaagatctgaagtaaaaaatctggatgataacaagcaagaaggaaatggtccggttttgaaaagcaaggtcctgaatggaggaacacttgttcgtaacaagaatgcaaatgttactggttacacagggtctgacttcgataagaactttgttgatgataatgctgccaatagagtgcaaagccagaatgctaaatttgaggactctttgtcagtgaaaccaaagcaggatgttctggccaaaaatgggagaagcaagtctttgaagctaacaactaacgaagtgatctcagctctgaagcactatggggttgaggcacaagagggagattcatcagatcaatctgtggagaagtactttggtgctgcacgcctgtggccttgggaaatcatttactatcgcaggcgtaagaaaggtccaatatctactgagaattatgctaagcgacttgagcagaacaaagaatttggtattgtggatcagtatgtcagaagcagcagtggttggtgggagtgtcattaa

SEQ ID NO: 11036 - protein, 644 aa, Sorghum bicolor
  misc_feature: Ceres ANNOT ID no. 6119507
  misc_feature (3)..(65): Pfam Id: RRM_1 Pfam Desc: RNA recognition motif. (a.k.a. RRM, RBD, or RNP domain)
  misc_feature (251)..(268): Pfam Id: zf-CCHC Pfam Desc: Zinc knuckle
  misc_feature (336)..(560): NCBI GI: 60655747 NCBI Desc: splicing factor arginine/serine-rich 4 [synthetic construct]
  misc_feature (336)..(560): NCBI GI: 30583669 NCBI Desc: splicing factor, arginine/serine-rich 4 [homo sapiens]
  misc_feature (336)..(560): NCBI GI: 60652653 NCBI Desc: splicing factor arginine/serine-rich 4 [synthetic construct]
  misc_feature (336)..(483): NCBI GI: 119628063 NCBI Desc: splicing factor, arginine/serine-rich 4, isoform cra_b [homo sapiens]
  misc_feature (3)..(83): NCBI GI: 119596370 NCBI Desc: splicing factor, arginine/serine-rich 6, isoform cra_a [homo sapiens]
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: Functional homolog of the protein sequence given in SEQ ID NO 12876
  misc_feature: Functional homolog of the protein sequence given in SEQ ID NO 13244
  misc_feature: Functional homolog of the protein sequence given in SEQ ID NO 13245
  misc_feature: Up-regulated in root tissues in response to methyl jasmonate treatment
  misc_feature: The sequence is a functional homolog of SEQ ID NO. 339 in the 11/188,298 US application
MSLHIGRLSQDVRQSYLEHLFQRFGRCTVNLKDGYGFAVYDSDDDATRAMRALHGKYVCGERITVNWSKQQPRFSQSFRRSSRFVELSRGRNFRDARDNIRFRDPLARNNQPANHDQSHDSDAVLKKESGKFAEIVNDAEENIGDDPGEVKRDEGGTNDEGPGEVKTDDGGTADADIIEHDRWAGKGTPGGDGDDFDRYEPYHGYERQEETENVIKASSYDSREHKHFSEKWQEHSDKHVDISHDKSRSPPTCYSCGVAGHIARNCPRGIDDNFIPRRDGLNFKEKWQLRQRRFGSPSRRRPEFPIHPLDQTNHKVQDGRKPFAERNMQMHWPRDSRRHAHYSENMPQTNKEGRKRSRSERSRGSSPSSEPSRRSNHANLKRSHSNRTSSDSRSKSPRSRPRFKAHSPTYSAHSSSKSSQPAQHEGSRSNINHPVPFSVSASPQHKSSPDIENKNLVGLMNSQLEDNLEFRTRSEVKNLDDNKQEGNGPVLKSKVLNGGTLVRNKNANVTGYTGSDFDKNFVDDNAANRVQSQNAKFEDSLSVKPKQDVLAKNGRSKSLKLTTNEVISALKHYGVEAQEGDSSDQSVEKYFGAARLWPWEIIYYRRRKKGPISTENYAKRLEQNKEFGIVDQYVRSSSGWWECH

SEQ ID NO: 11037 - DNA, 972 bp, Sorghum bicolor
  misc_feature: Ceres ANNOT ID no. 6119542
  misc_feature: Encodes the peptide sequence at SEQ ID NO 11038
atgtctcggtcaccacacctcccaccgcgctgcccgccgctgggtcctcagatcactcgaagggacgacagcatgttcacgcagagctgcaggtttccatccggggatccgttctttggtgagcccccgtgctggctcgatgatctccttgcagattctgggaaagctcccaagcttcctcccctcaggagggcctgcagcgattctgatgccatcttggatgcgctgtcgacattccagagcccaatttatccaatcgaggaaggtgatctgaactcaggtggtgaaggtgaggacttgttggatgctggcgaaggtggtgaaagtggttctgtggtcgaggcttgctgtgtttatggtccgaattcgccaagacagaagagtaggctgacatcttcggagagttccatggtcaatgctgtgcttgagaatgtccccagcaaccccttgcagtacctgaccattgatgcctccagtggtgtgaatggtaatgtggccagtggaactgctgatgctagtgatgcttttggttttggccatcctgatcaagacaagtcatttaaaaggcgttcagggcaaagatctagggtccggaaacttcaatacattgctgaacttgaaagaactgttgactcacttcagaacatgggagctgatttggctgtcagagtgtcatcacttttccagcttcatagtgctctatcaatggaaaacaagcaactgaggatgcagatttccagtcttcagcatgcaaaactgattaaggatggtcagacgcaggccctaaagaatgaagctgaaagattgaagcagatgtccgcccgtcaccgccggagcagaagcgtcacttcctgttatgacccaacctctttcggagcagatgcgtctgcagtcaattggcagatgcctgacatgggaaggctcagcctgaatggcagctcagtctccccaagaggcggctatggtctgtga

SEQ ID NO: 11038 - protein, 323 aa, Sorghum bicolor
  misc_feature: Ceres ANNOT ID no. 6119542
  misc_feature (1)..(323): NCBI GI: 50251990 NCBI Desc: bzip protein-like [oryza sativa (japonica cultivar-group)]
  misc_feature (7)..(272): NCBI GI: 30689007 NCBI Desc: bzip transcription factor family protein [arabidopsis thaliana]
  misc_feature (43)..(272): NCBI GI: 18491297 NCBI Desc: at2g42380/mhk10.10 [arabidopsis thaliana]
  misc_feature (189)..(272): NCBI GI: 145652335 NCBI Desc: transcription factor bzip48 [glycine max]
  misc_feature (190)..(272): NCBI GI: 145652365 NCBI Desc: transcription factor bzip112 [glycine max]
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 148 in the 10/412,699US patent application
  misc_feature: The sequence is a functional homolog of SEQ ID NO 1483 in the 10/412,699US patent application
  misc_feature: The sequence is a functional homolog of SEQ ID NO 2266 in the 10/374,780US patent application
  misc_feature: The sequence is a functional homolog of SEQ ID NO 341 in the 11/479,226US patent application
  misc_feature: The sequence is a functional homolog of SEQ ID NO 58 in the 11/375,241US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13298
  misc_feature: The sequence is a functional homolog of SEQ ID NO 148 in the 20040045049 US patent application
  misc_feature: The sequence is a functional homolog of SEQ ID NO 1483 in the 20040045049 US patent application
  misc_feature: The sequence is a functional homolog of SEQ ID NO. 337 in the 11/188,298 US application
MSRSPHLPPRCPPLGPQITRRDDSMFTQSCRFPSGDPFFGEPPCWLDDLLADSGKAPKLPPLRRACSDSDAILDALSTFQSPIYPIEEGDLNSGGEGEDLLDAGEGGESGSVVEACCVYGPNSPRQKSRLTSSESSMVNAVLENVPSNPLQYLTIDASSGVNGNVASGTADASDAFGFGHPDQDKSFKRRSGQRSRVRKLQYIAELERTVDSLQNMGADLAVRVSSLFQLHSALSMENKQLRMQISSLQHAKLIKDGQTQALKNEAERLKQMSARHRRSRSVTSCYDPTSFGADASAVNWQMPDMGRLSLNGSSVSPRGGYGL

SEQ ID NO: 11039 - DNA, 3078 bp, Sorghum bicolor
  misc_feature: Ceres ANNOT ID no. 6119543
  misc_feature: Encodes the peptide sequence at SEQ ID NO 11040
atgccggcggcggcatcggtggcggacccccgcctcgtgcgcaatacttgcatcctagcgcacgtggaccacggcaagacctccctcgcggaccatctagtggcctccggcggcagcggcctcctcagcccgaagctggcgggaagcgcccggttcatggaccacctcccggaggagcagcggcgcgccatcaccatgaagtcctcctccgtcgcgctccggcacgcgcaccccacgggcgtccaccgcgtgaacctgatcgactccccgggccacgccgacttctgctccgaggtctccgccgccgcgcgcctctcggactcggcgctcatcgtcgtcgacgcggccaagggcgtccgcgtccagacccacgccgcgcttcgccaggcgttcgtcgagcgcctgcgcccctgcctcgtcctcaacaagatggaccgcctcatcaccgacctcttcctctcgcccgaggacgcttacgcgcgcctccgcggcatcgtcgccgaggtcaactccatctactccacgctgcgctccggctactacttctcctcgctccaggacgacaaagacggccgccgcgcgggcggcggcgaggaggacgatgacgagggcgacgccttccatccccagaagggcaacgtcgtcttcgcctgcgcccgcgacggctggggcttccgcatccaccgctttgccgacctgtacgcccagaagacgggcgctagcaggtccaagctgctcatgggcttctggggtccgtactacatagacaagaagaagaaggcggttctgcctctccctcagagtaacgaggccacgagcagtggcgaggaccagcagcccatgttcgtggagaacgtgctcaggcctctgtggaaggtgtaccagagaggcctgagatcgaatagcgccaggtggatggacgacaacgtggtctccttcttcaatctggtggtgtcgccgcgggagctgtacagcgaggaccccaagacgtcgctgcatgccgtgatgcgggcgtggctgccgctcgcggagtcagtcatggatatgctcgtcgaatgcacgcccgaccccgtcgccgcccaggcgttcagagtggcaaggcttatgcccgagaggaggactgctgccgccaaccacacctgcagcattgtcgcggaggcagagatggtgaggagctctgtggcggcctgcagcgccagcgccagcgcaagcgcgcccattgtggtgttcgtgtccaagatgttcgcggtgccgtacacgatgctgccgtgcagggggctcaacaggaaggagttgctgatccatagcgagccggagtcagagggggagtgcttcttggccttcgcgagggtcttcagcggcgtactccgtgcagggcagaaggtgttcgtcctgtcaacgctgtatgatccggtaaaaggggacgacgcggcgagcaagcatgtgcaggaggtggagctgcactgcctgtacgagatgctcgggcaggacctgaggccagtgcccagcgttgctgcaggccacgtcgtggcaatccagggccttggccaacacgtgctgaagagtgcaacactgtcgtcgaccaagaattgctggccattctcgagcatgacgttccaggtgtctccgatgctcaaggtcgctgttgagccttccaaccctgctgatctgggagcccttgtaaaaggactgaagcttcttaaccaggcagacccgttggttgtgtacactgtctcacagaggggcgagcatgtccttgctgcagctggccaggtacatttggatcgctgcatcaaggatttgcaggagaggttcgccaaggtccagctgggggtctcaaagccgttagtgtcattcaaggagaccatccaaggagaaggtgttggcttattgggaagcatgaaggcccaacaggggtttgttgagagaaccactccgaatgggagattcagtgtgaaagttcaagtcattaggcttcccaatgcactgactaaggtccttgccgaaagtgaagaattacttggtcaaatcatcgacgggaaaacttcacagcttgatcaggatggtggtaattctatttctacaacaatgcttaggcagcgcttgatctgtgccattgacagtgaattggaagcgatctctgaacaagtggaaaaagagaagcttgagaggtgtaggaagacattgcttggataccttcagagaatctgtgccctaggtccttcacatgttggaccaaatttccttctcttgcctgactttgaatcaaaatgtggtgtcacagcaagcccaaatggaaaggaagatattcttgtgagtagcaagtgtcatgtatcagagatattggggtttgcgcgtgcacctgatgcagagacaaaaaatgccactgaaagtgaaacagagacatcgacgtattctctcgattctgaagcgctaaggaacagcatcgtctcaggttttcagtttgccacaaatgcaggtcccatatgcgatgaacctatgaggggtgtggcattcattgttgaggcacaccttctgtctaacaactctgatgttgcaattccctctgatgataacatcttcactgggcaagtaattactgcagtgaaggaagcatgccgagaagctgttcttcagagcaagccaaggcttgtggaaccaatgtacttttgtgaattgaccacaccgacagagcagttgggtgctgcgtttgctgttctgggtgattgtcgggccaaggttctgaaagaggagatgcaagaaggaacatctttgttcacagtgcaagctcacttgccagttgccgaaagctctgacttccctgagaaacttagaaagcgaacgtcaggtgcagctagtgcgattctagcatttagccactgggaggttatccctcaggaccccttctttaccccgaaaactccggaggagattgaaagattcggtgatggctcaagcattggaccaaacttggccaagaagctcatgaattctgtaaggcgaagaaagggccttcatgttgaagagaaagttgtggagcatggcacgaaacagcgaactcttgggaagaaagtgtga

SEQ ID NO: 11040 - protein, 1025 aa, Sorghum bicolor
  misc_feature: Ceres ANNOT ID no. 6119543
  misc_feature (11)..(356): Pfam Id: GTP_EFTU Pfam Desc: Elongation factor Tu GTP binding domain
  misc_feature (883)..(972): Pfam Id: EFG_C Pfam Desc: Elongation factor G C-terminus
  misc_feature (8)..(1025): NCBI GI: 15228918 NCBI Desc: elongation factor tu family protein [arabidopsis thaliana]
  misc_feature (9)..(1025): NCBI GI: 92877074 NCBI Desc: elongation factor tu, domain 2; translation elongation factor g [medicago truncatula]
  misc_feature (266)..(1025): NCBI GI: 9294187 NCBI Desc: elongation factor ef-2 [arabidopsis thaliana]
  misc_feature (13)..(423): NCBI GI: 94966754 NCBI Desc: elongation factor tu gtp binding domain containing 1 isoform 1 [homo sapiens]
  misc_feature (13)..(423): NCBI GI: 28374136 NCBI Desc: elongation factor tu gtp binding domain containing 1 [mus musculus]
MPAAASVADPRLVRNTCILAHVDHGKTSLADHLVASGGSGLLSPKLAGSARFMDHLPEEQRRAITMKSSSVALRHAHPTGVHRVNLIDSPGHADFCSEVSAAARLSDSALIVVDAAKGVRVQTHAALRQAFVERLRPCLVLNKMDRLITDLFLSPEDAYARLRGIVAEVNSIYSTLRSGYYFSSLQDDKDGRRAGGGEEDDDEGDAFHPQKGNVVFACARDGWGFRIHRFADLYAQKTGASRSKLLMGFWGPYYIDKKKKAVLPLPQSNEATSSGEDQQPMFVENVLRPLWKVYQRGLRSNSARWMDDNVVSFFNLVVSPRELYSEDPKTSLHAVMRAWLPLAESVMDMLVECTPDPVAAQAFRVARLMPERRTAAANHTCSIVAEAEMVRSSVAACSASASASAPIVVFVSKMFAVPYTMLPCRGLNRKELLIHSEPESEGECFLAFARVFSGVLRAGQKVFVLSTLYDPVKGDDAASKHVQEVELHCLYEMLGQDLRPVPSVAAGHVVAIQGLGQHVLKSATLSSTKNCWPFSSMTFQVSPMLKVAVEPSNPADLGALVKGLKLLNQADPLVVYTVSQRGEHVLAAAGQVHLDRCIKDLQERFAKVQLGVSKPLVSFKETIQGEGVGLLGSMKAQQGFVERTTPNGRFSVKVQVIRLPNALTKVLAESEELLGQIIDGKTSQLDQDGGNSISTTMLRQRLICAIDSELEAISEQVEKEKLERCRKTLLGYLQRICALGPSHVGPNFLLLPDFESKCGVTASPNGKEDILVSSKCHVSEILGFARAPDAETKNATESETETSTYSLDSEALRNSIVSGFQFATNAGPICDEPMRGVAFIVEAHLLSNNSDVAIPSDDNIFTGQVITAVKEACREAVLQSKPRLVEPMYFCELTTPTEQLGAAFAVLGDCRAKVLKEEMQEGTSLFTVQAHLPVAESSDFPEKLRKRTSGAASAILAFSHWEVIPQDPFFTPKTPEEIERFGDGSSIGPNLAKKLMNSVRRRKGLHVEEKVVEHGTKQRTLGKKV

SEQ ID NO: 11041 - DNA, 2379 bp, Sorghum bicolor
  misc_feature: Ceres ANNOT ID no. 6119544
  misc_feature: Encodes the peptide sequence at SEQ ID NO 11042
atggaggcgagggcgtcgccgcgtccgtcgatctccatcggcggcggcttcggagcggggcggggcgacgacagcgccttctcgttcctctccaaggggtggcgcgaggtgcgggactccgccaccgccgacctgcgcctcatgcgcgcgcgggccgattccctccgcacgctcgcggaccgcgagctcgagaacctcctcgcgtccgcctccaccgcgctggcctccgcgccgccgccgccgctcgccgcgggggcgcccatagccgagctcgagttcgtgcgcacgcggatccagcccaagatctccgagctgcgccgccggtacgcgtcgcgggagcgggagctcggccgcagggtgctcgaggggtgggcgccgcgcggggccgggggacccgcgcgcgcgcgcgtcgacctctccgggatcaccgccatccgcaacgccatcgtctctgaggtggatggcggggagcgctggaggcgcgccgtgtggagcggggaggccgaggcggaagaggggaaggagtgggaggtggtcaggatgatacgcgatggcatcaaggagttcgagcgccggagccagaccagcgagatttttgaggggttgcgtagtaccggcgagctcgttgagaaattcaagtccagcctgaaatcattcaacatggagtctcaaggatccaaggaaatccctccactggatctacctgaaatactggcaaatctagtaaggcagtctgaaccatttttggatcaacttggtatacggagagatcagtgtgacaaactagtggaggcattgtgtagaaaacaaaatcattccctttcagaagacacatccttgcatgtaaatgataagtcatcagacgaacttgacttgagaatcgcaagcgtgcttcaaagtactggttatcatgctgatgatggtttctggagtgatcctggaaagtatgaggtatcagacaataaaagacatgtggcagtagtcaccacagcaagtttaccttggatgacaggaacagcagttaatccattgttccgtgcagcatatcttgcaaaaggtactagacaagatgtgacactggtagtgccttggctctgcaaatcagaccaagaactggtatacccaaatagcatgaccttcaattcaccagaggagcaggaagcttatataaggagctggctggaggaaagactaggatttgaatcaaacttcaagatatccttttatcctggcaagttctcaaaagagcggcgtagcatcattcctgctggtgatacatctcagttcataccgtcaagagaagctgatatagcaatattggaagaaccagaacatctcaactggtatcatcatgggaaacgctggactgacaagttcaaccatgttgttggtgtagttcatacaaactacctggaatatatcaagagagagaagaatggagcccttcaggcttttctagttaaacacatcaacaattgggtgaccagagcatactgtgacaaggtcttacgtctctctgcagcaactcaagatttaccaaagtctatagtttgcaatgttcatggtgttaacccaaagttcttgaagattggagaggaaataactgccaatagggagactggagaggcgccattttccaagggagcatattttcttgggaagatggtttgggccaaaggttatagggaactcatagatttgatggctaaacataaaagcgatttggaaggattcaagttagacgtatatggaagtggtgaggactcgcaagaagttcaatctactgccagaaagttggatttgagtctcaattttttcaagggaagggatcatgctgataattcactccatgggtacaaggttttcataaatccgagcattagtgatgtcctgtgcacagcaacagcagaggctcttgcaatggggaaattcgtcatctgcgcagaacatccatcaaacgagtttttcatgacatttccgaactgcttgacatacaagacttcagaggagttcgttgcgagagtgaaagaggcgatggatagagaaccccagccgctaacccctgagcaaagatacaacctttcgtgggaggcagcgaccgagagattcatggagtactcagaccttgacaaggttctgaacaatgaggctgctcagcctggacaaggtaggaatagaaagaatacaagaacctcacagcctaatttgtctgacatcatggatggtggtctggcgtttgcccatcgatgcttaactggcaatgaggtcctcaggctggcaaccggagccattcctggtacccgggactacgataagcagcactgtatagatatgggtctcttgcctcctcaagtacagcaccctgtatatggctggtga

SEQ ID NO: 11042 - protein, 792 aa, Sorghum bicolor
  misc_feature: Ceres ANNOT ID no. 6119544
  misc_feature (533)..(696): Pfam Id: Glycos_transf_1 Pfam Desc: Glycosyl transferases group 1
  misc_feature (26)..(792): NCBI GI: 116310807 NCBI Desc: osigba0092m08.9 [oryza sativa (indica cultivar-group)]
  misc_feature (25)..(792): NCBI GI: 49617333 NCBI Desc: digalactosyldiacylglycerol synthase 1 [lotus corniculatus var. japonicus]
  misc_feature (25)..(792): NCBI GI: 76800640 NCBI Desc: digalactosyldiacylglycerol synthase 1 [vigna unguiculata]
  misc_feature (25)..(792): NCBI GI: 49617329 NCBI Desc: digalactosyldiacylglycerol synthase 1 [glycine max]
  misc_feature (25)..(792): NCBI GI: 6041825 NCBI Desc: digalactosyldiacylglycerol synthase [arabidopsis thaliana]
  misc_feature (25)..(792): SWISSPROT Homolog: EC 2.4.1.241 Digalactosyldiacylglycerol synthase 1, chloroplast precursor
MEARASPRPSISIGGGFGAGRGDDSAFSFLSKGWREVRDSATADLRLMRARADSLRTLADRELENLLASASTALASAPPPPLAAGAPIAELEFVRTRIQPKISELRRRYASRERELGRRVLEGWAPRGAGGPARARVDLSGITAIRNAIVSEVDGGERWRRAVWSGEAEAEEGKEWEVVRMIRDGIKEFERRSQTSEIFEGLRSTGELVEKFKSSLKSFNMESQGSKEIPPLDLPEILANLVRQSEPFLDQLGIRRDQCDKLVEALCRKQNHSLSEDTSLHVNDKSSDELDLRIASVLQSTGYHADDGFWSDPGKYEVSDNKRHVAVVTTASLPWMTGTAVNPLFRAAYLAKGTRQDVTLVVPWLCKSDQELVYPNSMTFNSPEEQEAYIRSWLEERLGFESNFKISFYPGKFSKERRSIIPAGDTSQFIPSREADIAILEEPEHLNWYHHGKRWTDKFNHVVGVVHTNYLEYIKREKNGALQAFLVKHINNWVTRAYCDKVLRLSAATQDLPKSIVCNVHGVNPKFLKIGEEITANRETGEAPFSKGAYFLGKMVWAKGYRELIDLMAKHKSDLEGFKLDVYGSGEDSQEVQSTARKLDLSLNFFKGRDHADNSLHGYKVFINPSISDVLCTATAEALAMGKFVICAEHPSNEFFMTFPNCLTYKTSEEFVARVKEAMDREPQPLTPEQRYNLSWEAATERFMEYSDLDKVLNNEAAQPGQGRNRKNTRTSQPNLSDIMDGGLAFAHRCLTGNEVLRLATGAIPGTRDYDKQHCIDMGLLPPQVQHPVYGW

SEQ ID NO: 11043 - DNA, 1251 bp, Sorghum bicolor
  misc_feature: Ceres ANNOT ID no. 6119548
  misc_feature: Encodes the peptide sequence at SEQ ID NO 11044
atggaggtctcgtcgtcttcggcggcggcggaggtcccccattacttcctctgcccgatctcgctggaggtgatgcgcgacccggtcacgctcgccaccggcatcacctacgaccgcgccagcatcgagcgctggctcttcgccgacggccacgccacctgccccgtcacgcgccgcgcgctggcgcccgccgagatggacgccacgcccaaccacacgctgcgccgcctcatccaggcctggtgcgccgcgcaccaggtcgagcgcttccccacgccgcgcccgccgctcgactcgtgccgcgtcgccgcgctcctcgacgaaggacgccacggcggggaccgccaggcggccgccgcgctcagggagatcaaggccgtcgtcgccgagagcgagcgcaacaggcgctgcgtcgaggccacgccaggcgccgtcgacttcctcgcctcacttccagcaagacgccgccgacgacttcgtgctggattctccgacctccacgagctcgccggcggagacgcgctcggcgtcctctactcgctcaagccgtctgagcggagccttgcccagatcttggaacgggacggcgacttcctcgacacgctggcgtgcgtcctgcgccgcccgagctaccggtcgcgcgcctacggcatccttctcctcaaggcgatgacggcggtcatgacgccggcgcggctcacgacggtgagcgccgacctggtgcaggaggtggtgcgcgtggtctcggatcgggtgtcctccaaggctgtccgggcggcgctgcacgtgctgtgccgcctctgcccgtggggtcggaaccgcgtcaaggccgtcgaggccggcgccatggccgcgctggtcgagctgctcctcgacgcgggcggccgccgcgtcacggagctagccgtcgtggccatcgaccacctctgcggctgcgcggagggccggtcggagctggtcgcgcacccggcggggctggccgtcgtgtccaagaaggtcatgcgggtgtccacagccgccaccgagagcgccgtgcgcgcgctccacgccgtggccaggcactcgccgacgccctcagtgctgcaggagatgctcgccgtcggcgtggtggcaaaacttctgctggtgttgcaggtcaatgccggcgagagggctggtctcagggcaaaggagatactaaagacacacgctagggtttggaaggactcgccatgcctccaaacatacatgcgggattcttacccttgctga

SEQ ID NO: 11044 - protein, 416 aa, Sorghum bicolor
  misc_feature: Ceres ANNOT ID no. 6119548
  misc_feature (11)..(88): Pfam Id: U-box Pfam Desc: U-box domain
  misc_feature (174)..(415): NCBI GI: 39545718 NCBI Desc: osjnba0033g16.8 [oryza sativa (japonica cultivar-group)]
  misc_feature (11)..(415): NCBI GI: 90399175 NCBI Desc: h0723c07.7 [oryza sativa (indica cultivar-group)]
  misc_feature (11)..(415): NCBI GI: 76884939 NCBI Desc: u-box protein [capsicum annuum]
  misc_feature (11)..(415): NCBI GI: 87240319 NCBI Desc: u box [medicago truncatula]
  misc_feature (252)..(406): NCBI GI: 18399375 NCBI Desc: u-box domain-containing protein [arabidopsis thaliana]
  misc_feature: The sequence is a functional homolog of SEQ ID NO. 308 in the 11/188,298 US application
  misc_feature: The sequence is a functional homolog of SEQ ID NO. 309 in the 11/188,298 US application
  misc_feature: The sequence is a functional homolog of SEQ ID NO. 528 in the 11/188,298 US application
MEVSSSSAAAEVPHYFLCPISLEVMRDPVTLATGITYDRASIERWLFADGHATCPVTRRALAPAEMDATPNHTLRRLIQAWCAAHQVERFPTPRPPLDSCRVAALLDEGRHGGDRQAAAALREIKAVVAESERNRRCVEATPGAVDFLASLPARRRRRLRAGFSDLHELAGGDALGVLYSLKPSERSLAQILERDGDFLDTLACVLRRPSYRSRAYGILLLKAMTAVMTPARLTTVSADLVQEVVRVVSDRVSSKAVRAALHVLCRLCPWGRNRVKAVEAGAMAALVELLLDAGGRRVTELAVVAIDHLCGCAEGRSELVAHPAGLAVVSKKVMRVSTAATESAVRALHAVARHSPTPSVLQEMLAVGVVAKLLLVLQVNAGERAGLRAKEILKTHARVWKDSPCLQTYMRDSYPC

SEQ ID NO: 11045 - DNA, 1275 bp, Sorghum bicolor
  misc_feature: Ceres ANNOT ID no. 6119555
  misc_feature: Encodes the peptide sequence at SEQ ID NO 11046
atggaggtctcgtcgtcctcggcggcggcggaggtcccccactattttctctgcccgatctcgctggaggtgatgcgtgacccggtcacgctcgccaccggcatcacctacgaccgcgccagcatcgagcgctggctcttcgccgacggccacgccacctgccccgtcacgcgccgcgcgctggcgcccgccgagatggacgccacgcccaaccacacgctgcgccgcctcatccaggcctggtgcgccgcgcaccaggtcgagcgcttccccacgccgcgcccgccgctcgactcgtgccgcgtcgccgcgctcctcgacgaaggacgacacggcggggaccgccaggcggcagccgcgctcagggagatcaaggccgtcgtcgcagagagcgagcgcaacaggcgctgcgtcgaggccacgccaggcgccgtcgacttcctcgcctcacttgtcgcgaagcactcatccaagcgcgccagcagccagcaagacgccgcagacgacttcgtgctggattctccgacctccacgagctcgccggcggaggacgcgctcggcgtcctctactcgctgaagccgtctgagcggagccttgcccagatcttggaacgggacgccgacttcctcgacacgctggcgtgcgtcctgcgccgcccgagctaccggtcgcgcgcctacggcatccttctcctcaaggcgataacggcggtcatgacgccggcgcggctcatgacggtgagcgccgacctggtgcaggaggtggtgcgcgtggtctcggatcgggtgtcctccaaggctgtacgggcggcgctgcacgtgctgtgccgcctctgcccctggggccggaaccgcgtcaaggccgtcgaggccggcgccgtggccacgctggtcgagctgctcctcgacgagggtggccgccgcgtcaccgagctagccgtcgtggccatcgaccacctctgcggctgcgcggagggccggtcggagctggtcgcgcacccggcggggctggccgtcgtgtccaagaaggtcatgcgggtgtccgtagtcgccaccgagagcgccgtgcgcgcgctccacgccgtggccaggcattcgccgacgccctccgtgctgcaggatatgctcgccgtcggtgtggtggcaaaactgctgctagtgctgcaggtcaatgccggcgatagggccggtatcagggcaaaggacatgctaaagacacacgctagggtttggaaggactcgccatgcctccaaagggattcttacccttgctga

SEQ ID NO: 11046 - protein, 424 aa, Sorghum bicolor
  misc_feature: Ceres ANNOT ID no. 6119555
  misc_feature (11)..(88): Pfam Id: U-box Pfam Desc: U-box domain
  misc_feature (11)..(423): NCBI GI: 76884939 NCBI Desc: u-box protein [capsicum annuum]
  misc_feature (148)..(423): NCBI GI: 87240319 NCBI Desc: u box [medicago truncatula]
  misc_feature (2)..(305): NCBI GI: 39545718 NCBI Desc: osjnba0033g16.8 [oryza sativa (japonica cultivar-group)]
  misc_feature (53)..(418): NCBI GI: 90399175 NCBI Desc: h0723c07.7 [oryza sativa (indica cultivar-group)]
  misc_feature (263)..(417): NCBI GI: 18399375 NCBI Desc: u-box domain-containing protein [arabidopsis thaliana]
  misc_feature: The sequence is a functional homolog of SEQ ID NO. 308 in the 11/188,298 US application
  misc_feature: The sequence is a functional homolog of SEQ ID NO. 309 in the 11/188,298 US application
  misc_feature: The sequence is a functional homolog of SEQ ID NO. 528 in the 11/188,298 US application
MEVSSSSAAAEVPHYFLCPISLEVMRDPVTLATGITYDRASIERWLFADGHATCPVTRRALAPAEMDATPNHTLRRLIQAWCAAHQVERFPTPRPPLDSCRVAALLDEGRHGGDRQAAAALREIKAVVAESERNRRCVEATPGAVDFLASLVAKHSSKRASSQQDAADDFVLDSPTSTSSPAEDALGVLYSLKPSERSLAQILERDADFLDTLACVLRRPSYRSRAYGILLLKAITAVMTPARLMTVSADLVQEVVRVVSDRVSSKAVRAALHVLCRLCPWGRNRVKAVEAGAVATLVELLLDEGGRRVTELAVVAIDHLCGCAEGRSELVAHPAGLAVVSKKVMRVSVVATESAVRALHAVARHSPTPSVLQDMLAVGVVAKLLLVLQVNAGDRAGIRAKDMLKTHARVWKDSPCLQRDSYPC

SEQ ID NO: 11047 - DNA, 2001 bp, Sorghum bicolor
  misc_feature: Ceres ANNOT ID no. 6119559
  misc_feature: Encodes the peptide sequence at SEQ ID NO 11048
atgtacaatagcgatggacaggatgacatattcttggagacatctgatgatataagaagttcaacatatttctcagctaggtgcagcacaagtgaccaattatcagcatcatggggacctgatcaggatgagctctggacaagtgaattgatgagtgtcaatgaaaggcggcacagattcatgattgggatgggctttgttaaacccattcctactggaatcaccttttcgcagtggcagggagaaattttggctgaccgtgcatttcgtgacctggaggaaagaattaatagcatctgttcttcatatcggccgtctttttctcattgtgcatcagcaccagatagtactaggaatagtgttgtgcttcatgaaagcgagcaccatgaactgactggaatacttgatgaggttggtacaaacagaatcatgaatatagaccagtcagaaggttttcttagcttctctcagcttgttcatgagttcttgcagaagggcagtggtcgtggtcctgcaaggggaatgaatgtagcatttagtgagaagcaaaaggataccaagagtttttgtggaaagttcacaagaaagaatggagaagatataatttgtttgcatgacacacgaatgaaaagcctgaagacaggcacattgtttacaacaaaagtttatcagcagaacaaaaagtggatggacttctctgctctctacatgtgccaagaaatccatgcccacggaggttcaatcagggtcatgaagttcagtacatgtggatggtatttagcgagtgtcggcgaagactgcatcgtgtgcatttggatgatacaagaagttgaatcctctcctgatttgtacatcagagaggcgcctgtcaaatccttgaacagaaataaaggcctgaaaatgaaggtgggaaaaggccagagacgagcccttgccataatacccaagaaagttttcaacattgcagagacaccactgcatgagtttcatggtcacacaagtgatatcttggatatgacatggtcaaaatcaaattttctcttgacttcatctaaagacaagactgtacgcatgtggaaagttggctgtgatgactgtctagcagtattcaagcacagagattatgtaacatgcattcaatccaatccggttgacgcaagatacttcgttagcggctcaatagatggcaaagtccgtgtttgggatgtttcagagaggcgagtagttgactgggctgatacaaaggatatcataactgctggtcttattgtcggaatcgcttcagggaggtgccggttctattaccatgcaggtgaaaacgtggaactggagaaagtaatgaaggtaacgaagaagaaatctgctggtagacagatcaccagccttcagtattcaaacggtgatcctgctgggatcatgatcgcttcagcaggttctaaaattcgagtctccgatggaggagctaagatcagccgaaagtttgaaggccggcgaggctccaaggtcctggtaccgccgtctctgacctccgacggccagtaccttgtgtcagcaggtggcgactccaacgtctacatctggaactttgacgggccagcagcgggcaaaagcaccaccaccggagcatcaagaagagttcgttcctgcgagcacttcttctccaagggcgtcacgtccgtggcgacatggccggggatgctgcagcagcaagaagatctccagtcgtcgtcgtcgtcgtcgtcgtcgaagggggccaccccgacgctttgccgcgaccgcgagttctgctcgtttgggacgtggttctcggcggatggagcgaggggcgccgcgacgtggcccgaggagaagctgctgccgtcgctcaagtacgtcaactgcgccgggatggacgagtgcagcaccaaggtgtcggccgcctggaacaaggtcgtcgtcaccggcggccgcgacggggtcatccgatgcttccacaactatggactaccggtgaagctgtag

SEQ ID NO: 11048 - protein, 666 aa, Sorghum bicolor
  misc_feature: Ceres ANNOT ID no. 6119559
  misc_feature (235)..(273): Pfam Id: WD40 Pfam Desc: WD domain, G-beta repeat
  misc_feature (323)..(360): Pfam Id: WD40 Pfam Desc: WD domain, G-beta repeat
  misc_feature (364)..(402): Pfam Id: WD40 Pfam Desc: WD domain, G-beta repeat
  misc_feature (4)..(666): NCBI GI: 116310811 NCBI Desc: osigba0092m08.13 [oryza sativa (indica cultivar-group)]
  misc_feature (4)..(666): NCBI GI: 115458340 NCBI Desc: os04g0417800 [oryza sativa (japonica cultivar-group)]
  misc_feature (4)..(651): NCBI GI: 32488162 NCBI Desc: osjnba0033g16.13 [oryza sativa (japonica cultivar-group)]
  misc_feature (213)..(666): NCBI GI: 92897856 NCBI Desc: wd40-like [medicago truncatula]
  misc_feature (191)..(666): NCBI GI: 92898868 NCBI Desc: wd-40 repeat [medicago truncatula]
  misc_feature: Useful for making plants with altered cell wall content and/or composition
  misc_feature: Functional homolog of the protein sequence encoded by LOCUS at5g53500
  misc_feature: The sequence is a functional homolog of SEQ ID NO. 485 in the 11/188,298 US application
  misc_feature: The sequence is a functional homolog of SEQ ID NO. 502 in the 11/188,298 US application
MYNSDGQDDIFLETSDDIRSSTYFSARCSTSDQLSASWGPDQDELWTSELMSVNERRHRFMIGMGFVKPIPTGITFSQWQGEILADRAFRDLEERINSICSSYRPSFSHCASAPDSTRNSVVLHESEHHELTGILDEVGTNRIMNIDQSEGFLSFSQLVHEFLQKGSGRGPARGMNVAFSEKQKDTKSFCGKFTRKNGEDIICLHDTRMKSLKTGTLFTTKVYQQNKKWMDFSALYMCQEIHAHGGSIRVMKFSTCGWYLASVGEDCIVCIWMIQEVESSPDLYIREAPVKSLNRNKGLKMKVGKGQRRALAIIPKKVFNIAETPLHEFHGHTSDILDMTWSKSNFLLTSSKDKTVRMWKVGCDDCLAVFKHRDYVTCIQSNPVDARYFVSGSIDGKVRVWDVSERRVVDWADTKDIITAGLIVGIASGRCRFYYHAGENVELEKVMKVTKKKSAGRQITSLQYSNGDPAGIMIASAGSKIRVSDGGAKISRKFEGRRGSKVLVPPSLTSDGQYLVSAGGDSNVYIWNFDGPAAGKSTTTGASRRVRSCEHFFSKGVTSVATWPGMLQQQEDLQSSSSSSSSKGATPTLCRDREFCSFGTWFSADGARGAATWPEEKLLPSLKYVNCAGMDECSTKVSAAWNKVVVTGGRDGVIRCFHNYGLPVKL

SEQ ID NO: 11049 - DNA, 1170 bp, Sorghum bicolor
  misc_feature: Ceres ANNOT ID no. 6119594
  misc_feature: Encodes the peptide sequence at SEQ ID NO 11050
  misc_feature: Down-regulated in shoot tissues in response to salicylic acid treatment
atgagtctccttcgcagcatctattgctcacccctttcgtttttcttgatcgcactggtcatcaccagtagcagccgtagtgctaccagcaccggtagcacttcaggaaccagaagatacaatgccatgttcagcttcggagattcagttgccgaaaccgggaacatctgcatcgtcagcagcaacaactcgacggagctcaatgtcctcacctgcacgcatccgccgtacggcatgacctacttcggcaagccgtcttgccggtggagcaacggtcgcacggtcgttgacttgatcgcacaatcgcttggactcccactacttacaccatcgaaatccaaaggcaaagatttccaaaagggtgcaaatatggccatcaccggtggtactgcgctgaacttctccttctaccaatcaatgggcgttgaaaatccagtgtggaaccatggctcgctagacatgcaagtccagtggttcaaggtgttgactgcttccatatgcgggacaaaagagaagtgcacagggtttctagcagaatcgctgtttcagttcggtggatttggaggaaacgactataatatcttgcttcttgagcttgggctgaccgttgaacaggcaatggagaacaccccattgattgtcgatgccatcgttaacggtattgagaggctgattgcacttggtgctgttcacattgttgtcccgggcattcttccaacgggctgtctcccactcttcttgacattgtttactattagtgtttcctcaacctcaagcgacacagacttcgatcagcacggctgcttgaaaagtttgaaccgtctgacagagtaccataactccatgcttcagaaacaagtacaaatactccaagccaagcataggtcaacaaggatgatgtacgcagactactcctccctggtgtacaaaatggtgcaacagcctcaagagtttggattcagaaatcctttggaaacgtgctgcggggcaggaggcaagtacaacttcgacgtcgccgccagatgcggcatgcccggcgcaacaacaccttgccgcgacccgtcggctcgcctgagctgggacggcgtccacccgacggaggcggccaacaagatgatcgccgacgcctggctccacggcccctactgcaacccacctattttaagttga

SEQ ID NO: 11050 - protein, 389 aa, Sorghum bicolor
  misc_feature: Ceres ANNOT ID no. 6119594
  misc_feature (43)..(377): Pfam Id: Lipase_GDSL Pfam Desc: GDSL-like Lipase/Acylhydrolase
  misc_feature (90)..(388): NCBI GI: 115466518 NCBI Desc: os06g0157000 [oryza sativa (japonica cultivar-group)]
  misc_feature (12)..(388): NCBI GI: 115435276 NCBI Desc: os01g0215700 [oryza sativa (japonica cultivar-group)]
  misc_feature (17)..(387): NCBI GI: 47497746 NCBI Desc: lipase-like [oryza sativa (japonica cultivar-group)]
  misc_feature (8)..(389): NCBI GI: 115435284 NCBI Desc: os01g0216500 [oryza sativa (japonica cultivar-group)]
  misc_feature (17)..(387): NCBI GI: 115445329 NCBI Desc: os02g0250400 [oryza sativa (japonica cultivar-group)]
  misc_feature: Down-regulated in shoot tissues in response to salicylic acid treatment
MSLLRSIYCSPLSFFLIALVITSSSRSATSTGSTSGTRRYNAMFSFGDSVAETGNICIVSSNNSTELNVLTCTHPPYGMTYFGKPSCRWSNGRTVVDLIAQSLGLPLLTPSKSKGKDFQKGANMAITGGTALNFSFYQSMGVENPVWNHGSLDMQVQWFKVLTASICGTKEKCTGFLAESLFQFGGFGGNDYNILLLELGLTVEQAMENTPLIVDAIVNGIERLIALGAVHIVVPGILPTGCLPLFLTLFTISVSSTSSDTDFDQHGCLKSLNRLTEYHNSMLQKQVQILQAKHRSTRMMYADYSSLVYKMVQQPQEFGFRNPLETCCGAGGKYNFDVAARCGMPGATTPCRDPSARLSWDGVHPTEAANKMIADAWLHGPYCNPPILS

SEQ ID NO: 11051 - DNA, 912 bp, Sorghum bicolor
  misc_feature: Ceres ANNOT ID no. 6119602
  misc_feature: Encodes the peptide sequence at SEQ ID NO 11052
atgacgtcctcggggacgggcgcgcagcagctgccgcggacggaggcgcggtcgctgtcgggtcacgagggagcggtgctggccgtgcggttcaaccgggacggcaactactgcctgagctgcggcaaggaccgcacactccgcctctggaaccctcacactggcgcccacgtcaagacctacaagtcccacgcccgcgaggtccgcgatgtccactcttcctcggataacgcgaaactggtgtcctgcggagccgacagacagatcttctattgggacgtcgcctcgggccgcgtcatccgcaagttccgcggtcacaacagcgaggtcaattcagtgaagtttaatgagtacaacgctgttgtagtctcagctggttatgaccgtacggtgcgtgcatttgactgcaggtcacaaagcagtgaccctattcagacaattgatacttttcaagatagtgtaatgtcagttaacctaacaaagacagaaataattgctggcagtgttgatggtactgtccgggcatttgacattcgtatgggtagggagactgttgataatctggggcatcctgtgaactgtgtatcattatcaaatgacagcaattgccttttagctaactgtttagattctactgtgcggcttctagacaagtcatctggagaactgttacaggagtataagggacatacgtgcaagtccttcaagatggattcctgtctgacgaatgatgatgcatttgtcgttggtggatctgaggatggttatattttcttctgggagttagtcgatgcacctgttgttgcaagattcagggcacatagttctgtggtaactagcatcagttaccacccaacgaaggcctgcatgttgacatcttcggtggatggctctattcgtgtttggacctga

SEQ ID NO: 11052 - protein, 303 aa, Sorghum bicolor
  misc_feature: Ceres ANNOT ID no. 6119602
  misc_feature (13)..(51): Pfam Id: WD40 Pfam Desc: WD domain, G-beta repeat
  misc_feature (55)..(93): Pfam Id: WD40 Pfam Desc: WD domain, G-beta repeat
  misc_feature (97)..(135): Pfam Id: WD40 Pfam Desc: WD domain, G-beta repeat
  misc_feature (265)..(303): Pfam Id: WD40 Pfam Desc: WD domain, G-beta repeat
  misc_feature (10)..(302): NCBI GI: 14150114 NCBI Desc: mitogen-activated protein kinase organizer 1 [homo sapiens]
  misc_feature (10)..(302): NCBI GI: 62897951 NCBI Desc: mitogen-activated protein kinase organizer 1 variant [homo sapiens]
  misc_feature (8)..(302): NCBI GI: 18044039 NCBI Desc: riken cdna 1500041n16 [mus musculus]
  misc_feature (8)..(302): NCBI GI: 50539926 NCBI Desc: zgc:92654 [danio rerio]
  misc_feature (22)..(286): NCBI GI: 108872188 NCBI Desc: wd-repeat protein [aedes aegypti]
  misc_feature: The sequence is a functional homolog of SEQ ID NO. 502 in the 11/188,298 US application
  misc_feature: The sequence is a functional homolog of SEQ ID NO. 485 in the 11/188,298 US application
MTSSGTGAQQLPRTEARSLSGHEGAVLAVRFNRDGNYCLSCGKDRTLRLWNPHTGAHVKTYKSHAREVRDVHSSSDNAKLVSCGADRQIFYWDVASGRVIRKFRGHNSEVNSVKFNEYNAVVVSAGYDRTVRAFDCRSQSSDPIQTIDTFQDSVMSVNLTKTEIIAGSVDGTVRAFDIRMGRETVDNLGHPVNCVSLSNDSNCLLANCLDSTVRLLDKSSGELLQEYKGHTCKSFKMDSCLTNDDAFVVGGSEDGYIFFWELVDAPVVARFRAHSSVVTSISYHPTKACMLTSSVDGSIRVWT

SEQ ID NO: 11053 - DNA, 1656 bp, Sorghum bicolor
  misc_feature: Ceres ANNOT ID no. 6119623
  misc_feature: Encodes the peptide sequence at SEQ ID NO 11054
atggagctggctgtcggcggcgggatgcggcggtcggcgtcgcacacctcgctgtcggagtcggacgacttcgagctcacgcggctgctcagcaagccgcggatcaacgtcgagcgccagcgctccttcgacgaccgctcgctcagcgacgtctcgcactcgggcggctacggcaggggaggcttcgacggcatgtactcgcctgggggcggcctgcgctccctcgtcggcacgccggcatcctccgcgctgcactccttcgagccccaccccatcgtcggcgacgcatgggaggcgctccgccgctcactcgtcttctttcgcggccagccccttggcaccgtcgccgccgtcgaccacgcttccgaggaagtcctcaactacgaccaagtgtttgtgagggatttcgtgccgagcgcgctggcgtttctgatgaatggcgagccggatatcgtcaagaacttccttctgaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggagggttgcgcctgtggattctggtttctggtggatcatactcctccgggcgtacacaaaaaccaccggtgatatgaccctggcagagacaccggagtgccagaaagggatgaggctcatactcagcctgtgcttatctgaggggtttgataccttcccgacattgttatgtgctgatggttgctgtatgatagatcgcagaatgggtgtatatggataccctattgagattcaagcccttttctttatggcactaaggtgtgctcttcaaatgcttaagcatgataatgaagggaaggaatttgtagagaagattgctacccgccttcatgctttaagttatcacatgcgaagttatttttggctcgatttccaacagctaaatgacatttatcgttacaagacagaagaatattcccacacagccgtcaacaaattcaatgttattcctgattcaattccggactggctatttgactttatgccttgtcagggtgggtttttcattggtaatgttagtcctgccaggatggacttccgatggtttgcacttggaaacatgattgctatactttcttctcttgcaacacctgagcaatctgttgctataatggatcttattgaggagcgttgggaagagcttatcggtgatatgcctctgaagatatgttatcctgctattgagaaccatgaatggcgaattgtgacaggctgtgatccaaaaaatactagatggagctatcacaatggaggatcgtggccagcctgcatcaaaactggacggccgcaaattgcaagaagagcaattgacctagcagagaggaggctgttgaaggatggctggcctgagtactatgacgggaagcttggtcggtatgttggcaagcaggcaaggaaattccagacttggtccatcgcggggtatttggtcgccaagatgatgttggaagatccttcacatcttggcatgatctccctagaagaggataaggcgatgttgaagcctgttttgaagcggtccgcatcatggacaaactaa

SEQ ID NO: 11054 - protein, 551 aa, Sorghum bicolor
  misc_feature: Ceres ANNOT ID no. 6119623
  misc_feature (84)..(544): Pfam Id: Invertase_neut Pfam Desc: Plant neutral invertase
  misc_feature (8)..(550): NCBI GI: 74476783 NCBI Desc: neutral/alkaline invertase [manihot esculenta]
  misc_feature (9)..(550): NCBI GI: 7267646 NCBI Desc: neutral invertase like protein [arabidopsis thaliana]
  misc_feature (60)..(550): NCBI GI: 3287693 NCBI Desc: similar to lim17 gene product gb1653769 from the genome of synechocystis sp. gbd90916. [arabidopsis thaliana]
  misc_feature (81)..(550): NCBI GI: 92892384 NCBI Desc: plant neutral invertase [medicago truncatula]
  misc_feature (1)..(550): NCBI GI: 146395463 NCBI Desc: beta-fructofuranosidase [solanum lycopersicum]
  misc_feature: Useful for making plants with modulated oxidative stress sensitivity
  misc_feature: Functional homolog of the protein sequence given in SEQ ID NO 13231
  misc_feature: Useful for making plants with modulated oxidative stress sensitivity
  misc_feature: Functional homolog of the protein sequence given in SEQ ID NO 13231
  misc_feature: Useful for making plants with altered carbohydrate content
  misc_feature: Functional homolog of the protein sequence given in SEQ ID NO 13652
MELAVGGGMRRSASHTSLSESDDFELTRLLSKPRINVERQRSFDDRSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDMTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGDMPLKICYPAIENHEWRIVTGCDPKNTRWSYHNGGSWPACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 11055 - DNA, 1032 bp, Sorghum bicolor
  misc_feature: Ceres ANNOT ID no. 6119651
  misc_feature: Encodes the peptide sequence at SEQ ID NO 11056
atgcaggtcgcacgccgccgttaccgctgggtgaaggagtgggtcccgcaagatctggtcgtcgccggaggcccctgcacgctctacaagtgggtgcgagaggatagactggccgctttgaaggctaaggacaaggagcagggagcagagtctgcaacgcctgaaccgaactccgaggttctgttcctgtgcagctacgaaggatgtgggaagacattttttgatgcaggggctcttaggaagcatgctcatgttcatggggagaggcaatatatctgtcactatgagaactgtggcaagaaattcttagatagctctaagttgaagaggcattttcttattcatacaggagaaaagaattttgtgtgtccacatgaaggttgtggaaaggctttttcgttggattttaatttaaaggcacacatgaaaacacattctgcggataactatcatgtgtgccagtatccagaatgtggccgaagatttacacaagaatcaaaattaagagctcatatcaggcaacaacatgagaaaaatccaggtgcatcgacaacgaaccacatagtaattggagatcagcatcagccacctaagccagcaaaggtctcagcaacacctccagctccctcagctgagcgcccttacgtctgcccctacgatggttgcgacaaggcatacatccatgagtacaagctgaacctccatttgaaaaaagagcaccccaaccactaccaggatggtggcccacgaggcgctgccccttcaaagcgcaacatctcgaagagttcccacaggagcaagccagacgtcaccccaaggatgccaacagccaagatccccaagcacaaaggagggtacgtagcaccgttgccagctgtgaacctccctgaggagcagcagtggccaaggaaagggatgtacgaggttgacagcgaggagaccgaggaagagggggacaacaatgtcgaagatagatggaactacaacagggctgttagcagcgacgacgaggaaaccgaagacgaagaatga

SEQ ID NO: 11056 - protein, 343 aa, Sorghum bicolor
  misc_feature: Ceres ANNOT ID no. 6119651
  misc_feature (62)..(86): Pfam Id: zf-C2H2 Pfam Desc: Zinc finger, C2H2 type
  misc_feature (91)..(115): Pfam Id: zf-C2H2 Pfam Desc: Zinc finger, C2H2 type
  misc_feature (121)..(145): Pfam Id: zf-C2H2 Pfam Desc: Zinc finger, C2H2 type
  misc_feature (151)..(176): Pfam Id: zf-C2H2 Pfam Desc: Zinc finger, C2H2 type
  misc_feature (215)..(240): Pfam Id: zf-C2H2 Pfam Desc: Zinc finger, C2H2 type
  misc_feature (1)..(343): NCBI GI: 115446647 NCBI Desc: os02g0551900 [oryza sativa (japonica cultivar-group)]
  misc_feature (9)..(343): NCBI GI: 4519673 NCBI Desc: wrebp-2 [nicotiana tabacum]
  misc_feature (9)..(258): NCBI GI: 30680251 NCBI Desc: zinc finger (c2h2 type) family protein [arabidopsis thaliana]
  misc_feature (9)..(342): NCBI GI: 92885256 NCBI Desc: basic-leucine zipper (bzip) transcription factor; zinc finger, c2h2-type [medicago truncatula]
  misc_feature (34)..(258): NCBI GI: 79325009 NCBI Desc: nucleic acid binding / zinc ion binding [arabidopsis thaliana]
  misc_feature: Useful for making plants with altered Lignin content
  misc_feature: Functional homolog of the protein sequence given in SEQ ID NO 13069
  misc_feature: Useful for making plants with altered lignin content
  misc_feature: Functional homolog of the protein sequence given in SEQ ID NO 13069
  misc_feature: The sequence is a functional homolog of SEQ ID NO. 455 in the 11/188,298 US application
MQVARRRYRWVKEWVPQDLVVAGGPCTLYKWVREDRLAALKAKDKEQGAESATPEPNSEVLFLCSYEGCGKTFFDAGALRKHAHVHGERQYICHYENCGKKFLDSSKLKRHFLIHTGEKNFVCPHEGCGKAFSLDFNLKAHMKTHSADNYHVCQYPECGRRFTQESKLRAHIRQQHEKNPGASTTNHIVIGDQHQPPKPAKVSATPPAPSAERPYVCPYDGCDKAYIHEYKLNLHLKKEHPNHYQDGGPRGAAPSKRNISKSSHRSKPDVTPRMPTAKIPKHKGGYVAPLPAVNLPEEQQWPRKGMYEVDSEETEEEGDNNVEDRWNYNRAVSSDDEETEDEE

SEQ ID NO: 11057 - DNA, 1758 bp, Sorghum bicolor
  misc_feature: Ceres ANNOT ID no. 6119656
  misc_feature: Encodes the peptide sequence at SEQ ID NO 11058
atggcctccgccgcgggcgccgcatctgccgccatcgccctcctcatcctcctacccctcgccgccgcctccgactccgaccacaagtaccaagcagaggagcctgtgacgctctgggtgaacaaggttggtccgtacaacaatccccaggagacatacaactactacagcctcccattttgccatgcgtcagaaaaccatgtgcataagtggggaggacttggcgaggtccttggtgggaatgaactcattgacagccagatcgacataaagttcagaaagaatgtcgataaggccacaatttgttcgctcgacctggatcttgtcaaggctaagcaattgtcagatgcgattgagaactcgtattggtttgaatttttcattgatgatttgcctttgtggggttttgttggagaggcagacagaaacaatgataacaaatatttcctattcacccataagaatatcgtcatcagatacaatggcaatcagattatccatgttaatcttactcaagaaagcccaaagcttattgatgtgaacaaggcattggacatgacatattctgtcaaatgggaaccaacagacataacatttgctcaccgctttgatgtgtatctggactatcctttctttgaacaccagattcactggttctcaattttcaattctttcatgatggttatctttctcactggactagtgtcaatgatactgatgcggactctaagaaatgattatgcaaagtatgcccgtgatgacgatgatattgaaactctggaacgagatgtcaatgaagaatctggatggaagcttgtacatggtgatgttttccggcctccttgcaatctagttcttctttcagctcttgttggtattggtacacagttggcagcactgattctactagtgattttgttggcaatcattggaatgctgtacattgggcgaggagctattgtcacaacattcattgtttgctatgctcttacttcattcatctctggatatgtcagtggtgcactatactcacggcatggagggaaaaactggatcaaggcgatggccatgacagcatcacttttcccatttatgtgctttggaattggcctagggcttaacactattgctattttctatggatcattagctgccataccatttggtacgatggtggttgttttcatcctgtgggctttcatctctttccctcttgcccttttgggaactgttgttggtagaaactggagtggcgccccaaacaatccctgtcgggtaaagactattcctcgacctattcctgagaagaaatggtacctcacaccctcagtcattgcgcttatgggaggactgcttccatttggtagtatctttattgagatgtactttgtcttcacatccttctggaactataaggtctactatgtttacgggttcatgttgctggtctttctaatcctcataattgtcaccatatgtgtaacaattgtcggaacatatttcttgctaaatgcggagaactaccactggcaatggacttcattcttctctgctgcttccactgctgtgtatgtttacctctactccatatattattaccacatgaagaccaagatgtcaggattcttccagacaagcttctacttcggctacactctaatgttctgcctaggtttaggaacactatgcggtgccgttgggtatcttggatcgacattgtttgtgaggaggatctacaggaacataaagtgtgactaa

SEQ ID NO: 11058 - protein, 585 aa, Sorghum bicolor
  misc_feature: Ceres ANNOT ID no. 6119656
  misc_feature (51)..(543): Pfam Id: EMP70 Pfam Desc: Endomembrane protein 70
  misc_feature (1)..(585): NCBI GI: 1931647 NCBI Desc: endomembrane protein emp70 precusor isolog; 68664-64364 [arabidopsis thaliana]
  misc_feature (11)..(585): NCBI GI: 92885243 NCBI Desc: nonaspanin (tm9sf) [medicago truncatula]
  misc_feature (23)..(585): NCBI GI: 92889078 NCBI Desc: nonaspanin (tm9sf) [medicago truncatula]
  misc_feature (1)..(585): NCBI GI: 60359970 NCBI Desc: mkiaa4036 protein [mus musculus]
  misc_feature (1)..(585): NCBI GI: 19111162 NCBI Desc: transmembrane protein 9 superfamily member 3 [mus musculus]
MASAAGAASAAIALLILLPLAAASDSDHKYQAEEPVTLWVNKVGPYNNPQETYNYYSLPFCHASENHVHKWGGLGEVLGGNELIDSQIDIKFRKNVDKATICSLDLDLVKAKQLSDAIENSYWFEFFIDDLPLWGFVGEADRNNDNKYFLFTHKNIVIRYNGNQIIHVNLTQESPKLIDVNKALDMTYSVKWEPTDITFAHRFDVYLDYPFFEHQIHWFSIFNSFMMVIFLTGLVSMILMRTLRNDYAKYARDDDDIETLERDVNEESGWKLVHGDVFRPPCNLVLLSALVGIGTQLAALILLVILLAIIGMLYIGRGAIVTTFIVCYALTSFISGYVSGALYSRHGGKNWIKAMAMTASLFPFMCFGIGLGLNTIAIFYGSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTLMFCLGLGTLCGAVGYLGSTLFVRRIYRNIKCD

SEQ ID NO: 11059 - DNA, 1338 bp, Sorghum bicolor
  misc_feature: Ceres ANNOT ID no. 6119668
  misc_feature: Encodes the peptide sequence at SEQ ID NO 11060
  misc_feature: Down-regulated in root tissues in response to methyl jasmonate treatment
  misc_feature: Down-regulated in shoot tissues in response to methyl jasmonate treatment
atggcggagcgcctcgccgcctccctcctccccgccgcctcgccgtccccgtccgcccgccgcgcgacggtcgcagccgcggccgccgcctctttcccctccccatgctccgcgcgcgcggggctgcgcctacgctcccgccagcccctcctctcgcactcgcagaaggcggccgggcgcgggcgtggcgtgcgggtggtccggtgcatggcggcgtcggacgcggcgcagctcaaggccgcgcaggaggacatcaaggagctccttaagaccacatactgccaccccatcctggtccgtctggggtggcatgattctggtacctatgacaagaatattgaggagtggccacaacgaggtggagctgatggaagcttaaggttcgatgctgagttgagtcatggagccaatgctggtctgattaatgcattgaagcttatccaacctatcaaggacaaatacccaggtatcacttatgcagatttgttccagttagcgagtgctacggcaattgaggaagctggtggcccgaaaattccaatgaaatatgggcgggttgatgtcacagcagctgagcagtgtccacctgaagggaggcttcctgacgctggcccacgtgatccggctgaacaccttagggaggtattctatagaatgggccttgatgacaaggaaattgttgcactatctggagcacatacacttggaagatcaaggcctgaccggagtggctggggaaaaccagaaacaaaatataccaaggatgggcctggtgagcctggagggcaatcatggacagttgagtggttgaagtttgataacagttacttcaaggacatgaagtttttgagccaacttccctcggaagagcagaaggaacaggatcttctagttttgcccacagatgctgcattatttgaggacccatcattcaaggtatacgcggaaaagtacgcagaggaccaggaagcgtttttcaaagactatgctgaagctcatgctaagctgagcgatcttggttcaaagtttgatcctcctgagggattctcactggacgatgacatgagcactgcacctgcagacgaaaagacggaagaagatatctcttttgcgacagccgatgacaacaacggcgcagctccacagccggagcccttcgtcgctgccaaatactcgtatggaaagagggagctgtcagagtcgatgaagcaaaagatcagagcagagtacgaggggttcggaggcagcccggacaagcccatgcagtccaactacttcctcaacatcatgatcctgatcgcagggctggcgttcttgacgtctctggtcgggaactga

SEQ ID NO: 11060 - protein, 445 aa, Sorghum bicolor
  misc_feature: Ceres ANNOT ID no. 6119668
  misc_feature (81)..(321): Pfam Id: peroxidase Pfam Desc: Peroxidase
  misc_feature (1)..(385): NCBI GI: 78099188 NCBI Desc: probable l-ascorbate peroxidase 8, chloroplast precursor
  misc_feature (1)..(385): NCBI GI: 115446663 NCBI Desc: os02g0553200 [oryza sativa (japonica cultivar-group)]
  misc_feature (1)..(445): NCBI GI: 46095323 NCBI Desc: thylakoid ascorbate peroxidase [triticum aestivum]
  misc_feature (1)..(445): NCBI GI: 121551197 NCBI Desc: thylakoid bound ascorbate peroxidase [triticum aestivum]
  misc_feature (64)..(445): NCBI GI: 25992557 NCBI Desc: thylakoid-bound ascorbate peroxidase [triticum aestivum]
  misc_feature (8)..(353): SWISSPROT Homolog: EC 1.11.1.11 L-ascorbate peroxidase T, chloroplast precursor
  misc_feature: Down-regulated in root tissues in response to methyl jasmonate treatment
  misc_feature: Down-regulated in shoot tissues in response to methyl jasmonate treatment
MAERLAASLLPAASPSPSARRATVAAAAAASFPSPCSARAGLRLRSRQPLLSHSQKAAGRGRGVRVVRCMAASDAAQLKAAQEDIKELLKTTYCHPILVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRDPAEHLREVFYRMGLDDKEIVALSGAHTLGRSRPDRSGWGKPETKYTKDGPGEPGGQSWTVEWLKFDNSYFKDMKFLSQLPSEEQKEQDLLVLPTDAALFEDPSFKVYAEKYAEDQEAFFKDYAEAHAKLSDLGSKFDPPEGFSLDDDMSTAPADEKTEEDISFATADDNNGAAPQPEPFVAAKYSYGKRELSESMKQKIRAEYEGFGGSPDKPMQSNYFLNIMILIAGLAFLTSLVGN

SEQ ID NO: 11061 - DNA, 1812 bp, Sorghum bicolor
  misc_feature: Ceres ANNOT ID no. 6119680
  misc_feature: Encodes the peptide sequence at SEQ ID NO 11062
atggatgggacaactgatgcaagcccttcgtcaaaactccatacaagactcagactctgggagtttccggactcttatatatttgaaccaattgatggccttgctgacttgtacttgtcagttagccggaccagcggaacaatgaatctagttcaagacttgccgtcacgtggatccactacaaaatataaagttcaaacagtatatggtgtgataggagtgctcaaacttgcagttggatcatattttgtggtggtcacggatcgtgattgtgtgggatcctactttggacatgcaatttttaaagtgacaggactaaaagttcttccctgcaaaaatgcacataacactacctctgctgagcagaaaaaaatggaaacagaattctcggaactcctggatgctgcagagaggactgttggccttcacttttcctatgatatcaacctaacactttctgcacagaggctacatgatctaggcgatgagtataaagctcttcctctttggagacaggcggaaccaagatttctatggaacgcgtacttgttagaacctctaattgagaacaagctgaaccagtacttattgccagtaattcaaggcagtatccttggttttcaaaatatccaagcagaagttgggtcagagaaggtaaatgtgaccctgattgcacgtaggtgcacacgaaggataggtgagggtactcgaatgtggagacgaggagctgatgcagagggttatgctgcaaacttcgttgaatcagagcagataatgcagtcaaaagggtttacagcatcctatgtacaagttcgaggctctatgccattcttgtgggagcagattgttgatttgacatacaaacctagttttgacattgttagacaagaggaggcacctcgtgtacttgagaggcacttccatgatttgcaaaagaaatatggagctgtcttagctgctgatcttgtcaatacaggtggcggtgagggtcgcctccgtgaaagatatgcaaaatctattgaacctattcttagtgaagatataagatatgtgcacttcgacttccaccgagtttgtggtcatattcactttgagcgcctttctcagctgtatgatcagatcaaggactatcttcagaaacataagtacttccttgtaaatgataaaggagagaaaattgaggagcagactggcactgtaagaacaaattgtatagattgtttggatcgcaccaatgtgactcagagcatgattgggcgaaatattctggaaagccaacttcaacgtataggagtttttggtgctggtgatacaataagcaaacatgcagcctttgatacaaactacaaagttttgtgggccaatcatggagatgcaataagcattcagtactctggaactcctgctctgaagggagattttgttcggtatgggaagcgaactactgaaggaattctgaacgatttgaagaatgcactcggtagatactacttcaataacttcgctgatgggactaagcaggatgccatggatcttcttcaaggacattacatgacatctgttagtcgagacatggcagtcccaaccaaagcaggacttctggacagttatgcgtccttccgccttgcttttgcattggttatgggagctctaatgttcatgatgatgtcactaagacaagcccggaatgatgttcgccatttgttgctgtcacttctgtgggctggtctttgtattggcatcacacaatttgttaaagccaatggtcgcacgttcactaaccgacctaggtttcacaagtcacgccattga

SEQ ID NO: 11062 - protein, 603 aa, Sorghum bicolor
  misc_feature: Ceres ANNOT ID no. 6119680
  misc_feature (68)..(367): Pfam Id: Syja_N Pfam Desc: SacI homology domain
  misc_feature (1)..(603): NCBI GI: 50725775 NCBI Desc: inositol 5-phosphatase 3-like protein [oryza sativa (japonica cultivar-group)]
  misc_feature (12)..(602): NCBI GI: 31415729 NCBI Desc: sac domain protein 6 [arabidopsis thaliana]
  misc_feature (12)..(451): NCBI GI: 91807100 NCBI Desc: phosphoinositide phosphatase family protein [arabidopsis thaliana]
  misc_feature (17)..(597): NCBI GI: 115452391 NCBI Desc: os03g0290500 [oryza sativa (japonica cultivar-group)]
  misc_feature (323)..(603): NCBI GI: 62734710 NCBI Desc: similar to sac domain protein 7 [oryza sativa (japonica cultivar-group)]
MDGTTDASPSSKLHTRLRLWEFPDSYIFEPIDGLADLYLSVSRTSGTMNLVQDLPSRGSTTKYKVQTVYGVIGVLKLAVGSYFVVVTDRDCVGSYFGHAIFKVTGLKVLPCKNAHNTTSAEQKKMETEFSELLDAAERTVGLHFSYDINLTLSAQRLHDLGDEYKALPLWRQAEPRFLWNAYLLEPLIENKLNQYLLPVIQGSILGFQNIQAEVGSEKVNVTLIARRCTRRIGEGTRMWRRGADAEGYAANFVESEQIMQSKGFTASYVQVRGSMPFLWEQIVDLTYKPSFDIVRQEEAPRVLERHFHDLQKKYGAVLAADLVNTGGGEGRLRERYAKSIEPILSEDIRYVHFDFHRVCGHIHFERLSQLYDQIKDYLQKHKYFLVNDKGEKIEEQTGTVRTNCIDCLDRTNVTQSMIGRNILESQLQRIGVFGAGDTISKHAAFDTNYKVLWANHGDAISIQYSGTPALKGDFVRYGKRTTEGILNDLKNALGRYYFNNFADGTKQDAMDLLQGHYMTSVSRDMAVPTKAGLLDSYASFRLAFALVMGALMFMMMSLRQARNDVRHLLLSLLWAGLCIGITQFVKANGRTFTNRPRFHKSRH

SEQ ID NO: 11063 - DNA, 615 bp, Sorghum bicolor
  misc_feature: Ceres ANNOT ID no. 6119686
  misc_feature: Encodes the peptide sequence at SEQ ID NO 11064
atgggaggagctaccaacctacctcctggtttccatttcttcccttcagatgaagatctcatcgtccatttcctccgtcgcaaagtggccaacctcccatgccgccctgacatcgtcccgacgatacttctgcaccgctacgatccgtgggaattgaatggcacggcgctgcaagctggaaaccaatggtatttctttagccatgccgcgcagagcagaacctctccgaatgggtactggaatcccgttggtgccgatgaaacagtaacaagcagtggctgtattgttggcctgaagaagacgctcatcttctgcaccggggagcctttcaaaggtttcaaaacaaactggatcatgcatgagtaccaccttcaagatggaggatacaatgtcagcggtagcagcacctcaagtagctcaagctccagtaggaaatcccagaggaagagacttcactcaagcacggagtccaacaactgggtgatatgtagagtgttcgaatcaagctgcggttcacaagtgagcttccatgatgagggcacagagctttcatgcttagatgaggtgtttttgtcgttagatgactatgacgaagtgagtttgccaaataattag

SEQ ID NO: 11064 - protein, 204 aa, Sorghum bicolor
  misc_feature: Ceres ANNOT ID no. 6119686
  misc_feature (7)..(125): Pfam Id: NAM Pfam Desc: No apical meristem (NAM) protein
  misc_feature (1)..(200): NCBI GI: 38344065 NCBI Desc: osjnba0006b20.9 [oryza sativa (japonica cultivar-group)]
  misc_feature (1)..(198): NCBI GI: 115458512 NCBI Desc: os04g0437000 [oryza sativa (japonica cultivar-group)]
  misc_feature (2)..(189): NCBI GI: 115336267 NCBI Desc: nac transcription factor nam-b2 [triticum turgidum subsp. durum]
  misc_feature (2)..(189): NCBI GI: 115336269 NCBI Desc: nac transcription factor nam-d2 [aegilops tauschii]
  misc_feature (2)..(189): NCBI GI: 115336271 NCBI Desc: nac transcription factor nam-1 [hordeum vulgare subsp. vulgare]
  misc_feature: The sequence is a functional homolog of SEQ ID NO 2694 in the 10/374,780US patent application
  misc_feature: The sequence is a functional homolog of SEQ ID NO 290 in the 10/374,780US patent application
  misc_feature: The sequence is a functional homolog of SEQ ID NO 6 in the 10/225,066US patent application
  misc_feature: The sequence is a functional homolog of SEQ ID NO 662 in the 10/225,066US patent application
  misc_feature: Useful for making plants with modulated growth and phenotype characteristics
  misc_feature: The sequence is a functional homolog of SEQ ID NO 6 in the 20050160493 US patent application
  misc_feature: The sequence is a functional homolog of SEQ ID NO 662 in the 20050160493 US patent application
  misc_feature: Useful for making plants with altered carbohydrate content
  misc_feature: Functional homolog of the protein sequence given in SEQ ID NO 13655
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MGGATNLPPGFHFFPSDEDLIVHFLRRKVANLPCRPDIVPTILLHRYDPWELNGTALQAGNQWYFFSHAAQSRTSPNGYWNPVGADETVTSSGCIVGLKKTLIFCTGEPFKGFKTNWIMHEYHLQDGGYNVSGSSTSSSSSSSRKSQRKRLHSSTESNNWVICRVFESSCGSQVSFHDEGTELSCLDEVFLSLDDYDEVSLPNN

SEQ ID NO: 11065 - DNA, 1383 bp, Sorghum bicolor
  misc_feature: Ceres ANNOT ID no. 6119695
  misc_feature: Encodes the peptide sequence at SEQ ID NO 11066
  misc_feature: Up-regulated in root tissues in response to methyl jasmonate treatment
  misc_feature: Up-regulated in shoot tissues in response to methyl jasmonate treatment
atgctgccctactttgatccggactacgacaacttcaaccagcgcatcaaccctccaagggtttgcattgacaacaccacatgcaccgactgcaccttggtgaaggttgacagcatgaacaagaatggcattctgctggaggtgctgcaggtcctgagtgatctggacctccacatcttcaaagcctacatcacctctgatggtggatggttcatggatgtgttccatgtcgtggataagcaagggcagaagattactgatgacaagaccatcaagtacatcgagaaggctttgggtccagagagcaatttgctgtgcccaaaagccagcaacaagcaggggaggtctgtggggctgcactccatcggcgaccacaccgccatcgagctcaaggggcccgacaggacgggcctcctctcggagatcttcgccgtgctcgccgacctccagtgcaacgtgctggcggccgaggtgtggacgcaccgcatgcgcgtggcctgcgtcgtgtacgtgaacgacgtggccacggggctggccatcgacgacccgggccgcgtgtcccggatcgagaaccggctgcgccacgtgctccgcggctacggcggcggcggcgggggcaacgacgacgacgacggcagcggcgcgcacgccaacttcacggacgcctcctcgacgccgcaccacctggaccggcggctgcaccagctcatgcacgccgacgtggacgtcgcgcccgcggcggctctggcggccggtggacagggcgacaggccggaggtgacggtggagcactgcgaggagaagtcctactccgtggtgaacgtcaagtgcagggaccggtccaagctgctcttcgacatcgtgtgcacgctcacggacatggagtacgtcgtgttccatgccgccgtgtcgtccgaagccaactacggcatccaggagctgtacatccgccgcaaggacggcaaaacgcttctgaaagacgaagcagagaaggtgatcaggagcctggaagcagccatctccagaagagtatccgagggcttcacgctggaggtgcgcggcagggacagggtgggcttgctgtcggacgtgacgagggtgctccgggagcacgggctcacggtgagccgcgccgacgtgacgacggagggagggcaggccaccaacgtcttctacgtccgggacccctcgggccagccggtggacatgaagaccgtcgaggggctccggggtcagtttggccagaccgccatgctcaacgtcaagaaggtgagtgtgcctgctgcggcggtggccagagcgcccgagccgagatccagcggcggcattgtcaggaacagcttcttctccttcggcagcctcttcgcgaaactccgggcctga

SEQ ID NO: 11066 - protein, 460 aa, Sorghum bicolor
  misc_feature: Ceres ANNOT ID no. 6119695
  misc_feature (126)..(194): Pfam Id: ACT Pfam Desc: ACT domain
  misc_feature (348)..(411): Pfam Id: ACT Pfam Desc: ACT domain
  misc_feature (6)..(452): NCBI GI: 22138100 NCBI Desc: acr5 [arabidopsis thaliana]
  misc_feature (6)..(452): NCBI GI: 22138098 NCBI Desc: acr4 [arabidopsis thaliana]
  misc_feature (6)..(452): NCBI GI: 6730631 NCBI Desc: f4n2.2 [arabidopsis thaliana]
  misc_feature (6)..(452): NCBI GI: 42572033 NCBI Desc: act domain containing protein (acr4) [arabidopsis thaliana]
  misc_feature (35)..(446): NCBI GI: 115477499 NCBI Desc: os08g0533300 [oryza sativa (japonica cultivar-group)]
  misc_feature: Up-regulated in root tissues in response to methyl jasmonate treatment
  misc_feature: Up-regulated in shoot tissues in response to methyl jasmonate treatment
MLPYFDPDYDNFNQRINPPRVCIDNTTCTDCTLVKVDSMNKNGILLEVLQVLSDLDLHIFKAYITSDGGWFMDVFHVVDKQGQKITDDKTIKYIEKALGPESNLLCPKASNKQGRSVGLHSIGDHTAIELKGPDRTGLLSEIFAVLADLQCNVLAAEVWTHRMRVACVVYVNDVATGLAIDDPGRVSRIENRLRHVLRGYGGGGGGNDDDDGSGAHANFTDASSTPHHLDRRLHQLMHADVDVAPAAALAAGGQGDRPEVTVEHCEEKSYSVVNVKCRDRSKLLFDIVCTLTDMEYVVFHAAVSSEANYGIQELYIRRKDGKTLLKDEAEKVIRSLEAAISRRVSEGFTLEVRGRDRVGLLSDVTRVLREHGLTVSRADVTTEGGQATNVFYVRDPSGQPVDMKTVEGLRGQFGQTAMLNVKKVSVPAAAVARAPEPRSSGGIVRNSFFSFGSLFAKLRA

SEQ ID NO: 11067 - DNA, 1935 bp, Sorghum bicolor
  misc_feature: Ceres ANNOT ID no. 6119699
  misc_feature: Encodes the peptide sequence at SEQ ID NO 11068
atgaagtcgtcagcgataacgaaaggtagcagtttgagcaggaaggattgcatcgggagctactacgccaaggatgccaagtacaggccgttcagcgcgctgctgcccgaaggctggagcggcaaggttctgtacgtgaagctcgtgctcgtcctcctcatgtgcggctccttcatgggcctcctcaactcgccgtccatccacctcgccgacgagcaccaccaccacaccacacagccagaggcggcgtcgaaatcgagctggatgtcgcacccggacgcggcgaactcggggtacgcgtcgagcctgaggatcgactggtcgcagatcgagacggcggcggagcactttgctccggcagcggcggacggcggcggcacgtcgcggacgcggacgcgggttgcgctgctcaacttcgacgacggcgaggtcgaggagtggaaggcgcggatgccgcacacggacgcctccgcggtgcgcctggaccacgtcggcagcgacgtcacctgggagcacctgtacccggagtggatcgacgaggaggagcgctacggcgcgccggcgtgcccggacctgccggagccatcggtggagtcggaggaggcgaggtacgacgtcgtcgcggtgaagctcccgtgcgggcgcgcggcgagctggtccaaggacgtggcgcggctccacctgcagctggccgcggcgcgtctcgccgcgcgcgcgcgccacggcggtgggccggcggcggcgcacgtgctcgtggtgagccggtgcttcccgatgcctaacctgttcaggtgccgggacgaggtggcgcgcgacggcgacgtgtggctgtacaggccggacgtgagcgacctccgccggaagctggagctccccgtggggtcctgcaagctggccatgccgttcagagcgctcggcgagccgtacgtctccgcggcgccgcagcgcgaggcgtacgcgacgatcctgcactcggagcagctgtacgcgtgcggcgccatcacggcggcgcggagcatccggatggccgggtccggtcgggacatggtggctctggtggacgagacgatcagcgcgcggcaccgcggcgcgctggaggcggccgggtgggtggtgcggacgatccggcggatccggaacccgcgggcgtcgcgggacgcgtacaacgagtggaactacagcaagttctggctgtggacgctgacggaatacgagcgggtcatcttcctggacgccgacctgctggtgcagcggcccatggagccgctgttcgcgatgccggaggtgagcgccacggggaaccacggcgcctacttcaactcgggggtcatggtggtggagccctgcaactgcacgttccggctgctggcggaccacgtcggcgacatcgagtcgtacaacggcggcgaccaggggtacctgaacgaggtgttcgcgtggtggcaccgcctgccgtcgcacgccaactacatgaagcacttctggggcggggacacggcggagcgcgccgccgccaagcgccgcgtgctggcggccgacccgcccgtggcgctcgccgtgcacttcgtcggactcaagccctggttctgcttccgggactacgactgcaactggaacgtgccggcgctgcgccagttcgccagcgacgaggcgcacgcgcggtggtggaaggtgcacgacgccatgccgccgcggctccaggggttctgcctgctggacgagcggcagaaggcgctgctgcggtgggacgtcgcgcgggcgagggaggccaacttctccgacggacactggagcgcgcggatcgccgacccgcgacggagcatctgcgcaggcggcggcgacgccgaggcctgccgcgagagggagatcgccggccgccgggtggaagggaaccggatcaccacgtcgtacgccaagctaattgacagtttctga

SEQ ID NO: 11068 - protein, 644 aa, Sorghum bicolor
  misc_feature: Ceres ANNOT ID no. 6119699
  misc_feature (320)..(532): Pfam Id: Glyco_transf_8 Pfam Desc: Glycosyl transferase family 8
  misc_feature (7)..(644): NCBI GI: 115446693 NCBI Desc: os02g0556000 [oryza sativa (japonica cultivar-group)]
  misc_feature (10)..(644): NCBI GI: 46389857 NCBI Desc: lycogenin glucosyltransferase (glycogenin)-like protein [oryza sativa (japonica cultivar-group)]
  misc_feature (74)..(609): NCBI GI: 56784626 NCBI Desc: glycogenin-like protein [oryza sativa (japonica cultivar-group)]
  misc_feature (42)..(609): NCBI GI: 60657590 NCBI Desc: secondary cell wall-related glycosyltransferase family 8 [populus tremula x populus tremuloides]
  misc_feature (99)..(609): NCBI GI: 60657592 NCBI Desc: secondary cell wall-related glycosyltransferase family 8 [populus tremula x populus tremuloides]
  misc_feature: Useful for making plants with altered cell wall content and/or composition
  misc_feature: Functional homolog of the protein sequence encoded by LOCUS at1g77130
  misc_feature: Useful for making plants with altered carbohydrate content
  misc_feature: Functional homolog of the protein sequence given in SEQ ID NO 13653
  misc_feature: Useful for making plants with altered cell wall content and/or composition
  misc_feature: Functional homolog of the protein sequence given in SEQ ID NO 13654
MKSSAITKGSSLSRKDCIGSYYAKDAKYRPFSALLPEGWSGKVLYVKLVLVLLMCGSFMGLLNSPSIHLADEHHHHTTQPEAASKSSWMSHPDAANSGYASSLRIDWSQIETAAEHFAPAAADGGGTSRTRTRVALLNFDDGEVEEWKARMPHTDASAVRLDHVGSDVTWEHLYPEWIDEEERYGAPACPDLPEPSVESEEARYDVVAVKLPCGRAASWSKDVARLHLQLAAARLAARARHGGGPAAAHVLVVSRCFPMPNLFRCRDEVARDGDVWLYRPDVSDLRRKLELPVGSCKLAMPFRALGEPYVSAAPQREAYATILHSEQLYACGAITAARSIRMAGSGRDMVALVDETISARHRGALEAAGWVVRTIRRIRNPRASRDAYNEWNYSKFWLWTLTEYERVIFLDADLLVQRPMEPLFAMPEVSATGNHGAYFNSGVMVVEPCNCTFRLLADHVGDIESYNGGDQGYLNEVFAWWHRLPSHANYMKHFWGGDTAERAAAKRRVLAADPPVALAVHFVGLKPWFCFRDYDCNWNVPALRQFASDEAHARWWKVHDAMPPRLQGFCLLDERQKALLRWDVARAREANFSDGHWSARIADPRRSICAGGGDAEACREREIAGRRVEGNRITTSYAKLIDSF

SEQ ID NO: 11069 - DNA, 1401 bp, Sorghum bicolor
  misc_feature: Ceres ANNOT ID no. 6119702
  misc_feature: Encodes the peptide sequence at SEQ ID NO 11070
atggtgacgaaccaggacgcggaggcggcatcggcggcagcgccgggggcaggggcgacggtggacgcgatgcggctagcgtcgcggtggcgatcccaggcggagtgggcctgcgcggcggcggagctggagtctgagccggcgccgtccgagctcaacaccgtcaacagctccggactcttctccgtcgtctctaccgacaagttgtccgtgaaatacctcggcagccatcaccacggccacgacgtaggtgtcgtgcaggccgaccgccccgcgcccacgcgccgggccgtgtactacttcgagatgagcgtcaggaacgcgggatacaaggggcagacatccatcgggttcacgaacgagagcttcaagatgaggcgacaaccgggttgggagtcaaacagttgtggataccacggtgacgatggccagctttacgtgggtcaagggaaaggtcaatcatttgggccaaaattcacatctggtgacataattggcgctggcatcaactacttgtcacaagaatttttcttcacgaaaaatggagctcaggttggagccattccaaaagaaattaaaggcccactatatcctaccattgcggttcatagtcagggtgaagagttgactgtaaactttggaaaagaaccattctgttttgacattgagggttatattcttgaagagaaaatgaggcaacaatctgtgtctgataaattgaacttggagccggacatcagtcattggattgtccgttcatatctcctacattatggataccaagatacattaaatgcttttgatatggcaaatgcaactgatccccccaccaatcgccaaaatggtcatgcagaacctcccgaaatgtatggtcttagccacagaaaacttttgcgtcagcttatcatgagtggggatatcgactctgcattcaaaagacttggggagtggtatccacaagtgataaaggatgagaaatcggttatttgcttcctactccattctcaaagattcatagaatatatcagggctgaacaactggaggatgctgtgaaatatggtcgtgctaacctggcaagcttcttgacacacaaagcttttgagggactgctgaaggatagtgtggccctacttgcgtatgagaagcctgcagaatcatgcatgggatacctgatggactctccccagcgtgaattcgtggcggacgcagtgaacgcagctgtcctgtcgacaaaccccaccatgaaggaccctgagagctgcctttactcgtgtctcgagaggttactaaggcagctcacagtttgtagctttgagcggcgtgcattcaacaacgaccaaggagatgcattcttactccacaaagaagtgcagaattatgaaaggtccaggcgctcatag

SEQ ID NO: 11070 - protein, 466 aa, Sorghum bicolor
  misc_feature: Ceres ANNOT ID no. 6119702
  misc_feature (96)..(217): Pfam Id: SPRY Pfam Desc: SPRY domain
  misc_feature (1)..(466): NCBI GI: 46389862 NCBI Desc: ranbpm-like [oryza sativa (japonica cultivar-group)]
  misc_feature (40)..(459): NCBI GI: 42571745 NCBI Desc: spla/ryanodine receptor (spry) domain-containing protein [arabidopsis thaliana]
  misc_feature (9)..(348): NCBI GI: 116128216 NCBI Desc: ensangp00000003407 [anopheles gambiae str. pest]
  misc_feature (39)..(348): NCBI GI: 6682820 NCBI Desc: ranbpm [xenopus laevis]
  misc_feature (4)..(348): NCBI GI: 37703700 NCBI Desc: ran-binding protein 10 [mus musculus]
MVTNQDAEAASAAAPGAGATVDAMRLASRWRSQAEWACAAAELESEPAPSELNTVNSSGLFSVVSTDKLSVKYLGSHHHGHDVGVVQADRPAPTRRAVYYFEMSVRNAGYKGQTSIGFTNESFKMRRQPGWESNSCGYHGDDGQLYVGQGKGQSFGPKFTSGDIIGAGINYLSQEFFFTKNGAQVGAIPKEIKGPLYPTIAVHSQGEELTVNFGKEPFCFDIEGYILEEKMRQQSVSDKLNLEPDISHWIVRSYLLHYGYQDTLNAFDMANATDPPTNRQNGHAEPPEMYGLSHRKLLRQLIMSGDIDSAFKRLGEWYPQVIKDEKSVICFLLHSQRFIEYIRAEQLEDAVKYGRANLASFLTHKAFEGLLKDSVALLAYEKPAESCMGYLMDSPQREFVADAVNAAVLSTNPTMKDPESCLYSCLERLLRQLTVCSFERRAFNNDQGDAFLLHKEVQNYERSRRS

SEQ ID NO: 11071 - DNA, 702 bp, Sorghum bicolor
  misc_feature: Ceres ANNOT ID no. 6119704
  misc_feature: Encodes the peptide sequence at SEQ ID NO 11072
atggcgtgccctgcgcagtccatgctctccctctccgccagcggcggcatcttcctgaggagcaagcctcaggcggccgcggcctgccatgtgcgtgggggcatcatcatcggcggtggcagcagcaggccgttcctgctcacctgcaacgcttcctcgccgccggcgccgacgcaggaggaccccgactgcaacgaggaggagtgcgccccggagaaggaggtcgggagcctgagcgccgagtggctggccgaggagaggacccaggtcgtcggcactttccctcccaagaagagaaagtggggctacgtcgagaaggacaccgcaggccagaccaacatctactccgtcgagccgatggtgtacgtggccgagagcgccatcagctccggcacggcgggcacgtcggcggagggcgccgagaacacggccgccatcgccgcggggctcgtcctcatcaccgtcgccgcggcctcgtccatcctcatccaggtgaacaagagccagcctaaggtgacgccggaagccgcctacaacggcccgccgctcagctactacgtcgccaagttccaaccggcggcggtggcgcagaccctcgaggcccccgcccccgccgaggcggtagaggcagcggcgccagaggcgacgacgtccaccgtcgacgcctctgcggctccggaggcgcagcagctgtcgtcgtga

SEQ ID NO: 11072 - protein, 233 aa, Sorghum bicolor
  misc_feature: Ceres ANNOT ID no. 6119704
  misc_feature (1)..(233): NCBI GI: 46389866 NCBI Desc: proline-rich family protein-like [oryza sativa (japonica cultivar-group)]
  misc_feature: The plant flowers significantly late compared to wild-type.
  misc_feature: Useful for making plants with modulated flowering time
  misc_feature: GREAT-hit functional homolog of the protein sequence given in SEQ ID NO 12964
  misc_feature: Useful for making plants with modulated flowering time
  misc_feature: Functional homolog of the protein sequence given in SEQ ID NO 12964
MACPAQSMLSLSASGGIFLRSKPQAAAACHVRGGIIIGGGSSRPFLLTCNASSPPAPTQEDPDCNEEECAPEKEVGSLSAEWLAEERTQVVGTFPPKKRKWGYVEKDTAGQTNIYSVEPMVYVAESAISSGTAGTSAEGAENTAAIAAGLVLITVAAASSILIQVNKSQPKVTPEAAYNGPPLSYYVAKFQPAAVAQTLEAPAPAEAVEAAAPEATTSTVDASAAPEAQQLSS

SEQ ID NO: 11073 - DNA, 996 bp, Sorghum bicolor
  misc_feature: Ceres ANNOT ID no. 6119707
  misc_feature: Encodes the peptide sequence at SEQ ID NO 11074
atgggtggaagccagtacgatgatgaatgggtgttgcccagtgccgatatcactcttgttcttgttgggaaacttggctatggcaagagtgcaactggaaatagcatccttggacgggaagcatttgtatcggaatattcacatgccagtgttactaatacttgtcagttgggaagcactaccctgaaggacggccgcaccatcaatgttattgataccccagggttatttgatatgagcatttcatctgatgaagctggtaaagagattgttaaatgtatgaacatggctaaagatgggatacatgcagttctgatggttttctctgccacatctcggttttctcgagaggatgcaagtacaattgagaccattaaggtcttctttggggaaaagattgttgaccacatgattttagtttttacttatggagatctagttggtgaatctaagttgaagaacatgctaaataatgcgccagagtatttgcagaatgttgttgagctatgccaaaacagagttgtcgtcttcgataacatgaccaatgaccgaaggctccaagcgcagcaacttgacaaattgcttgatgtagtggactcagtttgtgcaaacaatggaggaaaaccattttcagatcaaatgttcactcgcatcaaggaggtgcatgatagagaaaaagaggtgcataccttggggtattcagaagagcagatatctgagttgaaaaaggagattcatagaactagggatgaacagcttgcacacataaccagcatggtcgaggaaaagttaaactgcactgtggagaagctgcaacagcaactcatggaagaacagaacgcaaggctggaagctgagaaggtggcgtatgaagctaggctgaaatcagaagcggagatccagaagctcaaggagagcctcaagaaggctcaaagggaaaacgaggagttccggaggatggcgcagagccagggcagcaaatgtgctatcctgtag

SEQ ID NO: 11074 - protein, 331 aa, Sorghum bicolor
  misc_feature: Ceres ANNOT ID no. 6119707
  misc_feature (17)..(227): Pfam Id: AIG1 Pfam Desc: AIG1 family
  misc_feature (17)..(145): Pfam Id: MMR_HSR1 Pfam Desc: GTPase of unknown function
  misc_feature (7)..(324): NCBI GI: 38346576 NCBI Desc: osjnba0064d20.7 [oryza sativa (japonica cultivar-group)]
  misc_feature (7)..(324): NCBI GI: 32479674 NCBI Desc: p0076o17.7 [oryza sativa (japonica cultivar-group)]
  misc_feature (1)..(331): NCBI GI: 4097585 NCBI Desc: ntgp4 [nicotiana tabacum]
  misc_feature (1)..(319): NCBI GI: 21593218 NCBI Desc: aig1-like protein, 5' partial [arabidopsis thaliana]
  misc_feature (41)..(319): NCBI GI: 12324509 NCBI Desc: aig1-like protein, 5' partial; 1-1205 [arabidopsis thaliana]
MGGSQYDDEWVLPSADITLVLVGKLGYGKSATGNSILGREAFVSEYSHASVTNTCQLGSTTLKDGRTINVIDTPGLFDMSISSDEAGKEIVKCMNMAKDGIHAVLMVFSATSRFSREDASTIETIKVFFGEKIVDHMILVFTYGDLVGESKLKNMLNNAPEYLQNVVELCQNRVVVFDNMTNDRRLQAQQLDKLLDVVDSVCANNGGKPFSDQMFTRIKEVHDREKEVHTLGYSEEQISELKKEIHRTRDEQLAHITSMVEEKLNCTVEKLQQQLMEEQNARLEAEKVAYEARLKSEAEIQKLKESLKKAQRENEEFRRMAQSQGSKCAIL

SEQ ID NO: 11075 - DNA, 1830 bp, Sorghum bicolor
  misc_feature: Ceres ANNOT ID no. 6119720
  misc_feature: Encodes the peptide sequence at SEQ ID NO 11076
atgttcaagaaacctgctgatgtgaaaaccatacagcgcttgtctggggcggacaaaaagaaactaagaagaactgccaaggaaagatttccacaagcttctgatgctgatcttgatgccatccttccccccaaggttgagataacagttgctaagtacccgaatcattctcttgtatatggcatagagggagagttcccaatgattttcaacactgatgcaagaggccatgaactgtttccaacagtttatgcgctttggaaggtcccccatctgttgccagcttttacacttaaaggtggtgaggtttcacgtttcgtgattggcggtgctgatctgatgtttcctggtatcagcatacctccagaagggtttccatcttttgaagctggccaaccatgggctgtaaaagttcctggtaaccctgctccaattgcggttgggagcacaactatgagtagtactgaagccttgaaggcagggctacgtggcaaggctttaaagattttacattactaccgggatatgttatggcaagtgcacactgaccagggctgggattcagctgatggtcgttacgtccccaatgaaggattttttgacgacattgttgttgaagatcctaattctgtttcaacatctcagtctcctgattctgttgaaggacctgaaggcatgaatgatggtagtgtttcggctgaagatgcaggagttgatatttcagacaatcatggtgctgatcctggcatccagagtgaaaccgtggaagagataactgatgctgttaatgaactaaaactgcctgaagataaaaccactgaacaagcacctgttgaaatggaacatcatagtttgacaactgaggaaattgattctctcttggacaaatgccttctgcaagcgctatacacaagcataaaagaaaaagaccttccaatgccagggagtacactatgggcaaatcacatactaccctgcagacctcctggtattactcttgatatcaaaaagtcatcacacaaaaagttgtcgaagtggttacaatcaaaatcttcatctggccttatttcagtaaaggaggacaaatataagaaggaatttatattgcttgctatcaatcgtaagcatccagactacatggcctttagaccggaaaagagggtacaggagcttgttgaacacgtaaaagatgttgctgaaagtagcgtcactaagcaattggaggttgcagagatttataagccaagttctcatgttaaacccatatttgtggctgtagaagctgacatggagaagtattacagtgcaccagaggcttcagatatagtcttcaggtatgtcgaaaaggaaaatttggttaaacctacagacaagaccaaggtgattcttgatgttacattatgtgatgcattgtacaaaggggctatcaaaaagggctcggcatacccaactgaaatccacaagaaagacttgggttcaacatttttaaaccgcatgcaagttcaccacaaagtatcaagagggactcaggaggtcatacgcaagggtgccataagaactattcagatcatgacagaaagaagacagggtaacaagaagatgactcggctttccgggctcgagtgttttctgatggatcctgattcattggcttctgaactccagaaaaaatttgcctgcagcaccaccacagcagagcttccaggtaagaaagggcagtgcgaggtcttggtacaaggtggagtgattgatgaccttgcgaaacaccttgtcgaccactacggtgttccgaaaagatacatcgaggtttatgacaaaacaaagaggtag

SEQ ID NO: 11076 - protein, 609 aa, Sorghum bicolor
  misc_feature: Ceres ANNOT ID no. 6119720
  misc_feature (515)..(599): Pfam Id: SUI1 Pfam Desc: Translation initiation factor SUI1
  misc_feature (208)..(609): NCBI GI: 41055586 NCBI Desc: similar to ligatin [danio rerio]
  misc_feature (216)..(606): NCBI GI: 7678701 NCBI Desc: hepatocellular carcinoma-associated antigen 56; hca56 [homo sapiens]
  misc_feature (216)..(606): NCBI GI: 55961045 NCBI Desc: ligatin [homo sapiens]
  misc_feature (216)..(606): NCBI GI: 13638201 NCBI Desc: ligatin (hepatocellular carcinoma-associated antigen 56)
  misc_feature (216)..(606): NCBI GI: 123981374 NCBI Desc: ligatin [synthetic construct]
MFKKPADVKTIQRLSGADKKKLRRTAKERFPQASDADLDAILPPKVEITVAKYPNHSLVYGIEGEFPMIFNTDARGHELFPTVYALWKVPHLLPAFTLKGGEVSRFVIGGADLMFPGISIPPEGFPSFEAGQPWAVKVPGNPAPIAVGSTTMSSTEALKAGLRGKALKILHYYRDMLWQVHTDQGWDSADGRYVPNEGFFDDIVVEDPNSVSTSQSPDSVEGPEGMNDGSVSAEDAGVDISDNHGADPGIQSETVEEITDAVNELKLPEDKTTEQAPVEMEHHSLTTEEIDSLLDKCLLQALYTSIKEKDLPMPGSTLWANHILPCRPPGITLDIKKSSHKKLSKWLQSKSSSGLISVKEDKYKKEFILLAINRKHPDYMAFRPEKRVQELVEHVKDVAESSVTKQLEVAEIYKPSSHVKPIFVAVEADMEKYYSAPEASDIVFRYVEKENLVKPTDKTKVILDVTLCDALYKGAIKKGSAYPTEIHKKDLGSTFLNRMQVHHKVSRGTQEVIRKGAIRTIQIMTERRQGNKKMTRLSGLECFLMDPDSLASELQKKFACSTTTAELPGKKGQCEVLVQGGVIDDLAKHLVDHYGVPKRYIEVYDKTKR

SEQ ID NO: 11077 - DNA, 2007 bp, Sorghum bicolor
  misc_feature: Ceres ANNOT ID no. 6119724
  misc_feature: Encodes the peptide sequence at SEQ ID NO 11078
atggcggacgccggcgtggcgcgcggcccagggagtgctggcgatgctctgttcagggaactctggcatgcttgtgctgggccgttggtcacagtgcctcgccaaggcgagctggtttactacttcccgcagggtcatatggaacagcttgaagcatctacagatcaacaacttgatcagcacttacctctgtttaatctaccacccaagatcctctgcaaggtggtcaatgtagaacttagagctgaaactgattccgatgaagtttatgctcagattatgctacaacccgaagcagagcaaaatgagcccaccagcccagatgctgagccacccgagcctgaaagatgcaacgtccattccttctgcaagaccttgactgcttcagatacaagtacccatggtggattctctgtcctcaggaggcatgctgaagaatgtctgccccaactggacatgactcagaatccaccatggcaagaactggtggctaaagatctccatggaaatgaatggcatttccgtcacatctttcgagggcaaccaaggaggcatctacttacgacaggctggagtgtttttgttagctcgaaaagattggttgctggtgacgcgtttatctttttgagaggtgagaatggagagctgcgagtcggggtgaggaggctcatgaggcaactaaacaacatgccatcttcggttatctcaagccacagcatgcatcttggagtccttgcaactgcatctcatgccatctccactggaactctcttttctgttttctacaaacccagaacaagtcgatcagaatttgtcgttagtgtaaacaagtaccttgaagctaagaatcacaagatgtctgttggtatgaggtttaaaatgagatttgagggtgacgaatctcctgaaagaagattcagtgggacaattattggtctgggaagcatgccagctaactcaacatctccgtgggctaactctgagtggagatctttgaaggtccaatgggacgagccttctgctattctgcgtccagatagagtttcaccatgggaactagaaccccttgatgcaactaatccacaaccacctcaacctcctttacggaataagcgtgcgcggcctcctgcttcaccttccattgctccagaacttcctccagtttttggtttttggaaatccccagctgagcctgcccaagctttctcattttcaggactgcagcgaactcaggaattataccattcaaaccccaattcaatcttctcgtcatcgttgaatgtaggattcaattcaaagaatgagcgttctactccaaacaacaatcatttgtactggacaatgagagagacaagaactgaatcctactctgctagcattaacaaagctcctactgaaaagaagcaagaatctgctacttctggctgcagattgtttggtattgagataggttctgcagtatcaccagtggttactgttgctagtgttggtcaggatccaccacctgctctctcagtagatgttgaatctgatcagctgtcacaaccatcccatgccaacaaaacggatgccccagcggcaagcagtgagcgctctcctaatgaaacagagagccgacaagtcaggagctgcaccaaggtaatcatgcaaggaatggcggttggcagggcagtggacttgacgaggttagatgggtatgatgatcttcaccgcaagttggaggagatgtttgatatccatggagagctttctgccaacctcaggaaatggaaggttgtttacacagatgatgaggatgacatgatgctggtcggggacgatccatggaagatggtaaaaaggatatatatttactcttacgaggaggccaaatctttgactcccaaagcgaagctgccagtcattggtgacaccatcaagccagacccaaacaaattgtcaccggaatctgacatgccacagagtgacacaaacagcaatgctcccgttgctgctgataaggattga

SEQ ID NO: 11078 - protein, 668 aa, Sorghum bicolor
  misc_feature: Ceres ANNOT ID no. 6119724
  misc_feature (248)..(333): Pfam Id: Auxin_resp Pfam Desc: Auxin response factor
  misc_feature (121)..(226): Pfam Id: B3 Pfam Desc: B3 DNA binding domain
  misc_feature (426)..(630): Pfam Id: AUX_IAA Pfam Desc: AUX/IAA family
  misc_feature (9)..(650): NCBI GI: 38346580 NCBI Desc: osjnba0064d20.11 [oryza sativa (japonica cultivar-group)]
  misc_feature (9)..(650): NCBI GI: 115458558 NCBI Desc: os04g0442000 [oryza sativa (japonica cultivar-group)]
  misc_feature (9)..(389): NCBI GI: 32479677 NCBI Desc: p0076o17.10 [oryza sativa (japonica cultivar-group)]
  misc_feature (11)..(659): NCBI GI: 140053546 NCBI Desc: aux/iaa protein; transcriptional factor b3; auxin response factor [medicago truncatula]
  misc_feature (13)..(659): NCBI GI: 73697834 NCBI Desc: auxin response factor 1 [gossypium barbadense]
  misc_feature: The sequence is a functional homolog of SEQ ID NO 1350 in the 10/666,642US patent application
  misc_feature: The sequence is a functional homolog of SEQ ID NO 202 in the 11/375,241US patent application
  misc_feature: The sequence is a functional homolog of SEQ ID NO 298 in the 10/412,699US patent application
  misc_feature: The sequence is a functional homolog of SEQ ID NO 30 in the 10/412,699US patent application
  misc_feature: The sequence is a functional homolog of SEQ ID NO 300 in the 10/412,699US patent application
  misc_feature: The sequence is a functional homolog of SEQ ID NO 420 in the 11/435,388US patent application
  misc_feature: The sequence is a functional homolog of SEQ ID NO 468 in the 10/225,066US patent application
  misc_feature: The sequence is a functional homolog of SEQ ID NO 8 in the 10/374,780US patent application
  misc_feature: Useful for making plants with modulated growth and phenotype characteristics
  misc_feature: The sequence is a functional homolog of SEQ ID NO 298 in the 20040045049 US patent application
  misc_feature: The sequence is a functional homolog of SEQ ID NO 30 in the 20040045049 US patent application
  misc_feature: The sequence is a functional homolog of SEQ ID NO 300 in the 20040045049 US patent application
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: Functional homolog of the protein sequence given in SEQ ID NO 13377
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: Useful for making plants with modulated light quality sensitivity
  misc_feature: Functional homolog of the protein sequence given in SEQ ID NO 13657
  misc_feature: The sequence is a functional homolog of SEQ ID NO 100 in the 10/666,642 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
MADAGVARGPGSAGDALFRELWHACAGPLVTVPRQGELVYYFPQGHMEQLEASTDQQLDQHLPLFNLPPKILCKVVNVELRAETDSDEVYAQIMLQPEAEQNEPTSPDAEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWANSEWRSLKVQWDEPSAILRPDRVSPWELEPLDATNPQPPQPPLRNKRARPPASPSIAPELPPVFGFWKSPAEPAQAFSFSGLQRTQELYHSNPNSIFSSSLNVGFNSKNERSTPNNNHLYWTMRETRTESYSASINKAPTEKKQESATSGCRLFGIEIGSAVSPVVTVASVGQDPPPALSVDVESDQLSQPSHANKTDAPAASSERSPNETESRQVRSCTKVIMQGMAVGRAVDLTRLDGYDDLHRKLEEMFDIHGELSANLRKWKVVYTDDEDDMMLVGDDPWKMVKRIYIYSYEEAKSLTPKAKLPVIGDTIKPDPNKLSPESDMPQSDTNSNAPVAADKD

SEQ ID NO: 11079 - DNA, 1389 bp, Sorghum bicolor
  misc_feature: Ceres ANNOT ID no. 6119727
  misc_feature: Encodes the peptide sequence at SEQ ID NO 11080
atggcggaggacgcggttgctgcaaagagacgacgacggtgcacgggcgggggcggggacatggtggctttgccggagcacgtcctccaggagatcttgtcccgcgtgggcaccgtcaaggacctgttcatgttcgccgcgacatgtcgccgctggcttagctgcttcaccgaccggacattcctccgggagctcctgtgtccaggccagggccagggccagagccagagcctccttggcttcttcttgcaggacgccaggcaaggcgcgacgatggcgacgacgcggacggaagcggcgcggcagctggcctcggcctgctccttcctgccggcgcctgggtcgcctctcgcgcctggccccacggctcgtgccctcacctcctccttggtcgccgacggcgacggtgccttcgactacgccgtgcccctggcggcgcgccgtggcatcgtcctcatgcagtgtgtcccgcgccgccgcgacacccacctcctcctcggcgtctgcaaccccgtcacgggcgaacgccacctcctcgcacctttgcgcaggaaccctactcgcgtctgcggctacgccatcatcacagccgccgacgccgacgccgacgccgccggccgcttcaccttctcgcagctgctcgttgccatcgtacagccctccgactgggtggtgcacctccactcgtactccgccgccacgcgcagctggagcgcgccgaccgtatgcgtggtgaactgccgctgcttctccctgcggggccagagatccgccgtcgttcaccagggcgcggcacactggctctaccacacgagtggcctgtacgacgatggtggccagcgcgccctgccggcatcccgagatgatggcagcctcttcatgctcagcgtgcagctgggaggaggagcagcagcagcaggcggcatcggctttgcctttacacggatcccggtccgcgtgggaggcatcagcacgctcctgtgcgtcaccggagacggcaaccttgcggtcgtctgcgggtatatgtcgcacgtggctgtttccacttgtcgtgagcaacggcaagccggcggcggcggcggcgggcaggcgtgggagcgcaccgccttcaagataccagcggcggtgccctacccagacacggcaccgatgtggcagcccaaggagaagtggtttgacttgaccagggggtcaatgctcgtgctctacaggagcagcgccgtcttcatcgtcgaccttcacagcaagaccatggaaaaggtcatggactgcttcctgcccctgttcgcggatcaaatgaaacggacggctgtgccctacgagatggacttggttgacttcttcatgcttaagcttggtggtctaagctctacacgatcatcaggataa

SEQ ID NO: 11080 - protein, 462 aa, Sorghum bicolor
  misc_feature: Ceres ANNOT ID no. 6119727
  misc_feature (19)..(67): Pfam Id: F-box Pfam Desc: F-box domain
  misc_feature (24)..(242): NCBI GI: 115475259 NCBI Desc: os08g0203800 [oryza sativa (japonica cultivar-group)]
MAEDAVAAKRRRRCTGGGGDMVALPEHVLQEILSRVGTVKDLFMFAATCRRWLSCFTDRTFLRELLCPGQGQGQSQSLLGFFLQDARQGATMATTRTEAARQLASACSFLPAPGSPLAPGPTARALTSSLVADGDGAFDYAVPLAARRGIVLMQCVPRRRDTHLLLGVCNPVTGERHLLAPLRRNPTRVCGYAIITAADADADAAGRFTFSQLLVAIVQPSDWVVHLHSYSAATRSWSAPTVCVVNCRCFSLRGQRSAVVHQGAAHWLYHTSGLYDDGGQRALPASRDDGSLFMLSVQLGGGAAAAGGIGFAFTRIPVRVGGISTLLCVTGDGNLAVVCGYMSHVAVSTCREQRQAGGGGGGQAWERTAFKIPAAVPYPDTAPMWQPKEKWFDLTRGSMLVLYRSSAVFIVDLHSKTMEKVMDCFLPLFADQMKRTAVPYEMDLVDFFMLKLGGLSSTRSSG

SEQ ID NO: 11081 - DNA, 1200 bp, Sorghum bicolor
  misc_feature: Ceres ANNOT ID no. 6119745
  misc_feature: Encodes the peptide sequence at SEQ ID NO 11082
atggggagcgcaccggccaccgtccaagagatgaggcgtgcgcagcgcgcggatgggccggccgccgtgctcggcatcggcacggcgaacccgccgacgtgcttagcgcaggacgactaccccgactactacttccgcgtcaccaacagcgagcacctgaccgacctcaagggcaagctcaccaggatctgcaacaagtcaggcatcaagcagcgctacatccacctcaacgaggacctgctcgccgccaacccggacttcaccgaccgcacgcgcccgtccctggacgcgcgcgtggacatcgcctccgccgccgtcccggagctggccgcggccgccgcggccaaggccatcgccgagtggggccgcccggccaccgacatcacccacctcgtcttcagcacctactccggcgcgcgcgccccgagcgccgaccgccgcctcgcgtccctgctgggcctccgccccacggtgtcgcgcaccatcctcaacctccacggctgctacggcggcggccggtcgctccagctcgccaaggagctcgccgagaacaaccgcggcgcgcgcgtcctcgtcgcctgctctgagatcacgctcatcgccttctacggccccgaaggaggctgcgccgacaacatcctcggccaggctctgttcggcgacggcgctggcgccgtcatcgtcggcgccgaccccgtcgcccccgtcgagcgcccgctgtacgagatggccttcgcctcacagaccacgataccggagacggaggacgccatctccatgcagatcaacaaaggtggcatggagtaccacatctccaaccaggtgccccgtctgctggggtgcaacgtggaacgttgccttgtcgacgcctttcgcgcgctcggtgttagcgctgcgtggaacgaccttttctgggcgattcaccctggcggccgtgccattctggaccacatcgagggagtgctcggcctggacgacaccaaactggcggcgagtcgccatgtgctcagtgagtttggcaacatgagcggcaccacggtgatcttcgtgctcgatgagttgcgccgccgtcgggcagcgatggccaagcagggaggggaagcgccggagtggggagtgatgatggcttttggaccaggaatcacaattgagaccatggtgctccacgcccctagcaaccttgacctgaagggaaattaa

SEQ ID NO: 11082 - protein, 399 aa, Sorghum bicolor
  misc_feature: Ceres ANNOT ID no. 6119745
  misc_feature (6)..(232): Pfam Id: Chal_sti_synt_N Pfam Desc: Chalcone and stilbene synthases, N-terminal domain
  misc_feature (242)..(392): Pfam Id: Chal_sti_synt_C Pfam Desc: Chalcone and stilbene synthases, C-terminal domain
  misc_feature (291)..(390): Pfam Id: ACP_syn_III_C Pfam Desc: 3-Oxoacyl-[acyl-carrier-protein (ACP)] synthase III C terminal
  misc_feature (1)..(399): NCBI GI: 115472461 NCBI Desc: os07g0525900 [oryza sativa (japonica cultivar-group)]
  misc_feature (1)..(390): NCBI GI: 17978544 NCBI Desc: chalcone synthase 8 [sorghum bicolor]
  misc_feature (3)..(390): NCBI GI: 82654929 NCBI Desc: chalcone synthase (naregenin-chalcone synthase)
  misc_feature (4)..(393): NCBI GI: 5732950 NCBI Desc: chalcone synthase [lilium hybrid cv. 'acapulco']
  misc_feature (1)..(390): NCBI GI: 5305911 NCBI Desc: chalcone synthase 3 [sorghum bicolor]
  misc_feature (1)..(390): SWISSPROT Homolog: EC 2.3.1.74 Chalcone synthase C2
  misc_feature (6)..(390): SWISSPROT Homolog: EC 2.3.1.95 Stilbene synthase 2
  misc_feature (4)..(394): SWISSPROT Homolog: EC 2.3.1.156 Phloroisovalerophenone synthase
  misc_feature: The sequence is a functional homolog of SEQ ID NO 2 in US patent 7202397
MGSAPATVQEMRRAQRADGPAAVLGIGTANPPTCLAQDDYPDYYFRVTNSEHLTDLKGKLTRICNKSGIKQRYIHLNEDLLAANPDFTDRTRPSLDARVDIASAAVPELAAAAAAKAIAEWGRPATDITHLVFSTYSGARAPSADRRLASLLGLRPTVSRTILNLHGCYGGGRSLQLAKELAENNRGARVLVACSEITLIAFYGPEGGCADNILGQALFGDGAGAVIVGADPVAPVERPLYEMAFASQTTIPETEDAISMQINKGGMEYHISNQVPRLLGCNVERCLVDAFRALGVSAAWNDLFWAIHPGGRAILDHIEGVLGLDDTKLAASRHVLSEFGNMSGTTVIFVLDELRRRRAAMAKQGGEAPEWGVMMAFGPGITIETMVLHAPSNLDLKGN

SEQ ID NO: 11083 - DNA, 2448 bp, Sorghum bicolor
  misc_feature: Ceres ANNOT ID no. 6119750
  misc_feature: Encodes the peptide sequence at SEQ ID NO 11084
  misc_feature: Up-regulated in root tissues in response to methyl jasmonate treatment
  misc_feature: Up-regulated in shoot tissues in response to methyl jasmonate treatment
atggacggcaacggcaactccccgcggccgcctccgcgccggccggagcgggaggggagctacaacaactacgacatcgagagcatggacggcggctccggggccgcgccgccgccgtggcgccagcacaacaacggctcctccgaggccctgctccgctacgacgacggcggcgccgaccgcgggagcgaggcgcgccagccgctgctgaggaagcgcaccatgaacaccacctcccagatcgctatcgtcggcgccaacgtctgccccatcgagagcttggattacgaagtcgtggagaatgaccttttcaaacaagactggcgatcaagaaagaagaagcagatatttcagtacattgtcctcaagtggagcttggtgctccttattggcctattaactggagttgttggcttcttcaacaatcttgcggttgagaacattgctggattcaaattgctgctcacgagtgatcttatgctcaaggggaggtatattggagcattttttgtgtatggtggttggaatttagtcttggctgcagcagcagcagcaatctgtgcttatattgcacctgctgctgctgggtctggtattcctgaagttaaagcatatcttaatggggtcgatgcctattctatattagctcctagtacactctttgttaagatttttggttcaatacttggagtttcagctggatttgtgctaggaaaggaagggcccatggtacatacaggggcatgtattgccaacttgctcggtcagggtggatcacgcaagtatcatcttacttgtaactggctacgatactttaagaatgacagggataggagagatttgatcacatgtggatctgcagctggtgtggcagctgccttccgtgcacctgttggcggtgttctgtttgctcttgaagaagcagcatcatggtggcgaagtgctcttttgtggagaacattctttacaactgctgttgttgcggtggtattgaggggactgattgagttctgtcgcagtggaaaatgtggtctctttgggaaaggtggattgatcatgtttgatctcagttcaactgttgcaacctacagtactccggatctaattgcaattatagtccttgggataattggtggaatatttggaggcctcttcaactttttgttggacaagatcctccgagtttatagtattatcaacgagagaggtgctccattcaagatccttctcactataacaatatcaataatcacatcgatgtgttcctatggtcttccttggcttgcagcatgcactccatgccctgttgatgctgtggagcagtgtcctactgttggtcgctcgggcaattataagaacttccaatgcccgccagggcattacaatgatcttgcgtcactcttcttcaatacaaatgacgatgccatccgcaatctcttcagcaacggcacatcaactgagttccaaatgtcatctcttttcatcttcttcactgctatttactgccttggactagtgacttacggtgttgctgtcccatctggtctctttatccctgttattcttgctggagccacgtatgggcgcatagtgggaactcttcttggatccatatctgatcttgatcctggcctttttgcccttcttggcgcagcatcttttcttggtggaacaatgagaatgactgtgtcagtctgtgtgatccttctagagctcaccaatgatctccccatgctccctctactcatgcttgttcttctcatatccaaaaccatagcagataactttaacaagggagtttatgatcagatagtggtgatgaaaggcttgccattcatggaggctcatgctgaaccatacatgaggcacttggttgctggtgatgtggtgtctggcccactaataaccttttctggtgttgagaaagtggggaacattgttcatgcattgaggttaactggccacaatggttttcctgtggttgatgagccacccataacggaagccccggaactggttgggcttgtgactaggtctcatctattagttttgctgaacagcaagaatttcatgaaggaacggttcaaaactagtggtagctttgttctgcgaagatttggtgcatttgactttgccaaaccaggttcaggcaaaggtttgaaaattgaggatctggatttcactgatgaggagatggacatgtatgtggatctccacccgatcacaaatacatcaccttacacagtggttgagacaatgtcactagcaaaagcggcaatccttttccgggaactcgggttgaggcaccttttggttgtgccaaagacaccagacaggcctcccatagtcggcattctcacaaggcatgatttcatgcctgagcacattcacagtctgttcccgaacttgaatcctcacaagtaccattcagcatcaatggcaggttga

SEQ ID NO: 11084 - protein, 815 aa, Sorghum bicolor
  misc_feature: Ceres ANNOT ID no. 6119750
  misc_feature (178)..(595): Pfam Id: Voltage_CLC Pfam Desc: Voltage gated chloride channel
  misc_feature (628)..(796): Pfam Id: CBS Pfam Desc: CBS domain pair
  misc_feature (29)..(815): NCBI GI: 48374433 NCBI Desc: chloride channel [zea mays]
  misc_feature (13)..(815): NCBI GI: 46390910 NCBI Desc: chloride channel [oryza sativa (japonica cultivar-group)]
  misc_feature (62)..(815): NCBI GI: 21321024 NCBI Desc: chloride channel [oryza sativa (japonica cultivar-group)]
  misc_feature (1)..(803): NCBI GI: 21321022 NCBI Desc: chloride channel [oryza sativa (japonica cultivar-group)]
  misc_feature (13)..(735): NCBI GI: 21321026 NCBI Desc: chloride channel [oryza sativa (japonica cultivar-group)]
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 506 in the 11/188,298 US application
MDGNGNSPRPPPRRPEREGSYNNYDIESMDGGSGAAPPPWRQHNNGSSEALLRYDDGGADRGSEARQPLLRKRTMNTTSQIAIVGANVCPIESLDYEVVENDLFKQDWRSRKKKQIFQYIVLKWSLVLLIGLLTGVVGFFNNLAVENIAGFKLLLTSDLMLKGRYIGAFFVYGGWNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGKGGLIMFDLSSTVATYSTPDLIAIIVLGIIGGIFGGLFNFLLDKILRVYSIINERGAPFKILLTITISIITSMCSYGLPWLAACTPCPVDAVEQCPTVGRSGNYKNFQCPPGHYNDLASLFFNTNDDAIRNLFSNGTSTEFQMSSLFIFFTAIYCLGLVTYGVAVPSGLFIPVILAGATYGRIVGTLLGSISDLDPGLFALLGAASFLGGTMRMTVSVCVILLELTNDLPMLPLLMLVLLISKTIADNFNKGVYDQIVVMKGLPFMEAHAEPYMRHLVAGDVVSGPLITFSGVEKVGNIVHALRLTGHNGFPVVDEPPITEAPELVGLVTRSHLLVLLNSKNFMKERFKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 11085 - DNA, 1545 bp, Sorghum bicolor
  misc_feature: Ceres ANNOT ID no. 6119751
  misc_feature: Encodes the peptide sequence at SEQ ID NO 11086
atgtggtcttcgagccaggcgagcacgaggggcgtggtggagatggggagagtggaggccgggccgtcgcatttccccaagaggcccgcgccccggaattccgccagggtcaatctatcaaggacagttaaaccttgctcagctggcgaccgcccaggaatttctgttaactgcaacttggggtggtcttctcaaacatcgcctgacttgagtcagcactttagaggatattcatcagcatcagaggcagttcttactgcccaatcagatttgagaaaacttttggttggcaatgagaaaatcggtgttctcttgctgaatcttgggggcccagagactcttgatgatgtgcagcctttcttgtttaatctttttgcagatccggacattatccgtcttcctaggctctttcgctttctgcagaagccacttgcaaaattcatatcggtagtgagagcaccaaagagtaaggaaggttatgcatccataggtggcggttctcctctccgacaaattactgacgcacaggctgaagcactaagggaggcattatgtggaaaagatgttcctgccaaggtgtatgttggaatgcggtattggcatcccttcactgaagaagccatagaacaaataaaacgggatggtatcacgaaacttgttgtgttgcctctataccctcagttctccatatcaactagtggttcaagtctccgtttattggagagcatattcagagaggatgaatatctcgtgaatatgcaacatacagttataccttcctggtatcaacgtgaaggatatatcaagtctatggcaactttgattgagaacgaactgacaaaatttccagtaccccaaaaggttatgatatttttcagtgctcacggagttcctctggcatatgttgaagaagaagctggtgatccatataaagcagaaatggaagagtgtgtcgatcttatcatggaagaactggaaaaaagaggaataacaaatccgtgcacacttgcttatcagagtcgagttggaccagtggaatggctgaaaccgtacactgatgagacaattattgagcttgggcagaaaggggtaaagagcctgcttgctgttcccattagttttgtcagcgaacacattgaaactttggaagaaatcgatgtggagtacaaagagttggctttagaatctggcatcaagcactggggacgagttccagcattaggttgcgaacccacattcatttcggatcttgctgatgctgttattgaaagcctaccttatgttggcgcaatggcagtttccaatcttgaggctcggcagtctctcgtacccctcgggagcgtggaggagctgctagcagcatacgactcgaagcgcgatgagctcccccctccggtgatcgtgtgggagtggggctggacgaagagcgcagagacctggaatggccgcgcagcgatgctggccgtgctggctctcctggtgctggaagtgaccaccggcgaagggttcctgcatcaatggggaatcctgccccggctccactga

SEQ ID NO: 11086 - protein, 514 aa, Sorghum bicolor
  misc_feature: Ceres ANNOT ID no. 6119751
  misc_feature (100)..(425): Pfam Id: Ferrochelatase Pfam Desc: Ferrochelatase
  misc_feature (1)..(514): NCBI GI: 94730389 NCBI Desc: ferrochelatase-2, chloroplast precursor (ferrochelatase ii) (protoheme ferro-lyase 2) (heme synthetase 2)
  misc_feature (33)..(514): NCBI GI: 2429618 NCBI Desc: ferrochelatase [oryza sativa]
  misc_feature (95)..(514): NCBI GI: 12082085 NCBI Desc: ferrochelatase [cucumis sativus]
  misc_feature (95)..(511): NCBI GI: 15147828 NCBI Desc: ferrochelatase [nicotiana tabacum]
  misc_feature (80)..(513): NCBI GI: 2623990 NCBI Desc: ferrochelatase [arabidopsis thaliana]
  misc_feature (1)..(514): SWISSPROT Homolog: EC 4.99.1.1 Ferrochelatase-2, chloroplast precursor
MWSSSQASTRGVVEMGRVEAGPSHFPKRPAPRNSARVNLSRTVKPCSAGDRPGISVNCNLGWSSQTSPDLSQHFRGYSSASEAVLTAQSDLRKLLVGNEKIGVLLLNLGGPETLDDVQPFLFNLFADPDIIRLPRLFRFLQKPLAKFISVVRAPKSKEGYASIGGGSPLRQITDAQAEALREALCGKDVPAKVYVGMRYWHPFTEEAIEQIKRDGITKLVVLPLYPQFSISTSGSSLRLLESIFREDEYLVNMQHTVIPSWYQREGYIKSMATLIENELTKFPVPQKVMIFFSAHGVPLAYVEEEAGDPYKAEMEECVDLIMEELEKRGITNPCTLAYQSRVGPVEWLKPYTDETIIELGQKGVKSLLAVPISFVSEHIETLEEIDVEYKELALESGIKHWGRVPALGCEPTFISDLADAVIESLPYVGAMAVSNLEARQSLVPLGSVEELLAAYDSKRDELPPPVIVWEWGWTKSAETWNGRAAMLAVLALLVLEVTTGEGFLHQWGILPRLH

SEQ ID NO: 11087 - DNA, 603 bp, Sorghum bicolor
  misc_feature: Ceres ANNOT ID no. 6119756
  misc_feature: Encodes the peptide sequence at SEQ ID NO 11088
atggagaaccaccacctgcagcagcagcagcagcagcagcagcagccggccgccgccgcgactgcgagctccccgcagtaccggggcgtgaggcggcggaagtggggcaagtgggtgtcggagatccgtcagccggggaccaaggtccgcgtgtggctcggcagcttcgactccgccgaggccgcggccgtggcgcacgacgtggcggcgctgtgcctgcgcggcccgcgggacgcgcagctcaacttcccgggctccgcggggtggctgccccgcccgcccagcaccgacccagccgacatccgcgccgccgcggctgaggcggccgagcgcgtgcgccgcgagccggcgcttgtcggtacttccgccgccgccgccgccgagcccggcgccggcagcagggtccacgccgccagtgccagccgccttgacctggccgtgggcgacgagtttgacgacgacctcgcgtcgcccaggctgtggaccgagatggcagaggccatgctgctggacccacccaagtggggcccggatggcagcgacggttccgacggctctggctcccagcattggccccaggggtctctgtgggatgcatgctag

SEQ ID NO: 11088 - protein, 200 aa, Sorghum bicolor
  misc_feature: Ceres ANNOT ID no. 6119756
  misc_feature (25)..(76): Pfam Id: AP2 Pfam Desc: AP2 domain
  misc_feature (17)..(200): NCBI GI: 21742878 NCBI Desc: osjnba0058g03.2 [oryza sativa (japonica cultivar-group)]
  misc_feature (17)..(129): NCBI GI: 38605844 NCBI Desc: osjnbb0034g17.2 [oryza sativa (japonica cultivar-group)]
  misc_feature (25)..(169): NCBI GI: 60593399 NCBI Desc: tmcbf7 [triticum monococcum]
  misc_feature (25)..(179): NCBI GI: 89258594 NCBI Desc: dreb1-like transcription factor [gossypium hirsutum]
  misc_feature (25)..(197): NCBI GI: 77744832 NCBI Desc: ap2/erebp transcription factor [arabidopsis thaliana]
  misc_feature: The plant flowers significantly late compared to wild-type.
  misc_feature: The plant is abnormally large.
  misc_feature: The sequence is a functional homolog of SEQ ID NO 1222 in the 10/374,780US patent application
  misc_feature: The sequence is a functional homolog of SEQ ID NO 1224 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1314 in the 11/479,226US patent application
  misc_feature: The sequence is a functional homolog of SEQ ID NO 1411 in the 10/412,699US patent application
  misc_feature: The sequence is a functional homolog of SEQ ID NO 1413 in the 10/412,699US patent application
  misc_feature: The sequence is a functional homolog of SEQ ID NO 16 in the 10/225,068US patent application
  misc_feature: The sequence is a functional homolog of SEQ ID NO 164 in the 11/375,241US patent application
  misc_feature: The sequence is a functional homolog of SEQ ID NO 176 in the 11/375,241US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 2233 in the 10/666,642US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 616 in the 10/412,699US patent application
  misc_feature: The sequence is a functional homolog of SEQ ID NO 706 in the 11/435,388US patent application
  misc_feature: The sequence is a functional homolog of SEQ ID NO 710 in the 11/435,388US patent application
  misc_feature: The sequence is a functional homolog of SEQ ID NO 712 in the 11/435,388US patent application
  misc_feature: The sequence is a functional homolog of SEQ ID NO 718 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 802 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: Useful for making plants with modulated salt sensitivity
  misc_feature: Functional homolog of the protein sequence given in SEQ ID NO 13265
  misc_feature: Functional homolog of the protein sequence given in SEQ ID NO 13273
  misc_feature: The sequence is a functional homolog of SEQ ID NO 1411 in the 20040045049 US patent application
  misc_feature: The sequence is a functional homolog of SEQ ID NO 1413 in the 20040045049 US patent application
  misc_feature: The sequence is a functional homolog of SEQ ID NO 616 in the 20040045049 US patent application
  misc_feature: The sequence is a functional homolog of SEQ ID NO 96 in the 20060015972 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 176 in the 20060195944 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
MENHHLQQQQQQQQQPAAAATASSPQYRGVRRRKWGKWVSEIRQPGTKVRVWLGSFDSAEAAAVAHDVAALCLRGPRDAQLNFPGSAGWLPRPPSTDPADIRAAAAEAAERVRREPALVGTSAAAAAEPGAGSRVHAASASRLDLAVGDEFDDDLASPRLWTEMAEAMLLDPPKWGPDGSDGSDGSGSQHWPQGSLWDAC

SEQ ID NO: 11089 - DNA, 1098 bp, Sorghum bicolor
  misc_feature: Ceres ANNOT ID no. 6119762
  misc_feature: Encodes the peptide sequence at SEQ ID NO 11090
atgctacttaaatctgcaatgctgccgttagactacaccaccaccagctggccgccgcaccgcaagaaccaagccttgtctcggcccaaggcgatgccgtccaagtgggacgacgcgcagaaatggctggtgggcatgtcgaacggcggcggccgcgcggacggaggaacccacggcggcggcggcgccagggtgaagcccaggaactcgaacgccgacgatcggcgcctcctcggctcgtcctcgcagaacggccgtgtgtcctgcagcagcgtggacggcgccttggagtacaacagcatggtggtggccgcgcccgcgccctcgacgccgccgcggcagaccggcggcgagggcgacgacgacgacgtggaggagaccaagaagatcgactgcatggtgcagcagcagcatgggcatgggcatgggcatggctcgccgcacaaggcggtggtgatgaggtccgtgtgcctgcgggacatggggacagagatgacccccatcgccagcaaggagccgtccaggacggccacgccgctgcgtgcctccacgcctgttgcccggagcccaatatcatcgaggtcgtccaccccagcgagaagacgccaggaagggcccgtgggcgtgaccaccgccgccattgtagggacgacgaccgagcaggtagcggcagcaggcgaggtcggctgtgtcggcgaggagcgcaccgtggttggtcatggtcatgcccccagcgtgaactcgctggagtcccgcgcggcagcctgggatgaggctgaacgggccaagttcatggcgaggtataaacgtgaagaggtaaagatacaggcatgggagaaccatgagaagagaaaagctgagacgaagatgaagaaaatgcagatgaaggccgatcagatgaaatcacgggctcaagagaagctgtccagccggctggcgacgacgcatcggatggccgaggagaagcgggcgagcgccgaggcgaagctcaatgagcgtgcggcgaggacatcggagaaggccaactacatcaggaggacagggcacctgccgtcgtccttcaagatctcttgcttgtgcggctcaagctttgagtga

SEQ ID NO: 11090 - protein, 365 aa, Sorghum bicolor
  misc_feature: Ceres ANNOT ID no. 6119762
  misc_feature (244)..(355): Pfam Id: Remorin_C Pfam Desc: Remorin, C-terminal region
  misc_feature (126)..(305): NCBI GI: 79320867 NCBI Desc: dna binding [arabidopsis thaliana]
  misc_feature (45)..(360): NCBI GI: 47848302 NCBI Desc: remorin-like protein [oryza sativa (japonica cultivar-group)]
  misc_feature (165)..(358): NCBI GI: 38344336 NCBI Desc: osjnba0058k23.18 [oryza sativa (japonica cultivar-group)]
  misc_feature (165)..(358): NCBI GI: 116309948 NCBI Desc: h0714h04.6 [oryza sativa (indica cultivar-group)]
  misc_feature (165)..(358): NCBI GI: 115460610 NCBI Desc: os04g0620200 [oryza sativa (japonica cultivar-group)]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
MLLKSAMLPLDYTTTSWPPHRKNQALSRPKAMPSKWDDAQKWLVGMSNGGGRADGGTHGGGGARVKPRNSNADDRRLLGSSSQNGRVSCSSVDGALEYNSMVVAAPAPSTPPRQTGGEGDDDDVEETKKIDCMVQQQHGHGHGHGSPHKAVVMRSVCLRDMGTEMTPIASKEPSRTATPLRASTPVARSPISSRSSTPARRRQEGPVGVTTAAIVGTTTEQVAAAGEVGCVGEERTVVGHGHAPSVNSLESRAAAWDEAERAKFMARYKREEVKIQAWENHEKRKAETKMKKMQMKADQMKSRAQEKLSSRLATTHRMAEEKRASAEAKLNERAARTSEKANYIRRTGHLPSSFKISCLCGSSFE

SEQ ID NO: 11091 - DNA, 1425 bp, Sorghum bicolor
  misc_feature: Ceres ANNOT ID no. 6119831
  misc_feature: Encodes the peptide sequence at SEQ ID NO 11092
atggccggaggcggcgacgatgcagaggagataacgctggagcacacgcccacgtggatcgtcgcctccgtatgttccatcatcgtcgtcatctccctgctcttcgagcgactgctccacctcctcggcaagaggctaacaaaagggcgccggaagccactgtacgaagccctcctcaaggtcaaagaagagctgatgctgctggggttcatctccctgctgctcaccgtgttccagggcaccacgcagaagatatgcgtccaggagagcgtgatgcgccacctcctgccctgctcgctccccgccgacgacaaggtcaccgcgcacttcatgatcgccggcggcggcacgaggaggctcctcgccggaggaggcgcctccagtgactactgcctcaagggcaaagttccaattctttcggtagaagctattcatcagttacacatatttatcttcgtcttggcagtcacgcatgtggttctcagtgctgttacagttattcttggaatcacacagacaagaaactggaaatattgggaggacaagatccagcaaaacaatgatagtgctcctcaaatgatcaaacatgtgcaagaattccaatttatcaaaagtcacttcagaggtcatggaaaaagatggggaatattcggttggctgcgctctttttttaaacaattctatgggtcagtcactgaggaggactacacaaccctacgacttggttttgttatgaaacactgcagggggcatccaaaattcaacttttacaattatatgaatagagcattggaagtggatttcaagaaagtcgttggcataagctggtacctttgggctatgctaatgatattcttgctactcaatgttcatggatggtacgtctacatttggctatcagtagccccattcattttgctacttgtgctcggaagtaagatggagcatattatcacggagttggctcttgaggttgcccaaaaacatacggcaatagaaggggttctagttgtaactccttcggatgaactcttttggttccatcggcctaaactagttcttctcttgattcatatcatcttgttccaaaatgcatttgaaattgcactcttcttctggttgctggtcacgtatgggtttaattcttgcattatgggagaaccagcatatgctattattcgtgtggtgataagcaccctacctctctacgctcttatctcccaaatgggaagttcttttaagaaggccattttcgatgaaaatatctccgaaggcctcaccaactgggcagaaaatgctaggaggcgtaatagaatggcaacaacaagtgtcagtgacaattcacctattggtgagggaattcaaatgtcaaataaggcacagagagaatcagcaatggaacaaggaactgcaaggttgatctaa

SEQ ID NO: 11092 - protein, 474 aa, Sorghum bicolor
  misc_feature: Ceres ANNOT ID no. 6119831
  misc_feature (8)..(463): Pfam Id: Mlo Pfam Desc: Mlo family
  misc_feature (1)..(474): NCBI GI: 46405143 NCBI Desc: mlo3 [hordeum vulgare subsp. vulgare]
  misc_feature (1)..(444): NCBI GI: 14091600 NCBI Desc: membrane protein mlo15 [arabidopsis thaliana]
  misc_feature (1)..(444): NCBI GI: 42571225 NCBI Desc: seven transmembrane mlo family protein / mlo-like protein 15 (mlo15) [arabidopsis thaliana]
  misc_feature (8)..(451): NCBI GI: 13784979 NCBI Desc: seven transmembrane protein mlo3 [zea mays]
  misc_feature (7)..(448): NCBI GI: 13784989 NCBI Desc: seven transmembrane protein mlo8 [zea mays]
  misc_feature: Useful for making plants with modulated biotic stress sensitivity
  misc_feature: GREAT-hit functional homolog of the protein sequence given in SEQ ID NO 13417
  misc_feature: Useful for making plants with modulated biotic stress sensitivity
  misc_feature: Functional homolog of the protein sequence given in SEQ ID NO 13615
MAGGGDDAEEITLEHTPTWIVASVCSIIVVISLLFERLLHLLGKRLTKGRRKPLYEALLKVKEELMLLGFISLLLTVFQGTTQKICVQESVMRHLLPCSLPADDKVTAHFMIAGGGTRRLLAGGGASSDYCLKGKVPILSVEAIHQLHIFIFVLAVTHVVLSAVTVILGITQTRNWKYWEDKIQQNNDSAPQMIKHVQEFQFIKSHFRGHGKRWGIFGWLRSFFKQFYGSVTEEDYTTLRLGFVMKHCRGHPKFNFYNYMNRALEVDFKKVVGISWYLWAMLMIFLLLNVHGWYVYIWLSVAPFILLLVLGSKMEHIITELALEVAQKHTAIEGVLVVTPSDELFWFHRPKLVLLLIHIILFQNAFEIALFFWLLVTYGFNSCIMGEPAYAIIRVVISTLPLYALISQMGSSFKKAIFDENISEGLTNWAENARRRNRMATTSVSDNSPIGEGIQMSNKAQRESAMEQGTARLI

SEQ ID NO: 11093 - DNA, 888 bp, Sorghum bicolor
  misc_feature: Ceres ANNOT ID no. 6119835
  misc_feature: Encodes the peptide sequence at SEQ ID NO 11094
atggaggtggggttcctgggtctaggcatcatgggcaaggcaatggcggccaacctcctccgccacggcttccgcgtcaccgtctggaaccggaccctcgccaagtgccaagagctcgccgcgctcggcgccaccgtcggggagacgcccgcctccgtcgtctccaagtgcagatacaccatcgccatgctctccgaccctagcgccgcactatcagttgtcttcgacaaggatggcgtgctcgagcagatcggtagcgggaagggctatgtggacatgtccactgttgacgctgcaacttcgaccaagattagcgaggcagttaaacaaaaagggggagctttccttgaagctccagtttcagggagcaagaagccagctgaagatggtcaattggtcattcttgctgcaggggacaagccattgtatgacggtatggttcctgcatttgatgtactggggaagaagtcattctttctgggagagattggaaatggggcaaagatgaagcttgtggtcaacatgatcatgggaagtatgatgaatgctttgtccgagggactttgtttggccgacaaaagtgggttgagcccccaaacacttctcgatgtactggaccttggtgccatcgcaaacccaatgttcaagttgaaggggcctacaatgctgcaaggcagctacaaccctgcgtttcccctgaaacatcagcagaaggacatgaggttagctcttgctctgggagatgagaacgccgtcgctatgcccgtctcagcagctgccaatgaggcgttcaagaaggcgagaagcctggggctgggggaccaggatttttcggcggtctatgaggtagtgaagggcgcgggtggttctgggtctggccaggcgtga

SEQ ID NO: 11094 - protein, 295 aa, Sorghum bicolor
  misc_feature: Ceres ANNOT ID no. 6119835
  misc_feature (1)..(162): Pfam Id: NAD_binding_2 Pfam Desc: NAD binding domain of 6-phosphogluconate dehydrogenase
  misc_feature (1)..(285): NCBI GI: 15375068 NCBI Desc: gamma hydroxybutyrate dehydrogenase [arabidopsis thaliana]
  misc_feature (1)..(285): NCBI GI: 9279732 NCBI Desc: dehydrogenase-like protein [arabidopsis thaliana]
  misc_feature (1)..(285): NCBI GI: 79313434 NCBI Desc: 3-hydroxyisobutyrate dehydrogenase/ phosphogluconate dehydrogenase (decarboxylating) [arabidopsis thaliana]
  misc_feature (2)..(284): NCBI GI: 145617990 NCBI Desc: 3-hydroxyisobutyrate dehydrogenase [geobacter bemidjiensis bem]
  misc_feature (4)..(285): NCBI GI: 146396167 NCBI Desc: 2-hydroxy-3-oxopropionate reductase [geobacter uraniumreducens rf4]
  misc_feature: The sequence is a functional homolog of SEQ ID NO. 352 in the 11/188,298 US application
MEVGFLGLGIMGKAMAANLLRHGFRVTVWNRTLAKCQELAALGATVGETPASVVSKCRYTIAMLSDPSAALSVVFDKDGVLEQIGSGKGYVDMSTVDAATSTKISEAVKQKGGAFLEAPVSGSKKPAEDGQLVILAAGDKPLYDGMVPAFDVLGKKSFFLGEIGNGAKMKLVVNMIMGSMMNALSEGLCLADKSGLSPQTLLDVLDLGAIANPMFKLKGPTMLQGSYNPAFPLKHQQKDMRLALALGDENAVAMPVSAAANEAFKKARSLGLGDQDFSAVYEVVKGAGGSGSGQA

SEQ ID NO: 11095 - DNA, 1155 bp, Sorghum bicolor
  misc_feature: Ceres ANNOT ID no. 6119838
  misc_feature: Encodes the peptide sequence at SEQ ID NO 11096
atggcgatggaagcagaggaagacagaggtgggctggagggggagctcatcccggggctgcccgacgacgtggccatggagtgcctggcgcgggtgccgagccggtcgcaccggcgcatgcgccgcgtgtgccgcggatggcgcggcaccgtcggctcagccgagttccggcgccgccggagggccgccggagcctcggaggacatcgtgttcctcgtccagaccgcgcccgcgcgcggcgacgggaaggggtcgacgccggaatgcgcgctggtggcggcgaacctcaccaccggcgagtggcggcgcgtcgagggacacgacgagggctggggacccgtcccgctcttcgcgcagtgcgcggcggccggcgacgggcggcatgtcgccatcgtggggggctgggacccggacacgctccgcccgacccgcgacgtccggttgctggacgtccccgccggcacgtggcggcgcggcccgaggacgccggacagccggagcttctttgggtgcgctggcggcgacggcaacgtctacatcgccggcggccacgacgagtgcaagaacgcgctccgctccgccttcgcgtacagcgtcgcgggcgcgggcgcggccgacgccgcctggcgcgcgctcccggacatgtccgaggagcgcgacgagccgcagctcgtggtcgtggcgacaccgggccgccgcgtcctcctcgccgccagcggatacccgaccgaggcccagggcgcgttcaggagcaccgccgagtgctaccacgacgccggaggcgacgcgtggaccagcgagggcgacgtgatccccgacggcggcgacacggccgggaagacgtgcctggcgtcggtgcgcgggacggtgtgggccgtcggggccgggaaggacggcgtgcgggaatgggacggcgccgcgcgcgcgtggagggacgtggccgacgggccgccgggcatgaaggcctgcgtgaaggcggttggcgttggcaacggcgaggccgtgttcgtgttcggcacagtggccgacgcagcggcggacggcgtcaagtattctgcggcggtgatggaagcgagcggcggtgcatggatgcgagtgcccgtgccgtcagagttcggcgggttcgtttactcagccgcggccgtgtctatttag

SEQ ID NO: 11096 - protein, 384 aa, Sorghum bicolor
  misc_feature: Ceres ANNOT ID no. 6119838
  misc_feature (165)..(216): Pfam Id: Kelch_1 Pfam Desc: Kelch motif
  misc_feature (15)..(62): Pfam Id: F-box Pfam Desc: F-box domain
  misc_feature (15)..(374): NCBI GI: 46390144 NCBI Desc: kelch repeat-containing f-box family protein-like [oryza sativa (japonica cultivar-group)]
  misc_feature (13)..(384): NCBI GI: 49387909 NCBI Desc: kelch repeat-containing f-box-like [oryza sativa (japonica cultivar-group)]
  misc_feature (15)..(384): NCBI GI: 50725654 NCBI Desc: kelch repeat-containing f-box-like [oryza sativa (japonica cultivar-group)]
  misc_feature (15)..(310): NCBI GI: 92868693 NCBI Desc: cyclin-like f-box; serine/threonine protein phosphatase, bsu1 [medicago truncatula]
  misc_feature (10)..(183): NCBI GI: 115444911 NCBI Desc: os02g0202900 [oryza sativa (japonica cultivar-group)]
MAMEAEEDRGGLEGELIPGLPDDVAMECLARVPSRSHRRMRRVCRGWRGTVGSAEFRRRRRAAGASEDIVFLVQTAPARGDGKGSTPECALVAANLTTGEWRRVEGHDEGWGPVPLFAQCAAAGDGRHVAIVGGWDPDTLRPTRDVRLLDVPAGTWRRGPRTPDSRSFFGCAGGDGNVYIAGGHDECKNALRSAFAYSVAGAGAADAAWRALPDMSEERDEPQLVVVATPGRRVLLAASGYPTEAQGAFRSTAECYHDAGGDAWTSEGDVIPDGGDTAGKTCLASVRGTVWAVGAGKDGVREWDGAARAWRDVADGPPGMKACVKAVGVGNGEAVFVFGTVADAAADGVKYSAAVMEASGGAWMRVPVPSEFGGFVYSAAAVSI

SEQ ID NO: 11097 - DNA, 636 bp, Sorghum bicolor
  misc_feature: Ceres ANNOT ID no. 6119839
  misc_feature: Encodes the peptide sequence at SEQ ID NO 11098
atggcggaggcggaggcgacggcggggcgactgaggctgtactcgtactggcgcagctcgtgctcccaccgcgcccgcatcgctctcaatctcaaaggtgtggagtacgagtacaaggcggtgaaccttctcaagggcgagcagtctgatccagaatttgtcaagcttaatcctatgaagttcgtccctgcgttggttgatggcgattcttatttggaggacaagtaccctgagcctcctcttctacctcacgaccttcaaaagaaggctttgaatcaccagattgcaagcattgtagcttctggtattcaacctctccataacctcacagtgttgaggttcattgaccaaaaggttggtgcaggggagagtgtcttgtggactcaacaacaaatcgagagagctattgagagcctaatacaactaaaaggctgtgctgggaagtatgcgacaggagatgaagtccaactggcagatgtattccttgcaccccagatctatgcagccattgaacgcactaaaattgacatgtcaaattaccccattcttgctaggcttcactcggagtacatggcacaccctgcatttgaagcagcgctccctcgcaggcaaccagacgccccttcctcttcctag

SEQ ID NO: 11098 - protein, 211 aa, Sorghum bicolor
  misc_feature: Ceres ANNOT ID no. 6119839
  misc_feature (9)..(74): Pfam Id: GST_N Pfam Desc: Glutathione S-transferase, N-terminal domain
  misc_feature (103)..(194): Pfam Id: GST_C Pfam Desc: Glutathione S-transferase, C-terminal domain
  misc_feature (13)..(211): NCBI GI: 11385485 NCBI Desc: glutathione s-transferase gst 17 [zea mays]
  misc_feature (1)..(211): NCBI GI: 112385746 NCBI Desc: glutathione s-transferase 2 [oryza sativa (japonica cultivar-group)]
  misc_feature (1)..(140): NCBI GI: 46243593 NCBI Desc: glutathione s-transferase [oryza sativa (japonica cultivar-group)]
  misc_feature (69)..(211): NCBI GI: 20975738 NCBI Desc: glutathione s-transferase [oryza sativa (japonica cultivar-group)]
  misc_feature (4)..(207): NCBI GI: 11385465 NCBI Desc: glutathione s-transferase gst 25 [glycine max]
  misc_feature (10)..(211): SWISSPROT Homolog: EC 2.5.1.18 Glutathione S-transferase zeta-class 1
  misc_feature: The plant produces a reduced number of seeds.
  misc_feature: Useful for biocontainment applications
  misc_feature: GREAT-hit functional homolog of the protein sequence given in SEQ ID NO 12971
  misc_feature: Useful for biocontainment applications
  misc_feature: Functional homolog of the protein sequence given in SEQ ID NO 12971
MAEAEATAGRLRLYSYWRSSCSHRARIALNLKGVEYEYKAVNLLKGEQSDPEFVKLNPMKFVPALVDGDSYLEDKYPEPPLLPHDLQKKALNHQIASIVASGIQPLHNLTVLRFIDQKVGAGESVLWTQQQIERAIESLIQLKGCAGKYATGDEVQLADVFLAPQIYAAIERTKIDMSNYPILARLHSEYMAHPAFEAALPRRQPDAPSSS

SEQ ID NO: 11099 - DNA, 201 bp, Sorghum bicolor
  misc_feature: Ceres ANNOT ID no. 6119842
  misc_feature: Encodes the peptide sequence at SEQ ID NO 11100
atggcgagcggagggaagggactcaacgcgactggggagtttttccggcggagggacgagtggaggaggcacccgatggtggggaatcagctgcgccacgccacaccggggctcggcatcgctatcgtcgccttcgggatctacctcgtcggcgaggccgcctacaaccgcctctcccgcccctccggcgaccaccactag

SEQ ID NO: 11100 - protein, 66 aa, Sorghum bicolor
  misc_feature: Ceres ANNOT ID no. 6119842
  misc_feature: The plant flowers significantly late compared to wild-type.
  misc_feature: The plant senesces significantly earlier than wild-type.
  misc_feature: Useful for making plants with modulated flowering time
  misc_feature: Useful for making plants with modulated time to senescence
  misc_feature: GREAT-hit functional homolog of the protein sequence given in SEQ ID NO 13080
  misc_feature: GREAT-hit functional homolog of the protein sequence given in SEQ ID NO 13542
  misc_feature: Useful for making plants with modulated flowering time
  misc_feature: Functional homolog of the protein sequence given in SEQ ID NO 13080
  misc_feature: Useful for making plants with modulated time to senescence
  misc_feature: Functional homolog of the protein sequence given in SEQ ID NO 13542
MASGGKGLNATGEFFRRRDEWRRHPMVGNQLRHATPGLGIAIVAFGIYLVGEAAYNRLSRPSGDHH

SEQ ID NO: 11101 - DNA, 1197 bp, Sorghum bicolor
  misc_feature: Ceres ANNOT ID no. 6119857
  misc_feature: Encodes the peptide sequence at SEQ ID NO 11102
atggacgacgacggcgcggcctcccggtcgccgtcgcgctcgccgtcccggtcgccatcgcgctccccgtccccgctccccgtcgccgaccccgtcacggtcgccgccgcgccgcccggccacgtcgccgtcgctatcccgctccgcaagccttccccttcctcgggcggcggccgtgaggacgcgtggagcgacggcgccacctccacgctcatcgacgcctggggggagaggttcgtggcgctgggccgaggcagcctccggcacccgcagtggcaggaggtcgccgaggtggtctcctcccgcgacggctactccaaggcgcccaagtcggacgtgcagtgcaagaaccgcatcgacacgctcaagaagaagtacaagatcgagaaggccaagcacgactccgactggcgctacttcgaccgcctcgacgacctgctcgcccccgtgctcaagctcaattcctcctcctcctcctcggctgctgctgctgcggcggcggcggccgccgccgcagcccggagcgcggggcccatggtgccgccgcgcatcaacttcccgcagcgcacccgcacgccgctccattcctcggcggggggcaagcggaggatgccgccgtcgccgccgccgcagccgtcggcgtcgtccgactcctccgacgggttcccgccgtcttccggggtggcgaacgggaagaggctgcagcgcgtggaggagcccttggcggtggcggcggccaacggggaggtgtacgagcgcgtggagaacgccaggagggagcaggagctccggatggagcgggatcgcctggagtccgcgcggcagatggaggagcagcgcgtgcagttcttcctcaagatgcagatggaactctccaaggccgccatgggcggcggcgatgcggcagccaccaccgcgcccatggccatggccgtccccatccctgccgacggcaatggcacgcggagagctggcgtgaccgccgaggtcgccaccagcagcaatcaccgcgtccggtaccgcatcaaggccggcagcagcaggcaccaccaccctgccccgccgcagcaggcacattaccagaacagcacgagccccaccggtggcgacggcgatggtaacggcagcgactcggacaacaaggaagccgcacaggaagaggatgcggaagacgaggaggaggaagagagccagtga

SEQ ID NO: 11102 - protein, 398 aa, Sorghum bicolor
  misc_feature: Ceres ANNOT ID no. 6119857
  misc_feature (1)..(398): NCBI GI: 116310230 NCBI Desc: osigba0140o07.7 [oryza sativa (indica cultivar-group)]
  misc_feature (1)..(398): NCBI GI: 38344545 NCBI Desc: osjnba0027p08.13 [oryza sativa (japonica cultivar-group)]
  misc_feature (2)..(293): NCBI GI: 18149189 NCBI Desc: 6b-interacting protein 1 [nicotiana tabacum]
  misc_feature (6)..(149): NCBI GI: 15624003 NCBI Desc: p0480c01.17 [oryza sativa (japonica cultivar-group)]
  misc_feature (59)..(282): NCBI GI: 92898924 NCBI Desc: myb, dna-binding [medicago truncatula]
  misc_feature: The sequence is a functional homolog of SEQ ID NO 1781 in the 11/479,226US patent application
  misc_feature: The sequence is a functional homolog of SEQ ID NO 1844 in the 11/479,226US patent application
  misc_feature: The sequence is a functional homolog of SEQ ID NO 270 in the 10/374,780US patent application
  misc_feature: The sequence is a functional homolog of SEQ ID NO 2856 in the 10/374,780US patent application
  misc_feature: The sequence is a functional homolog of SEQ ID NO 298 in the 10/374,780US patent application
  misc_feature: The sequence is a functional homolog of SEQ ID NO 4 in the 10/225,066US patent application
  misc_feature: The sequence is a functional homolog of SEQ ID NO 46 in the 10/225,066US patent application
  misc_feature: The sequence is a functional homolog of SEQ ID NO 466 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 46 in the 20050160493 US patent application
  misc_feature: The sequence is a functional homolog of SEQ ID NO 466 in the 20050160493 US patent application
MDDDGAASRSPSRSPSRSPSRSPSPLPVADPVTVAAAPPGHVAVAIPLRKPSPSSGGGREDAWSDGATSTLIDAWGERFVALGRGSLRHPQWQEVAEVVSSRDGYSKAPKSDVQCKNRIDTLKKKYKIEKAKHDSDWRYFDRLDDLLAPVLKLNSSSSSSAAAAAAAAAAAAARSAGPMVPPRINFPQRTRTPLHSSAGGKRRMPPSPPPQPSASSDSSDGFPPSSGVANGKRLQRVEEPLAVAAANGEVYERVENARREQELRMERDRLESARQMEEQRVQFFLKMQMELSKAAMGGGDAAATTAPMAMAVPIPADGNGTRRAGVTAEVATSSNHRVRYRIKAGSSRHHHPAPPQQAHYQNSTSPTGGDGDGNGSDSDNKEAAQEEDAEDEEEEESQ

SEQ ID NO: 11103 - DNA, 1077 bp, Sorghum bicolor
  misc_feature: Ceres ANNOT ID no. 6119873
  misc_feature: Encodes the peptide sequence at SEQ ID NO 11104
atggcaagatcaccaagaggtaggaacctccaagctcgtcaacataggtcagcttcttcagatgtgcccttgtgctcctggaagacagaaggaacaaacaaaggaaatgatatgtcagtgacctctgagaagaatgaatggaaaggagccacttgcccagtttgcttggagcatccacatgatgctgtcctcctcctgtgtacttctcaccacaagggctgccgaccatatatgtgtggtaccaactaccgtcattctaactgccttgaacactttaaagaagcttacgcaaaggaaaaaatggctcttggtgtttcagctgagtctgcacctggccttccattatcctcgagcacactgccatcaatcaaccagccatgtgtaatggaacttgcctgccctctctgccgtggagaggttaaaggatggactgtggttgaacctgcgcgtcactatctgaaccggaaaaggagaacttgcatgcatgatgggtgctcattccatggctcgtataaggagctttgcaagcatgtgaagtcgaagcacccttcagcgaaacctcgtgaagttgatcctgctactgcagatgagtggaaaaggtttgaatgtgagagagagcggcaggatgccatcagcactatcaggtccatgaacccaggagctgtgatcatgggggattatgtccttgagttgaatggtggtggtaacaaccttttgccctctgatggagataattttgacttggaggaaaggctcaacttcttcacatccttagatcgtactttgaatgagcgaattgacttgtatgactcgtcagatagtttggatgaggggtttgacttcttggcatccctgtttacccatggcaggagaatctctactggagctccatttagcagggcttatagaagacatagggagaggcctagacgttcaacgatttctgttgatgcttctgacattcagcatgagtcagttagtgctcaaaggggacagcgtgctgttcgggctataggcagaacttcacggcggcaccatcctatggtggctcatataaggcctacacgaggcagctga

SEQ ID NO: 11104 - protein, 358 aa, Sorghum bicolor
  misc_feature: Ceres ANNOT ID no. 6119873
  misc_feature (1)..(249): NCBI GI: 82568695 NCBI Desc: pm27 [prunus mume]
  misc_feature (116)..(240): NCBI GI: 38346521 NCBI Desc: osjnba0027h09.16 [oryza sativa (japonica cultivar-group)]
  misc_feature (116)..(240): NCBI GI: 116317899 NCBI Desc: osigba0131j24.4 [oryza sativa (indica cultivar-group)]
  misc_feature (130)..(246): NCBI GI: 3377813 NCBI Desc: t15f16.1 gene product [arabidopsis thaliana]
  misc_feature (37)..(257): NCBI GI: 115444251 NCBI Desc: os02g0150900 [oryza sativa (japonica cultivar-group)]
  misc_feature: The sequence is a functional homolog of SEQ ID NO 10 in the 10/225,066US patent application
  misc_feature: The sequence is a functional homolog of SEQ ID NO 104 in the 10/225,066US patent application
  misc_feature: The sequence is a functional homolog of SEQ ID NO 1042 in the 10/225,066US patent application
  misc_feature: The sequence is a functional homolog of SEQ ID NO 136 in the 11/375,241US patent application
  misc_feature: The sequence is a functional homolog of SEQ ID NO 187 in the 11/479,226US patent application
  misc_feature: The sequence is a functional homolog of SEQ ID NO 1873 in the 11/479,226US patent application
  misc_feature: The sequence is a functional homolog of SEQ ID NO 2228 in the 10/374,780US patent application
  misc_feature: The sequence is a functional homolog of SEQ ID NO 2650 in the 10/374,780US patent application
  misc_feature: The sequence is a functional homolog of SEQ ID NO 304 in the 10/374,780US patent application
  misc_feature: The sequence is a functional homolog of SEQ ID NO 838 in the 10/225,066US patent application
  misc_feature: Useful for making plants with modulated growth and phenotype characteristics
  misc_feature: Useful for making plants with modulated heat sensitivity
  misc_feature: Functional homolog of the protein sequence encoded by LOCUS at1g77770
  misc_feature: The sequence is a functional homolog of SEQ ID NO 10 in the 20050160493 US patent application
  misc_feature: The sequence is a functional homolog of SEQ ID NO 104 in the 20050160493 US patent application
  misc_feature: The sequence is a functional homolog of SEQ ID NO 1042 in the 20050160493 US patent application
MARSPRGRNLQARQHRSASSDVPLCSWKTEGTNKGNDMSVTSEKNEWKGATCPVCLEHPHDAVLLLCTSHHKGCRPYMCGTNYRHSNCLEHFKEAYAKEKMALGVSAESAPGLPLSSSTLPSINQPCVMELACPLCRGEVKGWTVVEPARHYLNRKRRTCMHDGCSFHGSYKELCKHVKSKHPSAKPREVDPATADEWKRFECERERQDAISTIRSMNPGAVIMGDYVLELNGGGNNLLPSDGDNFDLEERLNFFTSLDRTLNERIDLYDSSDSLDEGFDFLASLFTHGRRISTGAPFSRAYRRHRERPRRSTISVDASDIQHESVSAQRGQRAVRAIGRTSRRHHPMVAHIRPTRGS

SEQ ID NO: 11105 - DNA, 1221 bp, Sorghum bicolor
  misc_feature: Ceres ANNOT ID no. 6119877
  misc_feature: Encodes the peptide sequence at SEQ ID NO 11106
atgaaggggaaaggcggggcgatggaccggaggtcctccgccaggtggagggtgctggtgctctgcgcattctgcttcggcctcggcatgctcttcaccgaccggttctggtcagcaccggatactagtaaccatatcatgtctcaacaacggaggcaagagcgagagctccaacttgtatcagaggattgcaacacaaagaggaagcatggggaagacaaggatataatgggagaggtaaccaagacccatgaagccatacaatcattggataagtccatctcaacgctgcagatggagcttgcagcaaagaggagcacacttgagcggctacggtctagtggttcaccagtaacctctgaaactagccaaccaaggaaaaaggcatttgttgtcattggagtcaacactgcattcagcagccgcaagcgccgtgattctgtccgggagacatggatgcctcaaggagaaaagctgaaacaattagaagaacagaagggaatagttatccgcttcactatcgggcacagtgctacgtccaacagtatactggacaaagctatagattcagaggacgctcagcatcatgactttcttaggctggaccatgttgagggatatcatgaactctcagctaagacaaaaatattcttctctactgctgttggcatctgggatgctgacttctacgtcaaggttgatgatgatgtgcatttttgtttgctggtccatgcacataaccaaacaggaatgcttgccactacccttgctcggcataaaacgaaaccaagaacttatattggctgcatgaagtcaggcccagttcttgctgacaagaatgtgaagtaccatgagcctgagtactggaaatttggggaggaaggaaataaatacttccgtcatgctacggggcagatatatgctgtttcgaaagatcttgcgacttatatttcaatcaatcagcctatcctgcacaaatatgcaaatgaagacgtgtcgcttggatcatggttcattggcttggaagttaatcacattgatgaaaggaacatgtgctgtggaactccaccagattgtgagtggaaagggcaagctggcaatgtctgtgtagcatctttcgattggagctgcagtggcatatgcaagtctgttgagaggatcaaagatgtacatgctcgctgtggtgaaggggattcagcagtttggagtgctcttatctag

SEQ ID NO: 11106 - protein, 406 aa, Sorghum bicolor
  misc_feature: Ceres ANNOT ID no. 6119877
  misc_feature (143)..(349): Pfam Id: Galactosyl_T Pfam Desc: Galactosyltransferase
  misc_feature (1)..(395): NCBI GI: 115446789 NCBI Desc: os02g0566800 [oryza sativa (japonica cultivar-group)]
  misc_feature (13)..(405): NCBI GI: 4138265 NCBI Desc: avr9 elicitor response protein [nicotiana tabacum]
  misc_feature (6)..(404): NCBI GI: 21360399 NCBI Desc: at1g05170/yup8h12_22 [arabidopsis thaliana]
  misc_feature (6)..(404): NCBI GI: 145323746 NCBI Desc: galactosyltransferase family protein [arabidopsis thaliana]
  misc_feature (4)..(401): NCBI GI: 115464013 NCBI Desc: os05g0427200 [oryza sativa (japonica cultivar-group)]
  misc_feature: Useful for making plants with altered carbohydrate content
  misc_feature: Functional homolog of the protein sequence given in SEQ ID NO 13658
MKGKGGAMDRRSSARWRVLVLCAFCFGLGMLFTDRFWSAPDTSNHIMSQQRRQERELQLVSEDCNTKRKHGEDKDIMGEVTKTHEAIQSLDKSISTLQMELAAKRSTLERLRSSGSPVTSETSQPRKKAFVVIGVNTAFSSRKRRDSVRETWMPQGEKLKQLEEQKGIVIRFTIGHSATSNSILDKAIDSEDAQHHDFLRLDHVEGYHELSAKTKIFFSTAVGIWDADFYVKVDDDVHFCLLVHAHNQTGMLATTLARHKTKPRTYIGCMKSGPVLADKNVKYHEPEYWKFGEEGNKYFRHATGQIYAVSKDLATYISINQPILHKYANEDVSLGSWFIGLEVNHIDERNMCCGTPPDCEWKGQAGNVCVASFDWSCSGICKSVERIKDVHARCGEGDSAVWSALI

SEQ ID NO: 11107 - DNA, 639 bp, Sorghum bicolor
  misc_feature: Ceres ANNOT ID no. 6119880
  misc_feature: Encodes the peptide sequence at SEQ ID NO 11108
atgatcgtctcctccctcctcccccttccctccctcttcatcctccccgccagcgccgcatcccgctcccgtcccggtcccgccaccctccttccctttccaaggatcaccctcagcggccgccgcttggctgcctcggcgactgagagcagcagcgaagaagaggaagcggcggccgggagcacgaacgggtccctcccgggcctgccccccgtggtggaggacgacgacgacgaggaggagttctgcccggtggactgcgtgacggagttcaagacggaggaggagttccagcgccacctggagcggtccaaggccacgggcgcgctggtggtagtggacttctaccggccctcctgcggcagctgcaagtacatcgagaagggcttcattcgcctctgcaagggctccggcgacgacggcgcccccgtcgtcttcctcaagcacaacgtgatcgacgagtacgacgagcagtcggaggtggcggatcggctgcgcatcaagatcgtgccgctcttccacttctacaaggacggcgtgctggtggagtcgttcgcgacgagggacaaggagaggatcctcgccgccattcagaagtacacctcggccgagccagaaccagaaccagaaccagagtga

SEQ ID NO: 11108 - protein, 212 aa, Sorghum bicolor
  misc_feature: Ceres ANNOT ID no. 6119880
  misc_feature (88)..(200): Pfam Id: Thioredoxin Pfam Desc: Thioredoxin
  misc_feature (1)..(211): NCBI GI: 46806684 NCBI Desc: thioredoxin-like protein [oryza sativa (japonica cultivar-group)]
  misc_feature (72)..(204): NCBI GI: 42571381 NCBI Desc: thioredoxin family protein [arabidopsis thaliana]
  misc_feature (72)..(172): NCBI GI: 42571379 NCBI Desc: thioredoxin family protein [arabidopsis thaliana]
  misc_feature (151)..(204): NCBI GI: 8439899 NCBI Desc: it contains thioredoxin domain pf00085. est gbai999448 comes from this gene. [arabidopsis thaliana]
  misc_feature (93)..(205): NCBI GI: 66841004 NCBI Desc: thioredoxin h2 protein [zea mays]
MIVSSLLPLPSLFILPASAASRSRPGPATLLPFPRITLSGRRLAASATESSSEEEEAAAGSTNGSLPGLPPVVEDDDDEEEFCPVDCVTEFKTEEEFQRHLERSKATGALVVVDFYRPSCGSCKYIEKGFIRLCKGSGDDGAPVVFLKHNVIDEYDEQSEVADRLRIKIVPLFHFYKDGVLVESFATRDKERILAAIQKYTSAEPEPEPEPE

SEQ ID NO: 11109 - DNA, 1314 bp, Sorghum bicolor
  misc_feature: Ceres ANNOT ID no. 6119881
  misc_feature: Encodes the peptide sequence at SEQ ID NO 11110
atgtcttcgcgctcggggtccacgagcggcggcagcagccaggggggaggcgccgcggtgccgctggccgtgcttctcaggcgggaggtcgccagcgagcgcaccgcgtccgagcgcccggagctgcactcgggcctcttcagccaggccaagaaaggcgaggacttcaccttcctcaagcccgaatgcgagcgcgtccccggcgtcccgtcctcctccttctccgccttcggcctgtttgatgggcacaatggaaatggagcggcgatttacaccaaggagaacctcttgaacaacatcttgagcgcggtccctgctgatctcaacagggaagactggcttgctgcactcccaagagcgctggttgctgcattcgtcaaaaccgataaagatttccagactaaagcacgttcttcagggacaactgtgacatttgtcataatagatgggttggtcatcactgttgcatcagttggcgattcccgttgtgtactacaagctgaaggttcaatttatcatttatcctccgatcatcgatttgatgcaagtaaagaggaggttgatcgtgtaacagaatgtggaggtgatgttggaaggctaaatgttgttggtggtgctgagattggcccccttaggtgttggcctggaggtttgtgcctatcaaggtcaatcggagatcaagatgttggtgaatttattgttccagttcctcttgtgaaacaagtaaagctatctactgcgggaggccgacttattattgcaagtgatggtgtttgggatgccttgtctccagaagtagcttttaactgttcacgtgaacttcctccagtgcctgcagctgagcaaatcgttaaaactgctgttcaatcaaaaggactgagggatgataccacctgtattgttgttgatataatagcagaaaaaaaccacccttccatgccacatcctaaaaagcaaccaggaatgggtgtcttcaaaaatatgttcggcaagaaaaaatcatcggattcatcatcccattcccatacagatagagaatatatggatccagataatgtggaggaaatatttgaggatgggctggattctgaataccctgttcgaaatatgttcaaactcttcatatgtgccatttgtcaagtagagttaaagccaaaccaagggatatctgtacatgaagattcatcacaacctgggagcttgcgtcgctgggatggtccattcctttgccagagctgtcaggagaagaaagaagcaatggagggaaagcgtcgttcacgaggtcttatttggagacctgttatttatgtttga

SEQ ID NO: 11110 - protein, 437 aa, Sorghum bicolor
  misc_feature: Ceres ANNOT ID no. 6119881
  misc_feature (43)..(297): Pfam Id: PP2C Pfam Desc: Protein phosphatase 2C
  misc_feature (9)..(435): NCBI GI: 115458662 NCBI Desc: os04g0449400 [oryza sativa (japonica cultivar-group)]
  misc_feature (9)..(427): NCBI GI: 116310073 NCBI Desc: h0818e04.11 [oryza sativa (indica cultivar-group)]
  misc_feature (9)..(427): NCBI GI: 38344839 NCBI Desc: osjnba0064h22.20 [oryza sativa (japonica cultivar-group)]
  misc_feature (17)..(424): NCBI GI: 115453381 NCBI Desc: os03g0395100 [oryza sativa (japonica cultivar-group)]
  misc_feature (20)..(427): NCBI GI: 92879648 NCBI Desc: protein phosphatase 2c-like [medicago truncatula]
  misc_feature: The sequence is a functional homolog of SEQ ID NO. 363 in the 11/188,298 US application
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
MSSRSGSTSGGSSQGGGAAVPLAVLLRREVASERTASERPELHSGLFSQAKKGEDFTFLKPECERVPGVPSSSFSAFGLFDGHNGNGAAIYTKENLLNNILSAVPADLNREDWLAALPRALVAAFVKTDKDFQTKARSSGTTVTFVIIDGLVITVASVGDSRCVLQAEGSIYHLSSDHRFDASKEEVDRVTECGGDVGRLNVVGGAEIGPLRCWPGGLCLSRSIGDQDVGEFIVPVPLVKQVKLSTAGGRLIIASDGVWDALSPEVAFNCSRELPPVPAAEQIVKTAVQSKGLRDDTTCIVVDIIAEKNHPSMPHPKKQPGMGVFKNMFGKKKSSDSSSHSHTDREYMDPDNVEEIFEDGLDSEYPVRNMFKLFICAICQVELKPNQGISVHEDSSQPGSLRRWDGPFLCQSCQEKKEAMEGKRRSRGLIWRPVIYV

SEQ ID NO: 11111 - DNA, 666 bp, Sorghum bicolor
  misc_feature: Ceres ANNOT ID no. 6120382
  misc_feature: Encodes the peptide sequence at SEQ ID NO 11112
atggggcgcggcaagatcgagatcaagcggatcgagaacgccaccaaccggcaggtgacctactccaagcgccgcacggggatcatgaagaaggcgcgcgagctcaccgtgctctgcgacgcccaggtcgccatcatcatgttctcctccaccggcaagtaccacgagttctgcagccccgggaccgacatcaagaccatctttgaccgataccagcaggccatcgggaccagcctatggaacgagcagtatgagaatatgcagcgcacgctgagccatctcaaggacatcaatcgcaacctgcgcacagagattaggcaaaggatgggcgaggatctggacactctggagttcgacgagctgcgcggtcttgagcaaaatgttgatgcggctctcaaggagtaccatgtgatcgccacacagactgaaacttacaagaaaaaggtgaagcactcgtacgaggcgtacaagaacctgcagcaggagctgggcatgcgcgaggacccggcgttcgggttcgtggacaacactggcgccggcggttgggacggcgccgcggcggcgctgggcggcggcgccccggacatgtacgccttccgcgtggtgcccagtcagcccaacctgcacggcatggcctatggctcccacgacctccgtcttggctag

SEQ ID NO: 11112 - protein, 221 aa, Sorghum bicolor
  misc_feature: Ceres ANNOT ID no. 6120382
  misc_feature (9)..(59): Pfam Id: SRF-TF Pfam Desc: SRF-type transcription factor (DNA-binding and dimerisationdomain)
  misc_feature (71)..(165): Pfam Id: K-box Pfam Desc: K-box region
  misc_feature (1)..(221): NCBI GI: 7328575 NCBI Desc: mads-box dna binding protein [zea mays]
  misc_feature (1)..(221): NCBI GI: 3688593 NCBI Desc: mads box transcription factor [triticum aestivum]
  misc_feature (1)..(219): NCBI GI: 44888599 NCBI Desc: apetala3-like protein [hordeum vulgare subsp. vulgare]
  misc_feature (1)..(221): NCBI GI: 73920923 NCBI Desc: mads-box transcription factor 16 (osmads16) (superwoman1 protein) (apetala3-like protein)
  misc_feature (1)..(221): NCBI GI: 115469922 NCBI Desc: os06g0712700 [oryza sativa (japonica cultivar-group)]
  misc_feature: Abnormal phyllotaxy, leaf number higher than wild-type
  misc_feature: The plant flowers significantly earllier than wild-type.
  misc_feature: The plant produces a reduced number of seeds.
  misc_feature: Useful for biocontainment applications
  misc_feature: Useful for making plants with altered Lignin content
  misc_feature: Useful for making plants with modulated biomass
  misc_feature: Useful for making plants with modulated flowering time
  misc_feature: Useful for making plants with modulated nitrogen use efficiency
  misc_feature: Functional homolog of the protein sequence given in SEQ ID NO 12958
  misc_feature: Functional homolog of the protein sequence given in SEQ ID NO 12982
  misc_feature: GREAT-hit functional homolog of the protein sequence given in SEQ ID NO 13115
  misc_feature: The sequence is a functional homolog of SEQ ID NO 2 in US patent 7049489
  misc_feature: Useful for making plants with altered lignin content
  misc_feature: Functional homolog of the protein sequence given in SEQ ID NO 13115
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Useful for making plants with modulated flowering time
  misc_feature: Functional homolog of the protein sequence given in SEQ ID NO 13660
  misc_feature: The sequence is a functional homolog of SEQ ID NO 1955 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKIEIKRIENATNRQVTYSKRRTGIMKKARELTVLCDAQVAIIMFSSTGKYHEFCSPGTDIKTIFDRYQQAIGTSLWNEQYENMQRTLSHLKDINRNLRTEIRQRMGEDLDTLEFDELRGLEQNVDAALKEYHVIATQTETYKKKVKHSYEAYKNLQQELGMREDPAFGFVDNTGAGGWDGAAAALGGGAPDMYAFRVVPSQPNLHGMAYGSHDLRLG

SEQ ID NO: 11113 - DNA, 1266 bp, Sorghum bicolor
  misc_feature: Ceres ANNOT ID no. 6120384
  misc_feature: Encodes the peptide sequence at SEQ ID NO 11114
atgccactgcgccgcctcgcgcctctcctagcgagcccgcgccgccgcctgcgctcctcccaaaaccctagccccgccaccatgtccccggccgccgctcacctggccacggccgccgaccccgacgaggacctctgcgcgagcgccgcggggtcagaagcggaggacctcgcgctggctccgccgctcccgccgccgccggtgtccgcggaggagcgggtggagcgcgcatgggcgcactggagacggctggggtccccgcggctgctggtggcccctatggtggacaactccgagctccccttccgcatgctgtgccgccgctacggcgccgacgcggcgtacacgcccatgctccattcccgcatcttctccgagaacgagaagtacaggtccatggagttcaccacgtgcaaggaggatcgaccactttttgttcagttttgtgccaatgatcctgacattttgttacaagctgcaaagatggtggaaccacattgtgactatgttgatatcaattttggttgcccacagcgtattgcaagacggggtaactatggagcatttctcatggacaaccttccccttgtaaaatcccttgtgcagaatctagcagctaatcttcatgttccagtctcagttaagattcgcgtatttccacgactggaagacacattagcctacgcgaagatgcttgaggaagctggtgcttctcttgtggctgtccatggtcggacaagagatgaaaaagatgggaagaaatttcgagctgactgggatgccatcaaggctgtgaaggatgcacttagagtacctgttcttgcaaatggaaacatccgccacatggaggatgtgaagaattgcctggaacatactggtgctgatggtgtgctttcagctgaaactcttctagaaaatccagcactttttgctggtttcaggacaaaggaatggaaggaagatagtgatgagaacggagatagcggcttggaccaggctgatctagtgattgaatatttgaagctgtgtgagcagtaccctgtgccatggagaatggttagatcccatgtccacaagatgttaggggactggtttagggtgcatccagaagtgagagaggaactcaataagcagaacaaactcaccttcgaatggttgcatgacatggtaatgaggctgaaggagctcggtggaagagtaccactttacagaaaggagactgcactagagacaacgttagatgggctagcctctagcaatgcctga

SEQ ID NO: 11114 - protein, 421 aa, Sorghum bicolor
  misc_feature: Ceres ANNOT ID no. 6120384
  misc_feature (90)..(395): Pfam Id: Dus Pfam Desc: Dihydrouridine synthase (Dus)
  misc_feature (5)..(421): NCBI GI: 115469926 NCBI Desc: os06g0712900 [oryza sativa (japonica cultivar-group)]
  misc_feature (16)..(375): NCBI GI: 108882414 NCBI Desc: t-dirnahydrouridine synthase [aedes aegypti]
  misc_feature (55)..(375): NCBI GI: 89286167 NCBI Desc: dihydrouridine synthase [tetrahymena thermophila sb210]
  misc_feature (84)..(381): NCBI GI: 24580595 NCBI Desc: cg3645-pb, isoform b [drosophila melanogaster]
  misc_feature (81)..(377): NCBI GI: 49903669 NCBI Desc: mgc83715 protein [xenopus laevis]
MPLRRLAPLLASPRRRLRSSQNPSPATMSPAAAHLATAADPDEDLCASAAGSEAEDLALAPPLPPPPVSAEERVERAWAHWRRLGSPRLLVAPMVDNSELPFRMLCRRYGADAAYTPMLHSRIFSENEKYRSMEFTTCKEDRPLFVQFCANDPDILLQAAKMVEPHCDYVDINFGCPQRIARRGNYGAFLMDNLPLVKSLVQNLAANLHVPVSVKIRVFPRLEDTLAYAKMLEEAGASLVAVHGRTRDEKDGKKFRADWDAIKAVKDALRVPVLANGNIRHMEDVKNCLEHTGADGVLSAETLLENPALFAGFRTKEWKEDSDENGDSGLDQADLVIEYLKLCEQYPVPWRMVRSHVHKMLGDWFRVHPEVREELNKQNKLTFEWLHDMVMRLKELGGRVPLYRKETALETTLDGLASSNA

SEQ ID NO: 11115 - DNA, 1674 bp, Sorghum bicolor
  misc_feature: Ceres ANNOT ID no. 6120396
  misc_feature: Encodes the peptide sequence at SEQ ID NO 11116
atgagcttgatatcccagaacgcggtccagaagcgccgcctcaagaaaagtgaagctgatgatggcaatgacgagaacattggctctccgacctccatagatgcagaggttgggaaggaagcaaagttgaagaatcacaataaggaaaggaagaagaaaaggactaaggtgcaggagtcccagcagaacaaagaggaagaggagatgcggcagctggagagctcattgtttggttccctttatgcgccactggagtttggcactgaggctggggctgcagtagtagctcctgaccgggatgcgcctttgtttttcacagataggtccgctggtggtggcgtggatcattttcctatatatgaggaggatatggcccatgaagatgaggaagatgtggtgcgtatcaaggggaggaagcctgtatgggtggatgaggaagaagaaaggacagaagtggacatcgtgaaggtttcaaggttgaggaagctaagaaaagaggaagatgagcatttgatttcagggaaagagtatgaggccaggctgcgtggtcagcatgccaaattgaaccccttcactggctgggctgatatggaccggaaaacttctcttcctgccgcgtcagatggtgagtctgatgatgagggttgtgttgatgatatccttcaaaataacgatgagcttgttgtcaaggatactgtcaagctcttacctgggatgttagagttctcaagacttgttgatgccaatatccaggatccatcaagtggtcctatcaattcagtgcagtttcataggaatgggcagctgatgcttgctgcaggtttggacaagcatctcaggtttttccagattgatggaaagagaaaccccaagatccagagcatattcattggggactgtccagtacacaaggcctcatttctacctgatggctctgaggtgatcctatcaggcaggagaaagttcttctactcatttgacctggtgaatgctgctgttagcaagattggacctttgacggggcgtgaggagaaaagcctggagagctttgagatatcacctgattcgagaaccattgcttttgtcggtaacgaagggtacatccttcttatttctgccaagacaaagcagctcattggaaccctcaagatgaacggaagcgtgcgttcactggcttttgcggatggtggaaaccagctgctgagcagcggtggagatggccatgtttaccactgggatctcggaacgaggaagtgcatccacaaggcttttgacgatggttccctggctggcatttcaatttgcacctcgcaggacagctctttgtttgccacaggctccaccagcggcatcgtgaatgtgtacaagagggatgattttcttggtgggaagaggaagccactgaagacgatcgaaaacctgaccactgacattggcgaaatgaaattcaaccatgatgcccagatcttggcaatcagctcaaggaaagagaggaatgggatgaggcttgtgcacgtcccgtcgttcagcgtgttccagaactggccagggcctcggttcagccttcactatccacggtgcctggatttcagccctggcagcgggttcttgtctgttggacacgcgggtggaaaagtccttctatacaagcttcaccactataaaaacgcatga

SEQ ID NO: 11116 - protein, 557 aa, Sorghum bicolor
  misc_feature: Ceres ANNOT ID no. 6120396
  misc_feature (376)..(413): Pfam Id: WD40 Pfam Desc: WD domain, G-beta repeat
  misc_feature (1)..(557): NCBI GI: 92877705 NCBI Desc: inorganic pyrophosphatase; wd40-like [medicago truncatula]
  misc_feature (1)..(557): NCBI GI: 87240437 NCBI Desc: wd40-like [medicago truncatula]
  misc_feature (38)..(556): NCBI GI: 89269519 NCBI Desc: wd repeat domain 50 [xenopus tropicalis]
  misc_feature (119)..(556): NCBI GI: 62860162 NCBI Desc: wdr50 [xenopus tropicalis]
  misc_feature (119)..(556): NCBI GI: 111309080 NCBI Desc: wdr50 protein [xenopus tropicalis]
MSLISQNAVQKRRLKKSEADDGNDENIGSPTSIDAEVGKEAKLKNHNKERKKKRTKVQESQQNKEEEEMRQLESSLFGSLYAPLEFGTEAGAAVVAPDRDAPLFFTDRSAGGGVDHFPIYEEDMAHEDEEDVVRIKGRKPVWVDEEEERTEVDIVKVSRLRKLRKEEDEHLISGKEYEARLRGQHAKLNPFTGWADMDRKTSLPAASDGESDDEGCVDDILQNNDELVVKDTVKLLPGMLEFSRLVDANIQDPSSGPINSVQFHRNGQLMLAAGLDKHLRFFQIDGKRNPKIQSIFIGDCPVHKASFLPDGSEVILSGRRKFFYSFDLVNAAVSKIGPLTGREEKSLESFEISPDSRTIAFVGNEGYILLISAKTKQLIGTLKMNGSVRSLAFADGGNQLLSSGGDGHVYHWDLGTRKCIHKAFDDGSLAGISICTSQDSSLFATGSTSGIVNVYKRDDFLGGKRKPLKTIENLTTDIGEMKFNHDAQILAISSRKERNGMRLVHVPSFSVFQNWPGPRFSLHYPRCLDFSPGSGFLSVGHAGGKVLLYKLHHYKNA

SEQ ID NO: 11117 - DNA, 345 bp, Sorghum bicolor
  misc_feature: Ceres ANNOT ID no. 6120418
  misc_feature: Encodes the peptide sequence at SEQ ID NO 11118
atggcgtccacggcagggtacctggcgcggcggacggcgcagaaggagcgggtgcgtctgctctaccgcagggcgctcaaggacacgctcaactgggccgttcaccgccacctcttctaccaggacgcgtcggatctccgggacaagttcgaggccaaccgacacgtggataacatggacgtgatcgataggctcatcgacgatgcggaggctcggtacaggaacttccagcaccccgatccctacattgttccatgggcaccaggcggcactaaattcactagaaacccccctccacctcaagggatcgagatcatctacaattatggcaaggaggaccagtaa

SEQ ID NO: 11118 - protein, 114 aa, Sorghum bicolor
  misc_feature: Ceres ANNOT ID no. 6120418
  misc_feature (13)..(78): Pfam Id: Complex1_LYR Pfam Desc: Complex 1 protein (LYR family)
  misc_feature (1)..(113): NCBI GI: 53792931 NCBI Desc: complex 1 family protein-like [oryza sativa (japonica cultivar-group)]
  misc_feature (3)..(113): NCBI GI: 24111283 NCBI Desc: at4g34700/t4l20_280 [arabidopsis thaliana]
  misc_feature (18)..(101): NCBI GI: 119398707 NCBI Desc: lyr family protein [aspergillus clavatus nrrl 1]
  misc_feature (15)..(114): NCBI GI: 34485502 NCBI Desc: nadh:ubiquinone oxidoreductase b22-like subunit [chlamydomonas reinhardtii]
  misc_feature (10)..(95): NCBI GI: 111662023 NCBI Desc: mitochondrial complex i subunit ndufb9 [gorilla gorilla]
MASTAGYLARRTAQKERVRLLYRRALKDTLNWAVHRHLFYQDASDLRDKFEANRHVDNMDVIDRLIDDAEARYRNFQHPDPYIVPWAPGGTKFTRNPPPPQGIEIIYNYGKEDQ

SEQ ID NO: 11119 - DNA, 1575 bp, Sorghum bicolor
  misc_feature: Ceres ANNOT ID no. 6120538
  misc_feature: Encodes the peptide sequence at SEQ ID NO 11120
atggcactagcgcccatggactacgctggttctattagttcaggccagaagtacctgggccgtttcggagtacccaccagcagtagattgcgatgggtgggatatgacacgaaatcaaggacatatcagttggttgctagagccatatccgtggatcaaccgcaactagacttctcgaatccagattggaagaagcagtttcaagaggatttcaataagcgcttcagcttgccacacttgagagatgtaattgatgtggaaccgaggccaactacattttctctcaagagcaggaccccccttgagaatgtgaatggtaccatgcaagaatcatggaacggctatgtgaatgatgatgacagagcacttttgaaggttattaagtttgcctcaccaacttctgctggagctgactgcattgaccctgattgtagctgggttgagcaatgggtgcaccgtgctggtccacgcaaacaaatatattttgagcctcaatatgtgaaggctgggattgtatcgtgtggtgggctctgccctggtctcaatgatgtcattcggcagattgtgcttacacttgaaaaatatggggtgaaaaacattgttgggatacagcatgggttccgtggattttttgaggatcacttatcagaagtgccactttctaggcatgtagtccaaaatatcaatcttgctggtggtagcttcttaggagtctcccgcggtggtgcaaacatttcagacattgttgacagtattcaggctaggaggcttgatatgctctttgtacttggtggaaatggaacacatgctggagctaatgctatacatgatgagtgccgcaagagaaaactgcaggtatcgattgtatgtgtccccaaaactattgacaatgacatactactgatggacaagacctttggatttgatactgcagtggaagctgcacaaagagctatcaactctgcatacattgaggcacattctgcatttcatggcattggattggtcaagctgatgggaagaagcagcggcttcatcacaatgcaggcctccctgtcaagtggccaagtagatatctgtctgatacctgaggtaccattcactcttgatggaccaaacggagttcttcgacatctcgagcacttgatagagaccaagggatttgctctggtttgtgttgctgaaggagcaggacaggaatattttcaaaagtcaaatgcaactgacgcatcagggaacatggttcttagtgacattggtgtccaccttcagcagaagatcaagtcccatttcaaggatataggagtccattctgatatcaagtatattgatcccacgtacatgctccgcgctgtgcgggccaatgcatctgatgccatcctgtgcaccgtgcttggtcagaatgctgttcacggcgcctttgcgggttttagcggcatcacaaccggggtgtgcaacacacacaatgtttacttgccgataccagaagtcatcaaatccacgaggtttgtcgatccaaacagtcggatgtggcaccggtgcctgacctcaactgggcagccagacttccattga

SEQ ID NO: 11120 - protein, 524 aa, Sorghum bicolor
  misc_feature: Ceres ANNOT ID no. 6120538
  misc_feature (168)..(475): Pfam Id: PFK Pfam Desc: Phosphofructokinase
  misc_feature (44)..(524): NCBI GI: 115479163 NCBI Desc: os09g0415800 [oryza sativa (japonica cultivar-group)]
  misc_feature (39)..(523): NCBI GI: 90654902 NCBI Desc: atp-utilizing phosphofructokinase [spinacia oleracea]
  misc_feature (125)..(357): NCBI GI: 115476600 NCBI Desc: os08g0439000 [oryza sativa (japonica cultivar-group)]
  misc_feature (153)..(523): NCBI GI: 19699124 NCBI Desc: at4g26270/t25k17_80 [arabidopsis thaliana]
  misc_feature (151)..(523): NCBI GI: 10176767 NCBI Desc: pyrophosphate-dependent phosphofructo-1-kinase-like protein [arabidopsis thaliana]
MALAPMDYAGSISSGQKYLGRFGVPTSSRLRWVGYDTKSRTYQLVARAISVDQPQLDFSNPDWKKQFQEDFNKRFSLPHLRDVIDVEPRPTTFSLKSRTPLENVNGTMQESWNGYVNDDDRALLKVIKFASPTSAGADCIDPDCSWVEQWVHRAGPRKQIYFEPQYVKAGIVSCGGLCPGLNDVIRQIVLTLEKYGVKNIVGIQHGFRGFFEDHLSEVPLSRHVVQNINLAGGSFLGVSRGGANISDIVDSIQARRLDMLFVLGGNGTHAGANAIHDECRKRKLQVSIVCVPKTIDNDILLMDKTFGFDTAVEAAQRAINSAYIEAHSAFHGIGLVKLMGRSSGFITMQASLSSGQVDICLIPEVPFTLDGPNGVLRHLEHLIETKGFALVCVAEGAGQEYFQKSNATDASGNMVLSDIGVHLQQKIKSHFKDIGVHSDIKYIDPTYMLRAVRANASDAILCTVLGQNAVHGAFAGFSGITTGVCNTHNVYLPIPEVIKSTRFVDPNSRMWHRCLTSTGQPDFH

SEQ ID NO: 11121 - DNA, 1281 bp, Sorghum bicolor
  misc_feature: Ceres ANNOT ID no. 6120542
  misc_feature: Encodes the peptide sequence at SEQ ID NO 11122
atgggttcgttatgctgcgtggcagcacggccacatggggctagcacagcaagccaggattggtcctctattagccgcagcgacccaccctggcggactggtgctggcttttctccacctctgtctagggggtgggagtacaggatcaactcggaagggttgtcttatggatcccatggtgatagcggggtcgctgtgaattatgggtcatcactatcatcaaatagtaaaggggctagtaggagctgggagaggaatgagcttccacaagatcaccgctactctacatctgagggtgccatttcgtatctcaacagcccagatgtcagcttccagaaccaccatattatgctaccaatgctgcaagattctagcgttgatgaatacatgagagtttcagttgctgagcctattggtgctttattattgtcagaggtaatgtcaggacaacagaatagtggtggttccacctcctctcgctctgatggaagtgaatatgatattgtacctaaatcatacacatcaacgccccgcaacttcccaagtcgtcgatcattcctttcaaagccaatccaccctgtttcatttccagaacatgcaccagaagcacaagaaactcaaagtcctgttgccatcgcaaggtccaacaatcctctgtgctctgaattcaacggaacaggagagcttcgctttccaggtcccatggactatggtagtggtagtcatggggagtcaggaaattggagtgccgcaagtagcatggatcttactgatttatcagaacgacctgaagctggacaagctggaccactgcgtcctaataatgtaatgcagaaaacaaggtgtgacctctgtgagaagcttctgacaaagaggtcaccttggggttctcgtagaattgtacgcactggagatttgccagttgctggtgttctcccatgctcccatgtctaccatgctgagtgtttagagcggaccactcccaaggggcagaagcatgaccctccttgccctgtgtgtgacaagctggctggtaaagataccgagcagtggtcgatttgcaggttaaaaaatggattcccaagattacgttcactaggggaagggccttctcgagtttggagctgtgctcatgctggagattgtgttgctggggctgtacagataccaagatcaaatagcatcaagctcttgagtcggagtggtcacaagaggcatgcatcttcgaagggagagcccagcaaagactgggctgaaacatcaaaaaatgattacatgtaa

SEQ ID NO: 11122 - protein, 426 aa, Sorghum bicolor
  misc_feature: Ceres ANNOT ID no. 6120542
  misc_feature (1)..(340): NCBI GI: 140071230 NCBI Desc: zinc finger, ring-type [medicago truncatula]
  misc_feature (1)..(340): NCBI GI: 92870334 NCBI Desc: zinc finger, ring-type [medicago truncatula]
  misc_feature (275)..(340): NCBI GI: 73329438 NCBI Desc: at1g19680-like protein [arabidopsis lyrata]
  misc_feature (275)..(340): NCBI GI: 73329338 NCBI Desc: at1g19680 [arabidopsis thaliana]
  misc_feature (275)..(340): NCBI GI: 73329340 NCBI Desc: at1g19680 [arabidopsis thaliana]
MGSLCCVAARPHGASTASQDWSSISRSDPPWRTGAGFSPPLSRGWEYRINSEGLSYGSHGDSGVAVNYGSSLSSNSKGASRSWERNELPQDHRYSTSEGAISYLNSPDVSFQNHHIMLPMLQDSSVDEYMRVSVAEPIGALLLSEVMSGQQNSGGSTSSRSDGSEYDIVPKSYTSTPRNFPSRRSFLSKPIHPVSFPEHAPEAQETQSPVAIARSNNPLCSEFNGTGELRFPGPMDYGSGSHGESGNWSAASSMDLTDLSERPEAGQAGPLRPNNVMQKTRCDLCEKLLTKRSPWGSRRIVRTGDLPVAGVLPCSHVYHAECLERTTPKGQKHDPPCPVCDKLAGKDTEQWSICRLKNGFPRLRSLGEGPSRVWSCAHAGDCVAGAVQIPRSNSIKLLSRSGHKRHASSKGEPSKDWAETSKNDYM

SEQ ID NO: 11123 - DNA, 843 bp, Sorghum bicolor
  misc_feature: Ceres ANNOT ID no. 6120603
  misc_feature: Encodes the peptide sequence at SEQ ID NO 11124
atggccgaaatggcggtgactgtcgcggccgccaacggcaccctccggacgtgctccggcgtgtcgccaacggcgcccggcggccgccgtgctgcggttcttggtcggtggcgggctcttgcgccagccaacttgagattgtcctctccagctgtgagggttccaagggctacttccgctgcggcggttgaggattggagcaacactgatatagtccctatcccgaaagttataatagatcaagactcagatccggatgcaacaattgtagaaataaccttgggtgatcgtcttggcgagctccttgatacaatgaatgccctaaagaacttggggctaaatgtcgttaaagctagtgtctgtctcgattctactggcaagcataacaagttttctataactaaagcgtccactggccgtaaaattgatgatccagagttgttagaagcaattcgactgacgatcattaacaacatgttagtgtatcatccggagtccagcagtcaattggctatgggagcaacttttgggccagaagcccctacagaagaggttgatgtggacatagcaacccacatagatatctatgatggccctgaaagaagcttacttgtggtggaaacagcggatcgtccggggttgctggttgaccttgttaagatcatctcagacatcaacattaatgtccaatctggagagtttgatactgaggggctactggctaaagcaaaattccatgtcagctacaggggcaaaccactgatggaggctttaaaacaggttctttctaatagcttgcgctatttcttgaggcggcccacaacagaggacgctagcttctag

SEQ ID NO: 11124 - protein, 280 aa, Sorghum bicolor
  misc_feature: Ceres ANNOT ID no. 6120603
  misc_feature (67)..(201): NCBI GI: 115475491 NCBI Desc: os08g0242700 [oryza sativa (japonica cultivar-group)]
  misc_feature (45)..(185): NCBI GI: 42571513 NCBI Desc: uridylyltransferase-related [arabidopsis thaliana]
  misc_feature (75)..(155): NCBI GI: 22138100 NCBI Desc: acr5 [arabidopsis thaliana]
  misc_feature (75)..(155): NCBI GI: 6730631 NCBI Desc: f4n2.2 [arabidopsis thaliana]
  misc_feature (75)..(155): NCBI GI: 22138098 NCBI Desc: acr4 [arabidopsis thaliana]
  misc_feature: Useful for making plants with altered Lignin content
  misc_feature: Useful for making plants with altered alkaloid content
  misc_feature: GREAT-hit functional homolog of the protein sequence given in SEQ ID NO 13316
  misc_feature: Useful for making plants with altered alkaloid content
  misc_feature: Useful for making plants with altered lignin content
  misc_feature: Functional homolog of the protein sequence given in SEQ ID NO 13316
MAEMAVTVAAANGTLRTCSGVSPTAPGGRRAAVLGRWRALAPANLRLSSPAVRVPRATSAAAVEDWSNTDIVPIPKVIIDQDSDPDATIVEITLGDRLGELLDTMNALKNLGLNVVKASVCLDSTGKHNKFSITKASTGRKIDDPELLEAIRLTIINNMLVYHPESSSQLAMGATFGPEAPTEEVDVDIATHIDIYDGPERSLLVVETADRPGLLVDLVKIISDININVQSGEFDTEGLLAKAKFHVSYRGKPLMEALKQVLSNSLRYFLRRPTTEDASF

SEQ ID NO: 11125 - DNA, 1518 bp, Sorghum bicolor
  misc_feature: Ceres ANNOT ID no. 6120604
  misc_feature: Encodes the peptide sequence at SEQ ID NO 11126
atggcctccgcctctccgaccgcgtctgcgtccgagcctgctgcagcgatcgcaccggcgccggcgcctgagggtgatcctccagctaccgtcctgccgccgggcgaggggggccctgagatcgccttcttcgacgtcgagacctccgtgccgcagcgggcgggccagggctacgcgctgctcgagttcggcgccatactcgtctgcccgcgcaggctcgtcgaggtcgcctcctacgccactctcgtccgccccgccgacccggtctcagctgtctcggcggcctccgtgcgctgcaacggcatcacaagggacgccgtgtccggggcgccgccgttccgcgacgtcgccgacgcagtctatgacctcctcaacgggcgggtctgggcagggcacaacattgtgaggtttgattctgcaagaataagagaggcattcactgagattggtcggtcaccccctcaacccaaggggatgattgacaccttgcccctacttacccagcggtttgggaggagagcaggggacatgaagatggcaagcttggcaaattactttggcctagggaagcaaagacacaggagtcttgatgatgttagaatgaacctcgaagttctcaaatactgtgctacagttctgttcctggaggcaagtcttccagaggtgctcactgttgagaatctggttgaacgtgcaacaacaaggagccgagctaatggtattgtgtcgcctgatttgccaaaacctgaagcaaactctccaccggattcatcaaaaaggcaacggatagtttctccaattgactctgtgatacctgaggaaggtaatcaaagaacaagtggtccttctaccaacagggaatctgttgagttggtatcccacattgaggagatgaagctagataccaccacacatatggatgcaagttctagtggttattctggatttcttgagccagatgatgtttcgattgaatgtattgaaatctcagttgctccattacaccaatttggccgaaggtcatctatccagcacagagattgcccactgcagctttgttgtgcaggcttgaaagtacagtttggtgtcagtacaaagtttcttgataatgcagggcgtccaaagatgagcatagtggttgagatccctgagagtctcagtaaagttttagaattctgcgatgatcttgctaggaagttatctcaggaatctggtagcagttctgaatggagacccctgattaagaagtatggatatgttaatcgtccgactgtccgcctgaacatccctactattgcaaacagcaatgctacagcctactcaactgatatatgccagaaagagcctactggcagcatccagaaacttgatttcagcaatgtagccaccacagaattggactccctgtttgttaaagggagcaaggtggacgcattcttctcaccggagctatacgattaccagcaaaatgctggcattcggctggttgcaaagaggctggttgtacactcgaattag

SEQ ID NO: 11126 - protein, 505 aa, Sorghum bicolor
  misc_feature: Ceres ANNOT ID no. 6120604
  misc_feature (41)..(206): Pfam Id: Exonuc_X-T Pfam Desc: Exonuclease
  misc_feature (36)..(504): NCBI GI: 9759593 NCBI Desc: exonuclease-like protein [arabidopsis thaliana]
  misc_feature (32)..(503): NCBI GI: 42568689 NCBI Desc: exonuclease family protein [arabidopsis thaliana]
  misc_feature (32)..(282): NCBI GI: 9757860 NCBI Desc: exonuclease-like protein [arabidopsis thaliana]
  misc_feature (315)..(503): NCBI GI: 31432192 NCBI Desc: collagen-like protein [oryza sativa (japonica cultivar-group)]
  misc_feature (42)..(207): NCBI GI: 67989346 NCBI Desc: dna polymerase iii, epsilon subunit [kineococcus radiotolerans srs30216]
MASASPTASASEPAAAIAPAPAPEGDPPATVLPPGEGGPEIAFFDVETSVPQRAGQGYALLEFGAILVCPRRLVEVASYATLVRPADPVSAVSAASVRCNGITRDAVSGAPPFRDVADAVYDLLNGRVWAGHNIVRFDSARIREAFTEIGRSPPQPKGMIDTLPLLTQRFGRRAGDMKMASLANYFGLGKQRHRSLDDVRMNLEVLKYCATVLFLEASLPEVLTVENLVERATTRSRANGIVSPDLPKPEANSPPDSSKRQRIVSPIDSVIPEEGNQRTSGPSTNRESVELVSHIEEMKLDTTTHMDASSSGYSGFLEPDDVSIECIEISVAPLHQFGRRSSIQHRDCPLQLCCAGLKVQFGVSTKFLDNAGRPKMSIVVEIPESLSKVLEFCDDLARKLSQESGSSSEWRPLIKKYGYVNRPTVRLNIPTIANSNATAYSTDICQKEPTGSIQKLDFSNVATTELDSLFVKGSKVDAFFSPELYDYQQNAGIRLVAKRLVVHSN

SEQ ID NO: 11127 - DNA, 900 bp, Sorghum bicolor
  misc_feature: Ceres ANNOT ID no. 6120610
  misc_feature: Encodes the peptide sequence at SEQ ID NO 11128
atgttcctccgccgccgcctcctctccaccgctgccgcggcggcctccgcccgcggcccaccgccgatccgcgtgtccctaacggagtccgcgggccgcggcgttttcgccacccgcccagtctcctctggcgagctcctccactcggcgcagcccctcgtctcccacccatcccactcactgctccacgaggtttgctacaattgcctcaggaggaagcccggggaagggcgcgcttcaagcggaggttactacttctgcagcgacacttgcagcgaccacgccaaggggttccatgacattgacaaggacgtagattggtctttattcgattaccactgcagttcacgtggtctgaagtacccatacatggccaagcgccttgcttgcatggttatatcaggatctgctaatgcagattgtcttaacatacttcagccagctcggttgcaccaagggacgctgattgagatgaaggaggaatttgagttgttggagtccactcttagaaaagctgggtttcaggaagaagccacagcctattggtacatcaatgtattggcaagaatacgcataaatgcatttcgtattgaattagttgcaagttcatatgaggatctcttatcctcagcggcagcctccgtatcatgtgattcatcagttggcaatgcagtttatatgctcccctctttctacaaccatgactgtgatccaaatgctcacatagtttggctggatagtgctgatgcgaaattgaaggccctccgtgacattgaagaaggtgaggagctgcgcatctgctacatcgatactagcctagatgccgacgctagacagaagattcttgctgatggatttggcttcaagtgccattgccttcggtgcttatctggagactag

SEQ ID NO: 11128 - protein, 299 aa, Sorghum bicolor
  misc_feature: Ceres ANNOT ID no. 6120610
  misc_feature (163)..(275): Pfam Id: SET Pfam Desc: SET domain
  misc_feature (1)..(299): NCBI GI: 27466907 NCBI Desc: set domain protein 123 [zea mays]
  misc_feature (3)..(299): NCBI GI: 78708616 NCBI Desc: set domain protein 123 [oryza sativa (japonica cultivar-group)]
  misc_feature (221)..(299): NCBI GI: 21410974 NCBI Desc: smyd3 protein [homo sapiens]
  misc_feature (221)..(299): NCBI GI: 19570495 NCBI Desc: histone methyltransferase [homo sapiens]
  misc_feature (221)..(299): NCBI GI: 123984179 NCBI Desc: set and mynd domain containing 3 [synthetic construct]
MFLRRRLLSTAAAAASARGPPPIRVSLTESAGRGVFATRPVSSGELLHSAQPLVSHPSHSLLHEVCYNCLRRKPGEGRASSGGYYFCSDTCSDHAKGFHDIDKDVDWSLFDYHCSSRGLKYPYMAKRLACMVISGSANADCLNILQPARLHQGTLIEMKEEFELLESTLRKAGFQEEATAYWYINVLARIRINAFRIELVASSYEDLLSSAAASVSCDSSVGNAVYMLPSFYNHDCDPNAHIVWLDSADAKLKALRDIEEGEELRICYIDTSLDADARQKILADGFGFKCHCLRCLSGD

SEQ ID NO: 11129 - DNA, 912 bp, Sorghum bicolor
  misc_feature: Ceres ANNOT ID no. 6120635
  misc_feature: Encodes the peptide sequence at SEQ ID NO 11130
atggatttctgccgccacctcctcctcgccgcggtgctcgtgctcgtgctcgagctcctccttgccggctgcgcctctgcggcgagccggggcgctggttccttcgacccctcccgcgtggtccaactctcgtggcgccccagggcgttcctgcacaagggtttcctgtcggatgcggagtgcgaccacctcatcgtgctggccaaggacaaactggagaagtctatggtagcggacaacgagtccggtaagagcgtccagagcgaggtgcgcaccagctccggcatgttcctggagaagaagcaggatgaagtagtaaggggaatagaggagaggatagctgcttggacatttcttccaccagagaatggtgaatccattcagatattacactaccagaatggtgagaaatacgaaccccactatgactacttccatgacaaaaataatcaagccctgggtggccatcgcattgccactgtgctcatgtacttatctaatgttgagaagggtggagagaccatcttccccaatgcagaggggaagctattacaacccaaggacgacacatggtctgattgtgcaagaaatggatatgcagttaaaccggtaaagggtgatgccctgctgttcttcagtctccaccctgatgcaacaacagactctgagagcttgcacggtagctgccccgtcatcgaaggccagaagtggtccgcaactaaatggatccatgtgaggtcgtttgatctccctgtcaagcagccgggttcctctgacggatgcgaggacgacaatgtcctctgtccccagtgggcggccgtgggcgagtgtgccaagaaccctaactacatggttgggaccaaggaagctcctggcttttgccggaagagctgcaaagtatgcgcagagtaa

SEQ ID NO: 11130 - protein, 303 aa, Sorghum bicolor
  misc_feature: Ceres ANNOT ID no. 6120635
  misc_feature (123)..(245): Pfam Id: 2OG-FeII_Oxy Pfam Desc: 2OG-Fe(II) oxygenase superfamily
  misc_feature (261)..(301): Pfam Id: ShK Pfam Desc: ShK domain-like
  misc_feature (35)..(302): NCBI GI: 92868637 NCBI Desc: metridin-like shk toxin; 2og-fe(ii) oxygenase [medicago truncatula]
  misc_feature (36)..(301): NCBI GI: 50845214 NCBI Desc: prolyl 4-hydroxylase [dianthus caryophyllus]
  misc_feature (26)..(302): NCBI GI: 18086437 NCBI Desc: at3g28480/mfj20_16 [arabidopsis thaliana]
  misc_feature (26)..(302): NCBI GI: 9294583 NCBI Desc: prolyl 4-hydroxylase alpha subunit-like protein [arabidopsis thaliana]
  misc_feature (5)..(301): NCBI GI: 34393269 NCBI Desc: prolyl 4-hydroxylase alpha-1 subunit precursor-like protein [oryza sativa (japonica cultivar-group)]
  misc_feature: The sequence is a functional homolog of SEQ ID NO. 333 in the 11/188,298 US application
MDFCRHLLLAAVLVLVLELLLAGCASAASRGAGSFDPSRVVQLSWRPRAFLHKGFLSDAECDHLIVLAKDKLEKSMVADNESGKSVQSEVRTSSGMFLEKKQDEVVRGIEERIAAWTFLPPENGESIQILHYQNGEKYEPHYDYFHDKNNQALGGHRIATVLMYLSNVEKGGETIFPNAEGKLLQPKDDTWSDCARNGYAVKPVKGDALLFFSLHPDATTDSESLHGSCPVIEGQKWSATKWIHVRSFDLPVKQPGSSDGCEDDNVLCPQWAAVGECAKNPNYMVGTKEAPGFCRKSCKVCAE

SEQ ID NO: 11131 - DNA, 720 bp, Sorghum bicolor
  misc_feature: Ceres ANNOT ID no. 6120655
  misc_feature: Encodes the peptide sequence at SEQ ID NO 11132
atgacggccgggaccatgcgcttgctgggcggggaggtgagcccgttcgcggcgcgggcgcgcctggcgctggagctgcgcggcgtggcgtacgagctcctggacgagccgctcggccccaagaaaagcgacaggctcctcgccgccaacccggtctacggcaagatccccgtgctgctcctccccgacggccgcgccatatgcgagtccgccgtcatcgtccagtacgtcgaggacgtcgcgcggggaagcggcggcgccgaggctggcggcctgctgctgccggacgacccatacgagcgcgccatgcaccgcttctggaccgtcttcatcgacgacaagttttggccggcgctggacgccgtctcgctggcgccgaccgcggacgcacgcgcgcaggccgtggtagacacccgcgccgcgctaaaccgcctggaggaggtgttcaaggaccgcagcaacggcgcggctttcttctccggccgcgacgcggcgccgggcctcctggacctggcactcggctgcttcctgccggcgctcagggcctgcgagcggctccacggcctctccctcatcgacgcgtccacgacgccgctcctggacgggtggagccggcgcttcgccgcgcacccggcagccaagcgcgtcctgccggacacggacaaggtggtgcagttcacgaggttcctccaggaaaagttcggggtccacgtgtcatga

SEQ ID NO: 11132 - protein, 239 aa, Sorghum bicolor
  misc_feature: Ceres ANNOT ID no. 6120655
  misc_feature (4)..(79): Pfam Id: GST_N Pfam Desc: Glutathione S-transferase, N-terminal domain
  misc_feature (1)..(239): NCBI GI: 55741086 NCBI Desc: bronze-2 protein [zea mays]
  misc_feature (1)..(239): NCBI GI: 23304519 NCBI Desc: bz2 (bronze2) [zea mays]
  misc_feature (1)..(239): NCBI GI: 55741044 NCBI Desc: bronze-2 protein [zea mays]
  misc_feature (6)..(239): NCBI GI: 549990 NCBI Desc: bz2
  misc_feature (48)..(219): NCBI GI: 42417174 NCBI Desc: bronze-2 protein [zea mays subsp. parviglumis]
MTAGTMRLLGGEVSPFAARARLALELRGVAYELLDEPLGPKKSDRLLAANPVYGKIPVLLLPDGRAICESAVIVQYVEDVARGSGGAEAGGLLLPDDPYERAMHRFWTVFIDDKFWPALDAVSLAPTADARAQAVVDTRAALNRLEEVFKDRSNGAAFFSGRDAAPGLLDLALGCFLPALRACERLHGLSLIDASTTPLLDGWSRRFAAHPAAKRVLPDTDKVVQFTRFLQEKFGVHVS

SEQ ID NO: 11133 - DNA, 1011 bp, Sorghum bicolor
  misc_feature: Ceres ANNOT ID no. 6120658
  misc_feature: Encodes the peptide sequence at SEQ ID NO 11134
atggcgtcgctgctccgcctccaggccctcgctccagccatgacagttccccgccaccatttcctcatctcccctctccgcctcgcctctgcagccacggctccgctcgctcgacgcctctccaccgccgtctccagcaacaagccggagccacgcgtctcggaaccggatctggaatcaggtctgtatcttgtggcaacgccaattgggaaccttgaagatatcaccttaagggcactgcgtgtccttaaatgtgctaatgtgatactatctgaagacacaaggcattcaggaaagctacttcaacattacaacatcaaaacacctcttcttagcttccataagttcaacgagcgtgagagagagcccagtatcttaaggaggcttcatgaaggcgaagcagttgcactgataagtgatgctggcacgccaggtattagtgaccctggcatggaactggctagactatgtgcaactgagaaaatccctgtcattcccattcctgggccttcggctgcaattgctgctctttctgcatcgggtctgccatcaaatgaattcacatttgttgggtttttaccaaagcatgctcggtcaagaagagataggcttgagatatctgctcatgaagctgctacacaaatattctatgttcctccccatggcattcatcagtttcttgttgatgctgcttcatcttttggtgattctaggcaatgcgttattgcaagggagataacaaaaatacatgaagagttttggcggggaactttaggtgaagcaaatgaagcctttgcaactcgacaaccaaagggagaaataacagtgctcatagaggggaagttaatttcagttgacgaatctccatcagaggatttccttgagcatgaactaagagaattgacggcaaagggttatactctttctgcggcggtgaaattggtcactgaagccacatcagcaaagaagaaagatgtttatgcactcgcattgaggttgtttggaaaataa

SEQ ID NO: 11134 - protein, 336 aa, Sorghum bicolor
  misc_feature: Ceres ANNOT ID no. 6120658
  misc_feature (61)..(262): Pfam Id: TP_methylase Pfam Desc: Tetrapyrrole (Corrin/Porphyrin) Methylases
  misc_feature (58)..(242): NCBI GI: 7767663 NCBI Desc: f27f5.18 [arabidopsis thaliana]
  misc_feature (55)..(333): NCBI GI: 17232172 NCBI Desc: tetrapyrrole methylase family protein [nostoc sp. pcc 7120]
  misc_feature (60)..(333): NCBI GI: 86605141 NCBI Desc: tetrapyrrole methylase family protein [cyanobacteria bacterium yellowstone a-prime]
  misc_feature (53)..(333): NCBI GI: 56751344 NCBI Desc: tetrapyrrole methylase family protein [synechococcus elongatus pcc 6301]
  misc_feature (62)..(333): NCBI GI: 22299057 NCBI Desc: tetrapyrrole methylase family protein [thermosynechococcus elongatus bp-1]
MASLLRLQALAPAMTVPRHHFLISPLRLASAATAPLARRLSTAVSSNKPEPRVSEPDLESGLYLVATPIGNLEDITLRALRVLKCANVILSEDTRHSGKLLQHYNIKTPLLSFHKFNEREREPSILRRLHEGEAVALISDAGTPGISDPGMELARLCATEKIPVIPIPGPSAAIAALSASGLPSNEFTFVGFLPKHARSRRDRLEISAHEAATQIFYVPPHGIHQFLVDAASSFGDSRQCVIAREITKIHEEFWRGTLGEANEAFATRQPKGEITVLIEGKLISVDESPSEDFLEHELRELTAKGYTLSAAVKLVTEATSAKKKDVYALALRLFGK

SEQ ID NO: 11135 - DNA, 2478 bp, Sorghum bicolor
  misc_feature: Ceres ANNOT ID no. 6120712
  misc_feature: Encodes the peptide sequence at SEQ ID NO 11136
atggtggttctggtcaaagtgttggtcacctgcgccaaattctgctgcccggcggcgagtttactcctctcggcctctacttctcgggctcgagctctacccggcgggccactgctgcggcgcagaactagcaaggtttcattacgctcaattgctatggctaccacacaagcctcagatgcagcggctgacaaaggattacctctggcagtggacgcgaccatggctgacgagtatgcctcacagtcaaagttgctgcaagaatttgttaaaatcccaactattggcaaggcttggatctttaattccaaggatgatgacatgtccaaagcagtggtttcgattggccaaacagatcttttggccaacaagaggagacaattccttctgaattctcacatttcaaagagtccaaaatctgttgatttcaagtggtcccctttcccgactgaaataagtggagcgtcagcagtaattccatcaccatctggagaaaaacttcttctagtacgcaattctgaggatgattcccctacaaaactggagatttggggcccatgtcaattagagaacgagatacatattgcaaaatctgttcatggatcactctatactgatgaatggtttggagggatatcatggaaccaggaggagactttcatagcttatgttgccgaggagcctcctcaaccaaaaccagtgtttaatgattatggattcaagaaggaaggctcatccgaaaaggactgcaagagctggaagggacaaggggattgggaggagacctggggagaaacgtattccaagaaaaggattcctgcgctgtttgtcgtcaacatatccagcggcgaagttcgacctgtcaagcaaatacctagatcattaagtgttggccaagtgatttgggctccatcttcttcatatagcttggtttttgttgcatggtcatctgacaatggtttccaagagacgccaaggaagcttggtattaaatactgctacaacagaccttgtgctttgtatgctgctcctgatcctttcagagaagaagctgagaaatcatcaactgagggcaataagagtgaaactacaactatgatcaaattaacaggagacctgatcagtgcttttttcccacggttcagtccggacgggaagtatcttgtgttcatctcagcgaagagtgctgtagatagtggggcacacaatgccacaaattcaatgcatagaatcgaatggcctgcagatggaaatttggatgggagccttggaattgctgatgtggtggccgttgtgatgtgccccaaagataactgtttccctgggctgtactgttttggcttgcttagggatccatggcttactgatggacaaactatgattatatcttctgtttggggaagtagggaagtaatactttccgtaaatgttgtgagctgtgaagtttcaagagttagtccccaggattcagattattcatggaatgttcttgcagttgataagaacaacattcttgcagtttccagcagccttattacactccctcagatgtactatgcgattaaggttcctcagactgaaagcaattgggagtggcaggaagtttcaactccttttccaaagccatctgataagatcagctccatattagcagaacataagttcagcatactcaaaatcccaattagcaacccttccgacaaacttgcaaatggggctaagcttccttttgaggctatttttgtatcacataaggattctgcaagtaatccaacaattgttgttcttcatggtggaccacactcagtttatccatcaagttattccaaatccttggcttttcttttttcgcagggatataatcttcttgttgtcaactacaggggttcgttaggctttggggaagaagcactacaatcccttcctggcaatatcggttctcaggatgtcaatgatgtattgacggcattggaccttgttataaagagaggactaatagatccatctagagtcgccgtagttggaggttcacatggaggtttcttgaccactcatttgatcggccaggctccagacacatttgttgcagcagctgctcgaaacccagtatgtaacttatcattgatggtgggtaccagtgacatccctgattggtgctttgttgagatttatggaaaagaagggaaaaagtacttctcagagtctccttcagtagacgatatttgtcaattccaccagaagtcaccaatttcacatatttcagaggtcaagacaccaacactctttctccttggagcgcaagatctcagagttccagtttctaatggcctgcagtatgcaagggctttgaaggagaggggaatcgaatccaaaactattatcttcccagaagatatccatggaatcgacaagcctcagtctgatttcgaaagcttcctcaacataggagtttggttcaagaagcacatgagcaaataa

SEQ ID NO: 11136 - protein, 825 aa, Sorghum bicolor
  misc_feature: Ceres ANNOT ID no. 6120712
  misc_feature (606)..(826): Pfam Id: Peptidase_S9 Pfam Desc: Prolyl oligopeptidase family
  misc_feature (593)..(804): Pfam Id: Abhydrolase_3 Pfam Desc: alpha/beta hydrolase fold
  misc_feature (53)..(825): NCBI GI: 115482018 NCBI Desc: os10g0415600 [oryza sativa (japonica cultivar-group)]
  misc_feature (64)..(824): NCBI GI: 115482020 NCBI Desc: os10g0415800 [oryza sativa (japonica cultivar-group)]
  misc_feature (56)..(822): NCBI GI: 30466066 NCBI Desc: acylamino acid-releasing enzyme [arabidopsis thaliana]
  misc_feature (56)..(382): NCBI GI: 7268163 NCBI Desc: acylaminoacyl-peptidase like protein [arabidopsis thaliana]
  misc_feature (368)..(824): NCBI GI: 38564417 NCBI Desc: acylpeptide hydrolase [danio rerio]
MVVLVKVLVTCAKFCCPAASLLLSASTSRARALPGGPLLRRRTSKVSLRSIAMATTQASDAAADKGLPLAVDATMADEYASQSKLLQEFVKIPTIGKAWIFNSKDDDMSKAVVSIGQTDLLANKRRQFLLNSHISKSPKSVDFKWSPFPTEISGASAVIPSPSGEKLLLVRNSEDDSPTKLEIWGPCQLENEIHIAKSVHGSLYTDEWFGGISWNQEETFIAYVAEEPPQPKPVFNDYGFKKEGSSEKDCKSWKGQGDWEETWGETYSKKRIPALFVVNISSGEVRPVKQIPRSLSVGQVIWAPSSSYSLVFVAWSSDNGFQETPRKLGIKYCYNRPCALYAAPDPFREEAEKSSTEGNKSETTTMIKLTGDLISAFFPRFSPDGKYLVFISAKSAVDSGAHNATNSMHRIEWPADGNLDGSLGIADVVAVVMCPKDNCFPGLYCFGLLRDPWLTDGQTMIISSVWGSREVILSVNVVSCEVSRVSPQDSDYSWNVLAVDKNNILAVSSSLITLPQMYYAIKVPQTESNWEWQEVSTPFPKPSDKISSILAEHKFSILKIPISNPSDKLANGAKLPFEAIFVSHKDSASNPTIVVLHGGPHSVYPSSYSKSLAFLFSQGYNLLVVNYRGSLGFGEEALQSLPGNIGSQDVNDVLTALDLVIKRGLIDPSRVAVVGGSHGGFLTTHLIGQAPDTFVAAAARNPVCNLSLMVGTSDIPDWCFVEIYGKEGKKYFSESPSVDDICQFHQKSPISHISEVKTPTLFLLGAQDLRVPVSNGLQYARALKERGIESKTIIFPEDIHGIDKPQSDFESFLNIGVWFKKHMSK

SEQ ID NO: 11137 - DNA, 1548 bp, Sorghum bicolor
  misc_feature: Ceres ANNOT ID no. 6120715
  misc_feature: Encodes the peptide sequence at SEQ ID NO 11138
atggacggcctcgcggcaccgtcgccgtcccactccggcgccacctccggcggcggggcctcccaccgcaagcggaagctcccgccgtcgtcgctttccgacgccaccgccgacgaggacgacgacaccaccgctccgtcatccccctccacggccccatcctcgccctcccgcccttcctctccatcttcctcacactccgacgatgacgaggacgactcgctccacacgttcaatgccgcgcgccttgacggcgcgccgggtgggggctccgcctccggccgtcctccgaagccggattcctcatcagtgtctgctgcgtcggccgccgccgcggctgcggcgggcggaggacccaagctggagcctggctcggcgaccgccggcgacgggaaggaggacccgaagggattgttcacggacaacctccagaccagcggcgcttacagcgcccgtgaggagggcctcaaacgcgaggaagattcgggaaggctgaaatttctctgttattctaacgatggtgttgatgaacacatgatatggttagtaggtttgaagaatatcttcgctcggcagcttccaaatatgcccaaagaatatattgtgcgccttgtcatggatagaactcacaagtcaatgatggttatcaggaacaatattgtcgtgggaggcattacttatcgcccttatgcaagccagaggtttggagaaatagcgttttgtgctatcacagctgatgagcaagttaaaggctatggaacaagattaatgaatcatttgaagcaacatgcacgggatgctgatgggctcacacatttcttaacctatgctgataataatgctgttggctattttgtaaagcagggtttcacaaaggagatcacattggacaaagaaagatggcaagggtacattaaagactatgacggaggaatattgatgcagtgtaaaattgacccaaagctgccatatgttgatctggcaacaatgattcgacgtcaaaggcaggccattgatgagaagatcagagacctttctaactgccatattgtttatcccggaattgatttccagaagaaagaagctggcattccaagaagactgataaagccagaagatatccctggtcttagggaagctgggtggacgcctgatcagtggggtcactctaaatcacgatcagcgttctccccggactataatacttacagacaacaacttgctaaccttatgcggacattgttgaagaatctgagtgaacatcctgatgcttggccatttaaagagcctgtggattcacgagatgttccagactattatgatatcataaaagatcctattgatttaaagacgatgttaagaagagttgactctgagcaatattatgtgaccctagagatgtttgtagccgacatgaagagaatgttcagcaatgcaagaacttacaattctccagatactatctattacaaatgcgcaacacggcttgaaaatttcttctcaaccaaaattgcttcactggtttcacaagcctcaaccaagagctag

SEQ ID NO: 11138 - protein, 515 aa, Sorghum bicolor
  misc_feature: Ceres ANNOT ID no. 6120715
  misc_feature (407)..(495): Pfam Id: Bromodomain Pfam Desc: Bromodomain
  misc_feature (214)..(291): Pfam Id: Acetyltransf_1 Pfam Desc: Acetyltransferase (GNAT) family
  misc_feature (1)..(515): NCBI GI: 18447805 NCBI Desc: histone acetyltransferase [zea mays]
  misc_feature (1)..(515): NCBI GI: 78708640 NCBI Desc: histone acetyltransferase [oryza sativa (japonica cultivar-group)]
  misc_feature (1)..(515): NCBI GI: 122063480 NCBI Desc: histone acetyltransferase gcn5
  misc_feature (275)..(514): NCBI GI: 7258364 NCBI Desc: histon acetyltransferase hat1 [arabidopsis thaliana]
  misc_feature (124)..(494): NCBI GI: 2707336 NCBI Desc: histone acetyltransferase [arabidopsis thaliana]
  misc_feature (1)..(515): SWISSPROT Homolog: EC 2.3.1.48 Histone acetyltransferase GCN5
MDGLAAPSPSHSGATSGGGASHRKRKLPPSSLSDATADEDDDTTAPSSPSTAPSSPSRPSSPSSSHSDDDEDDSLHTFNAARLDGAPGGGSASGRPPKPDSSSVSAASAAAAAAAGGGPKLEPGSATAGDGKEDPKGLFTDNLQTSGAYSAREEGLKREEDSGRLKFLCYSNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMQCKIDPKLPYVDLATMIRRQRQAIDEKIRDLSNCHIVYPGIDFQKKEAGIPRRLIKPEDIPGLREAGWTPDQWGHSKSRSAFSPDYNTYRQQLANLMRTLLKNLSEHPDAWPFKEPVDSRDVPDYYDIIKDPIDLKTMLRRVDSEQYYVTLEMFVADMKRMFSNARTYNSPDTIYYKCATRLENFFSTKIASLVSQASTKS

SEQ ID NO: 11139 - DNA, 984 bp, Sorghum bicolor
  misc_feature: Ceres ANNOT ID no. 6120858
  misc_feature: Encodes the peptide sequence at SEQ ID NO 11140
atggatccggtcacagcatccatacacggtcaccatcttcctccaccattcaacacccgcgacttccatcaccatctccagcagcagcagcagcagcagcatcaccagctgcagctcaagaccgaggacgaccatggtagcggcgggccaggggtgttcggctcccgcggcaacatcaagggcgaccaccacgagcataatgacgagaacagcggaaacagcaacgggagtggcggcggcggcggtggaggcgacgagctggcgctgattcccacgtctggtggcggcgggccagacggcggaggagacggcaccccgcgccgcccgaggggccggccggcggggtccaagaacaagccgaagccgcccatcatcatcaccagggacagcgccaacacgctccggacgcacgtcatggaggtggccgggggctgcgacatctccgagagcatcacggcgttcgcgcgccgcaggcagcgcggggtctgcgtcctcagcggcgccggcaccgtcaccaacgtcaccctgcggcagccggcctcccagggcgccgtcgtcgctctccacggccgcttcgagatcctctccctctccggctcgttcctcccgccgcccgcgccgcccgaagccacgggcctcaccgtctaccttgccggcgggcaggggcaggtggtgggcggcagcgtcgtcggcgcgctcacggcggctgggccggtggtgataatggcagcgtctttcgccaacgccgtgtacgagcggttgccgctggaggaggatgacatgctcgctgcacaggcacaggccgacagtgcaggaattctcgcgggtgcgcagcaagcggcgcagctcgccgccgccggcgctgtggatccaagcctcttccagggactgccgccgaacctgctcggcaacgtgcagctgccgccagaagcagcctacggatggaacccgggcgccgccggtggccgtccggcgccgttctaa

SEQ ID NO: 11140 - protein, 327 aa, Sorghum bicolor
  misc_feature: Ceres ANNOT ID no. 6120858
  misc_feature (44)..(327): NCBI GI: 119331584 NCBI Desc: at-hook dna-binding protein [catharanthus roseus]
  misc_feature (64)..(327): NCBI GI: 38346718 NCBI Desc: osjnba0086o06.16 [oryza sativa (japonica cultivar-group)]
  misc_feature (63)..(327): NCBI GI: 115474893 NCBI Desc: os08g0159700 [oryza sativa (japonica cultivar-group)]
  misc_feature (18)..(327): NCBI GI: 41052877 NCBI Desc: dna-binding protein-like [oryza sativa (japonica cultivar-group)]
  misc_feature (80)..(303): NCBI GI: 48716263 NCBI Desc: dna-binding protein-like [oryza sativa (japonica cultivar-group)]
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 1412 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 1928 in the 11/479,226US patent application
  misc_feature: The sequence is a functional homolog of SEQ ID NO 2038 in the 10/374,780US patent application
  misc_feature: The sequence is a functional homolog of SEQ ID NO 2154 in the 10/374,780US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 2370 in the 10/374,780US patent application
  misc_feature: The sequence is a functional homolog of SEQ ID NO 248 in the 10/714,887US patent application
  misc_feature: The sequence is a functional homolog of SEQ ID NO 248 in the 11/435,388US patent application
  misc_feature: The sequence is a functional homolog of SEQ ID NO 2528 in the 10/374,780US patent application
  misc_feature: The sequence is a functional homolog of SEQ ID NO 256 in the 10/225,066US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 264 in the 10/714,887US patent application
  misc_feature: The sequence is a functional homolog of SEQ ID NO 264 in the 11/435,388US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 298 in the 11/435,388US patent application
  misc_feature: The sequence is a functional homolog of SEQ ID NO 300 in the 10/714,887US patent application
  misc_feature: The sequence is a functional homolog of SEQ ID NO 314 in the 11/435,388US patent application
  misc_feature: The sequence is a functional homolog of SEQ ID NO 316 in the 10/714,887US patent application
  misc_feature: The sequence is a functional homolog of SEQ ID NO 318 in the 10/666,642US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 322 in the 11/435,388US patent application
  misc_feature: The sequence is a functional homolog of SEQ ID NO 324 in the 10/714,887US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 44 in the 10/669,824US patent application
  misc_feature: The sequence is a functional homolog of SEQ ID NO 44 in the 10/870,198US patent application
  misc_feature: The sequence is a functional homolog of SEQ ID NO 456 in the 10/374,780US patent application
  misc_feature: The sequence is a functional homolog of SEQ ID NO 48 in the 10/669,824US patent application
  misc_feature: The sequence is a functional homolog of SEQ ID NO 48 in the 10/870,198US patent application
  misc_feature: The sequence is a functional homolog of SEQ ID NO 498 in the 10/225,066US patent application
  misc_feature: The sequence is a functional homolog of SEQ ID NO 50 in the 10/669,824US patent application
  misc_feature: The sequence is a functional homolog of SEQ ID NO 50 in the 10/870,198US patent application
  misc_feature: The sequence is a functional homolog of SEQ ID NO 536 in the 10/225,066US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 66 in the 10/669,824US patent application
  misc_feature: The sequence is a functional homolog of SEQ ID NO 66 in the 10/870,198US patent application
  misc_feature: The sequence is a functional homolog of SEQ ID NO 830 in the 11/435,388US patent application
  misc_feature: The sequence is a functional homolog of SEQ ID NO 84 in the 10/870,198US patent application
  misc_feature: The sequence is a functional homolog of SEQ ID NO 86 in the 10/870,198US patent application
  misc_feature: The sequence is a functional homolog of SEQ ID NO 90 in the 10/669,824US patent application
  misc_feature: The sequence is a functional homolog of SEQ ID NO 92 in the 10/225,068US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 44 in the 20040128712 US patent application
  misc_feature: The sequence is a functional homolog of SEQ ID NO 48 in the 20040128712 US patent application
  misc_feature: The sequence is a functional homolog of SEQ ID NO 50 in the 20040128712 US patent application
  misc_feature: The sequence is a functional homolog of SEQ ID NO 64 in the 20040128712 US patent application
  misc_feature: The sequence is a functional homolog of SEQ ID NO 66 in the 20040128712 US patent application
  misc_feature: The sequence is a functional homolog of SEQ ID NO 90 in the 20040128712 US patent application
  misc_feature: The sequence is a functional homolog of SEQ ID NO 84 in the 20050097638 US patent application
  misc_feature: The sequence is a functional homolog of SEQ ID NO 86 in the 20050097638 US patent application
  misc_feature: The sequence is a functional homolog of SEQ ID NO 536 in the 20050160493 US patent application
  misc_feature: The sequence is a functional homolog of SEQ ID NO 1412 in the 20060162006 US patent application
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
  misc_feature: The sequence is a functional homolog of SEQ ID NO 1412 in the 10/374,780 US patent application
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 2038 in the 10/374,780 US patent application
  misc_feature: The sequence is a functional homolog of SEQ ID NO 2370 in the 10/374,780 US patent application
  misc_feature: The sequence is a functional homolog of SEQ ID NO 264 in the 10/714,887 US patent application
  misc_feature: The sequence is a functional homolog of SEQ ID NO 264 in the 11/435,388 US patent application
  misc_feature: The sequence is a functional homolog of SEQ ID NO 536 in the 10/225,066 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1413 in the 10/374,780 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: The sequence is a functional homolog of SEQ ID NO 1418 in the 10/374,780 US patent application
  misc_feature: The sequence is a functional homolog of SEQ ID NO 1414 in the 10/374,780 US patent application
  misc_feature: The sequence is a functional homolog of SEQ ID NO 92 in the 10/669,824 US patent application
  misc_feature: The sequence is a functional homolog of SEQ ID NO 88 in the 10/669,824 US patent application
  misc_feature: The sequence is a functional homolog of SEQ ID NO 86 in the 10/669,824 US patent application
  misc_feature: The sequence is a functional homolog of SEQ ID NO 90 in the 10/669,824 US patent application
  misc_feature: The sequence is a functional homolog of SEQ ID NO 89 in the 10/669,824 US patent application
  misc_feature: The sequence is a functional homolog of SEQ ID NO 87 in the 10/669,824 US patent application
MDPVTASIHGHHLPPPFNTRDFHHHLQQQQQQQHHQLQLKTEDDHGSGGPGVFGSRGNIKGDHHEHNDENSGNSNGSGGGGGGGDELALIPTSGGGGPDGGGDGTPRRPRGRPAGSKNKPKPPIIITRDSANTLRTHVMEVAGGCDISESITAFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEEDDMLAAQAQADSAGILAGAQQAAQLAAAGAVDPSLFQGLPPNLLGNVQLPPEAAYGWNPGAAGGRPAPF

SEQ ID NO: 11141 - DNA, 519 bp, Sorghum bicolor
  misc_feature: Ceres ANNOT ID no. 6120898
  misc_feature: Encodes the peptide sequence at SEQ ID NO 11142
atggactggtgcgaccgctgcgcccacgtgttcatgctggccttcctcaactccttcttcctgggcagcacggggattatcgtctacgtgctcgcgcgagatcactccatcagcacgtccggcaccgtcatggtctccgtcgtcctcgtcttctgggtgctcatcggcgccttcttctacttcgtctcctgtggcgccttcatcctctgctgcgtccgccgcatcgggtggctgccgcgccccagcgccggcggcggcggaggcagcaccttgcccgcggcggcggacatcccggcgtacgagctgcgggacgccgggcacgggcaggcggacggcggcgcgtctgctgattgcgcggtgtgtcttggcgagatggagacgggcgacatggtgaagcggctaccggtgtgcctccacgtgttccaccagcaatgcgtcgacaaatggctcaagaataactcgacgtgcccggtgtgcaggtgcaatgtgttcgcgccgctgccgatgcaaatggtgtaa

SEQ ID NO: 11142 - protein, 172 aa, Sorghum bicolor
  misc_feature: Ceres ANNOT ID no. 6120898
  misc_feature (118)..(159): Pfam Id: zf-C3HC4 Pfam Desc: Zinc finger, C3HC4 type (RING finger)
  misc_feature (84)..(168): NCBI GI: 115445315 NCBI Desc: os02g0249300 [oryza sativa (japonica cultivar-group)]
  misc_feature (104)..(169): NCBI GI: 53793111 NCBI Desc: el5-like [oryza sativa (japonica cultivar-group)]
  misc_feature (85)..(166): NCBI GI: 115445307 NCBI Desc: os02g0248200 [oryza sativa (japonica cultivar-group)]
  misc_feature (110)..(166): NCBI GI: 52077541 NCBI Desc: ring-h2 zinc finger protein-like [oryza sativa (japonica cultivar-group)]
  misc_feature (87)..(161): NCBI GI: 55741101 NCBI Desc: ring-h2 zinc finger protein [zea mays]
  misc_feature: The sequence is a functional homolog of SEQ ID NO. 329 in the 11/188,298 US application
  misc_feature: The sequence is a functional homolog of SEQ ID NO. 271 in the 11/188,298 US application
MDWCDRCAHVFMLAFLNSFFLGSTGIIVYVLARDHSISTSGTVMVSVVLVFWVLIGAFFYFVSCGAFILCCVRRIGWLPRPSAGGGGGSTLPAAADIPAYELRDAGHGQADGGASADCAVCLGEMETGDMVKRLPVCLHVFHQQCVDKWLKNNSTCPVCRCNVFAPLPMQMV

SEQ ID NO: 11143 - DNA, 702 bp, Sorghum bicolor
  misc_feature: Ceres ANNOT ID no. 6120901
  misc_feature: Encodes the peptide sequence at SEQ ID NO 11144
atggcgtgcttcaacagctccatccgcgtaatgatactggttttcatcaacacggtggtcatcggcggcactgcctccatcatctacacgttcgagcggggcataaaggcaccccaggtcatcctcatgttctttggcttattcaacgccaccatctaccccatcttctgcctcacgctcttcccgtggtccagtctagggcgttgcctgtgtcgcgtcggtgtgctgctctgcctgccgtggggccgcatgcgccgggcctggagcgccgccgccgccggcgaccacgacggcggcgatagtggctttggtttgccggagattgtggtgcagagacagggccagcaggtcaggaacgtgtttcctagggaggcggcgccaccgcttcccggcgaagtaggacctggtagagctgtcgtcgttgctgccggcgacgacgacatacctgcgtacgcgtacgagcagcaggccggcggcggcgcggtgccggagtacggcacgccgtcgtcggcagagtgcgcggtgtgcctaggagcgctcgagaagggggagatggtgaagagtctgccggtgtgcttgcacgtgttccaccagcactgcgtcgaccagtggctgcaccaccgcccgacgtgtccggtctgccggtgcaacgtcttcccttcacgtactgccgccattgccgggctaagtagtatagcatga

SEQ ID NO: 11144 - protein, 233 aa, Sorghum bicolor
  misc_feature: Ceres ANNOT ID no. 6120901
  misc_feature (173)..(214): Pfam Id: zf-C3HC4 Pfam Desc: Zinc finger, C3HC4 type (RING finger)
  misc_feature (124)..(226): NCBI GI: 115445307 NCBI Desc: os02g0248200 [oryza sativa (japonica cultivar-group)]
  misc_feature (148)..(225): NCBI GI: 115435246 NCBI Desc: os01g0213000 [oryza sativa (japonica cultivar-group)]
  misc_feature (125)..(233): NCBI GI: 53792026 NCBI Desc: ring finger-like [oryza sativa (japonica cultivar-group)]
  misc_feature (99)..(220): NCBI GI: 53793109 NCBI Desc: ring finger-like [oryza sativa (japonica cultivar-group)]
  misc_feature (99)..(220): NCBI GI: 53793050 NCBI Desc: ring finger-like [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MACFNSSIRVMILVFINTVVIGGTASIIYTFERGIKAPQVILMFFGLFNATIYPIFCLTLFPWSSLGRCLCRVGVLLCLPWGRMRRAWSAAAAGDHDGGDSGFGLPEIVVQRQGQQVRNVFPREAAPPLPGEVGPGRAVVVAAGDDDIPAYAYEQQAGGGAVPEYGTPSSAECAVCLGALEKGEMVKSLPVCLHVFHQHCVDQWLHHRPTCPVCRCNVFPSRTAAIAGLSSIA

SEQ ID NO: 11145 - DNA, 393 bp, Sorghum bicolor
  misc_feature: Ceres ANNOT ID no. 6120939
  misc_feature: Encodes the peptide sequence at SEQ ID NO 11146
atggcgtcgtcgtcgaccccggcggccgtccgcgagatgcagaaggatctcgaggtgcaggccaacgccctcagcaagatccagaaagacatcgccaagaaccaccaggtccgcaagcagtacaccatccaggtcggcgagaacgagctcgtcctcaaggagctggagctgctcagcgatggggctaacgtgtacaagctcatcggaccggtgctggtcaagcaggacctcgcggaggccaaggctaacgttaagaagcgcattgagtacatcacggcagagctgaagcggatggatcgggctctcaaagacttggaggaaaagcaaaacagcaagaaggaatcgatattcaagttgcaacagaggatgcaggctgtacaagctaaggcttag

SEQ ID NO: 11146 - protein, 130 aa, Sorghum bicolor
  misc_feature: Ceres ANNOT ID no. 6120939
  misc_feature (18)..(123): Pfam Id: Prefoldin_2 Pfam Desc: Prefoldin subunit
  misc_feature (2)..(116): NCBI GI: 50251815 NCBI Desc: prefoldin-like [oryza sativa (japonica cultivar-group)]
  misc_feature (53)..(130): NCBI GI: 115445291 NCBI Desc: os02g0246300 [oryza sativa (japonica cultivar-group)]
  misc_feature (12)..(130): NCBI GI: 87248333 NCBI Desc: prefoldin beta subunit [bombyx mori]
  misc_feature (12)..(127): NCBI GI: 121543907 NCBI Desc: prefoldin subunit 6-like protein [maconellicoccus hirsutus]
  misc_feature (10)..(130): NCBI GI: 116116889 NCBI Desc: ensangp00000016626 [anopheles gambiae str. pest]
MASSSTPAAVREMQKDLEVQANALSKIQKDIAKNHQVRKQYTIQVGENELVLKELELLSDGANVYKLIGPVLVKQDLAEAKANVKKRIEYITAELKRMDRALKDLEEKQNSKKESIFKLQQRMQAVQAKA

SEQ ID NO: 11147 - DNA, 2190 bp, Sorghum bicolor
  misc_feature: Ceres ANNOT ID no. 6120941
  misc_feature: Encodes the peptide sequence at SEQ ID NO 11148
atgactcaagctcattcaaagtcatgcttccaacaattttcagatggagttcaagttaagaggaacagtggcagcttcaccattgagctcctgccatctcttggtgcaacaataaatcaatctaacaagttgcagaagttcatcatatctccctatgatccccgttatagatactgggagttgttccttatagtcctagtcatttactctgcctggatttgcccgtttgaactagcatttttgagggacttgtcctctaagcttctgctagttgagaacattgtcaatagcttcttcgctattgatattgttttgacattctttgtagcttatgtcgacagcaaaacacatcttcttgtggatgatcgaaagagaattgcagtaaggtacctatcaacctggttcatctttgatgtatgttcaacagctccatttcagccaatcagccttctttttacacacaaggggaatgaccttgcttttaagatactcaatatgttgaggctatggcgtcttcaccgagtcagctcgctgtttgcaagactggagaaggatataagattcaactatttctggactaggtgctcaaaacttatttctgttactctgtttgcggtgcattgtgcgggatgtttcaactatatgattgccgacagatatcctgatccagagagaacatggataggtgctgttatgcctaccttcagatcagagagcttatggactagatatgtaactgccctttactggtcgatcacaacactgacaacaacaggttatggggacctacatgctgagaacccaagagagatgctgtttgatatctgctatatgctgtttaatctgggcctgacagcttatcttattggtaatatgaccaacctggttgttcatgggaccagccgcacccagaattttagggactcaatccaatcggcatcggaatttgcggcacgaaatcagttgcccgagaagataaagcagcaaatgttgtcgcacttctgcctacagttcaagacagaggggctcaaccagcaagctatgctaaattgtctcccaaaaggaattcggtcaagcatagcatacaacttattttttacaatcctacaacaagcctacctctttcatggagtatccaataatttcattgcagaactggtaatggatgtacaggctgagtatttcccaccaaaggaagacataatgttgcaaaatgagggggcagcagatatctacgtaatagtttcaggagtagtgaatttgataacaacaataaatggtaatgaacaggtgtatgaaaaagttgaggagggagacatgttcggagaggttggtgctctctgtgacataccccagccatttacttgccgcaccactaccctatcacagctcttgagaataaggaagataagactaacagagattatgcaagaacacagggaagacagcaatatactaatgaataatctatttcagaagctaaagctgcaggaaaatttaccagaattaaatcaactagatcgaagattcatgcacaagtatgagctattccatgctcctcgagaagcatggttgttacctcaaccttacctacaatacactgagcacaaatttgaagacattagtaagaaggtcccaacctttggtggagatcatggtccaacaaaactagcagcagaaacaatccaattgaggatgccacagcaaggaaacagtcatgaccatggcaattttggggcgacagatgggatggcaggcggagaagacaaatgtaatgaggttcacataaactgcgagaccaaaaaaggaaccaaagagttctgcgttcagataaaatccgaagattgtgatgcagcaagctattggcaaacaagtcatgaaacagtgaagctggggtcttcccacaatacattagatggcataactacgagagaaaatcaagatagtggtaacatacaatcatccaacaaaagagttacaattcacgcatatcctcataatgcaacaggttctttagtacagaatgggaagcttatcaatctgcctggttcactggaggagatttttgaaatcggaagtcagaagtttccaggtttccaccctacaaaattggtcagtagagactatgctgagatagatgacattagtgttattcgagatggtgaccacctattccttcttcagatgtag

SEQ ID NO: 11148 - protein, 729 aa, Sorghum bicolor
  misc_feature: Ceres ANNOT ID no. 6120941
  misc_feature (91)..(292): Pfam Id: Ion_trans Pfam Desc: Ion transport protein
  misc_feature (392)..(481): Pfam Id: cNMP_binding Pfam Desc: Cyclic nucleotide-binding domain
  misc_feature (201)..(298): Pfam Id: Ion_trans_2 Pfam Desc: Ion channel
  misc_feature (1)..(729): NCBI GI: 38489336 NCBI Desc: inward rectifying shaker k+ channel; zmk2.1 [zea mays]
  misc_feature (1)..(729): NCBI GI: 18077659 NCBI Desc: inwardly rectifying potassium channel [zea mays]
  misc_feature (1)..(536): NCBI GI: 115445285 NCBI Desc: os02g0245800 [oryza sativa (japonica cultivar-group)]
  misc_feature (1)..(495): NCBI GI: 15824823 NCBI Desc: inward rectifying shaker-like k+ channel [vitis vinifera]
  misc_feature (1)..(495): NCBI GI: 16516993 NCBI Desc: inward rectifying potassium channel [vitis vinifera]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO 3 in US patent 7235713
  misc_feature: The sequence is a functional homolog of SEQ ID NO 1838 in the 10/374,780 US patent application
  misc_feature: The sequence is a functional homolog of SEQ ID NO. 503 in the 11/188,298 US application
MTQAHSKSCFQQFSDGVQVKRNSGSFTIELLPSLGATINQSNKLQKFIISPYDPRYRYWELFLIVLVIYSAWICPFELAFLRDLSSKLLLVENIVNSFFAIDIVLTFFVAYVDSKTHLLVDDRKRIAVRYLSTWFIFDVCSTAPFQPISLLFTHKGNDLAFKILNMLRLWRLHRVSSLFARLEKDIRFNYFWTRCSKLISVTLFAVHCAGCFNYMIADRYPDPERTWIGAVMPTFRSESLWTRYVTALYWSITTLTTTGYGDLHAENPREMLFDICYMLFNLGLTAYLIGNMTNLVVHGTSRTQNFRDSIQSASEFAARNQLPEKIKQQMLSHFCLQFKTEGLNQQAMLNCLPKGIRSSIAYNLFFTILQQAYLFHGVSNNFIAELVMDVQAEYFPPKEDIMLQNEGAADIYVIVSGVVNLITTINGNEQVYEKVEEGDMFGEVGALCDIPQPFTCRTTTLSQLLRIRKIRLTEIMQEHREDSNILMNNLFQKLKLQENLPELNQLDRRFMHKYELFHAPREAWLLPQPYLQYTEHKFEDISKKVPTFGGDHGPTKLAAETIQLRMPQQGNSHDHGNFGATDGMAGGEDKCNEVHINCETKKGTKEFCVQIKSEDCDAASYWQTSHETVKLGSSHNTLDGITTRENQDSGNIQSSNKRVTIHAYPHNATGSLVQNGKLINLPGSLEEIFEIGSQKFPGFHPTKLVSRDYAEIDDISVIRDGDHLFLLQM

SEQ ID NO: 11149 - DNA, 2901 bp, Sorghum bicolor
  misc_feature: Ceres ANNOT ID no. 6120946
  misc_feature: Encodes the peptide sequence at SEQ ID NO 11150
atgctccaaccaagggaagctgatgtgcctgcactctttcttgtcttcattgtacttcccgtggtagcttattttcttcttgggagatggcatgatgctgcaagtaagaaggcaagggtaagtgtgcttgcacatcgagctgcagaagaagcctatagagaggaaacaatggcatgcccagacattattccgccagggccttccttgagaactatgccctatttcagacctgcaccttcattaagacaggaataccatgaatgtgcaacttgccatgcccctgcaaagactcgttgctccagatgcaagtctgttagatactgctctgggaagtgtcaaatagtacactggagacaaggacataaggaaacatgccaaaaatggcttggtagtggttctagcagctttggtggatctagcactgaggctactgagcagatgccgttcttgactaacttaaattcacctcttccgggtggtgacattcacttgcgtgacatgaactttgatactttatcagaaccatcctttcccacaactgatggctacaatctagatactgatccatttccggcagacagaagcaacatggatagatcaaatcaagggattcatatgagcgaaaatggtgctgttggtgtatcttttgaaaagaataattataatgctgctgatgaaatccactctccagagattttatctggcaacaaggtgtcaaacaactattttggttcagatgcaataagtggtaatggggatgcaacttatcctgccaaaagtaatgcacatcaacctagcagttgtgctcctgacatgagaaaacagtcaaaagcaagcatcacagtttatcagcctgacacgggtgtctatttaacttctgacatggtcagttcttgtgaggggtcatatgtttctgccagtgagccactgcaaaggagcttgtcgtctggaagaactattgggaaagcaaatgtggtgaataagaggcccccacacccatcaagtaaggtggtctcagcacagaagtcacaggatagggtgtctacatcatatcaaaacgatggtcatgagaagaatccttacaacaaaaatgaacaaagatctacccccacatgtgaatcaagtcaaccaacaagtagcaatctacaaaagtttggagcatccaaggttgaagttttaaagaagccttcaaaatttctcaaaaccagccttgtgggattgatcaatgataataagaggaacaaggtattgttcccatatgaagatcttgtcaagttttttcagtatgaagcacggggtatttctcctagaggtcttttcaattgtggaaacagctgctatgctaatgctgttcttcaatgtctcatgtgcacaaagccactgatgatctaccttcttctgagattgcattctaaagattgctcttcaaaaaattggtgccttatgtgtgaacttgagcaatatgcttcaactttacgtgaaagtggtggacccttatctccaagtagaattctttctaatctgaggaatattggatgtcgcttgggtggtggaactcaggaagatgctcatgagtttttaaggcatcttgtgatgtctatgcaagcagcttgcttggatgggctgggtggtgagaagcacgttgaaccaagtttgcaggaaacaacactgatacaacagatgtttggtggccgtcttaaatccaaggttaagtgcctcagatgctatcacgagtctgaaagatatgagaatataatggatcttactttggagattcatggctgggtagagtccttgcaagatgctttgacacagttcactgctcctgaagatttagatggtgataatatgtataaatgtggaaggtgttctgcctatgttaaagctaggaagcaactgagtgtgcatgaggtgccaaacatattgacacttgttcttaaaagatttcagtcaggaaaatatggcaagatcaataaatgtgttactttccctgatatgttggacatggttcctttcgtgactggatctggtgacaatccccctctttatttcttgtatgccgtggttgtacatgtggatacagaaaatgcatcattctctgggcactatatatcttacgtcaaagatatgcagggtacatggttgagaattgatgattcagaggtccaggttgtatcagtgaatcaagttatgtcagaaggtgcatatatgcttttctacttgaggtcttttccccgaccaccaagaatatacattgagaaggggctgcccgttacctctgtaaagcgtcacacttcaaaatcttccaagggctctaaacatgagcgcaagcagacttctgcaaatgatcaagcatatggggtttatgattttagacccgatggcgaaggctacatgcaagatcatcatgcagagttgagatccagagatttccatcatgccgatgatgcctttgcagactcagttagcacagacttctcggaagctacctcaagtgagtggtcgttgtttaccagctctgacgagtcctcatttaccactgaaagcacaagagattcattcagtgttgtggattatggagacaacgctggcctggatccaatttcctctatatttgggccaagttatgctccggagcaccctcctggcaatttcgtctcatgtacaaggttctcaccttccaatccacaaacaaggtacttctcagagagcacaggcttcgtctcggactcttccatgccggcccaccctagcggcattgtacatagaggaaggtatccagatagggcatgtgcctcttcagccgaaccgctcgcttcggcgcatcagcggagtgggtacggtcggtatccccttagtcgagatggttttgttcaaacatctgggttttgccaaatgtaa

SEQ ID NO: 11150 - protein, 966 aa, Sorghum bicolor
  misc_feature: Ceres ANNOT ID no. 6120946
  misc_feature (434)..(740): Pfam Id: UCH Pfam Desc: Ubiquitin carboxyl-terminal hydrolase
  misc_feature (88)..(125): Pfam Id: zf-MYND Pfam Desc: MYND finger
  misc_feature (1)..(966): NCBI GI: 115445271 NCBI Desc: os02g0244300 [oryza sativa (japonica cultivar-group)]
  misc_feature (321)..(777): NCBI GI: 18394440 NCBI Desc: ubiquitin-specific protease 15 (ubp15) [arabidopsis thaliana]
  misc_feature (321)..(777): NCBI GI: 11993475 NCBI Desc: ubiquitin-specific protease 15 [arabidopsis thaliana]
  misc_feature (131)..(901): NCBI GI: 140055235 NCBI Desc: peptidase c19, ubiquitin carboxyl-terminal hydrolase 2; zinc finger, mynd-type [medicago truncatula]
  misc_feature (389)..(914): NCBI GI: 11993477 NCBI Desc: ubiquitin-specific protease 16 [arabidopsis thaliana]
MLQPREADVPALFLVFIVLPVVAYFLLGRWHDAASKKARVSVLAHRAAEEAYREETMACPDIIPPGPSLRTMPYFRPAPSLRQEYHECATCHAPAKTRCSRCKSVRYCSGKCQIVHWRQGHKETCQKWLGSGSSSFGGSSTEATEQMPFLTNLNSPLPGGDIHLRDMNFDTLSEPSFPTTDGYNLDTDPFPADRSNMDRSNQGIHMSENGAVGVSFEKNNYNAADEIHSPEILSGNKVSNNYFGSDAISGNGDATYPAKSNAHQPSSCAPDMRKQSKASITVYQPDTGVYLTSDMVSSCEGSYVSASEPLQRSLSSGRTIGKANVVNKRPPHPSSKVVSAQKSQDRVSTSYQNDGHEKNPYNKNEQRSTPTCESSQPTSSNLQKFGASKVEVLKKPSKFLKTSLVGLINDNKRNKVLFPYEDLVKFFQYEARGISPRGLFNCGNSCYANAVLQCLMCTKPLMIYLLLRLHSKDCSSKNWCLMCELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGRCSAYVKARKQLSVHEVPNILTLVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYLRSFPRPPRIYIEKGLPVTSVKRHTSKSSKGSKHERKQTSANDQAYGVYDFRPDGEGYMQDHHAELRSRDFHHADDAFADSVSTDFSEATSSEWSLFTSSDESSFTTESTRDSFSVVDYGDNAGLDPISSIFGPSYAPEHPPGNFVSCTRFSPSNPQTRYFSESTGFVSDSSMPAHPSGIVHRGRYPDRACASSAEPLASAHQRSGYGRYPLSRDGFVQTSGFCQM

SEQ ID NO: 11151 - DNA, 1023 bp, Sorghum bicolor
  misc_feature: Ceres ANNOT ID no. 6120950
  misc_feature: Encodes the peptide sequence at SEQ ID NO 11152
atggcgccgtccaggcacgcggacgagggcgggcagctccagctcatggacgccgacagggtcgacgacgaggaggagtgcttcgagtccatcgacaagctgatttctcaggggataaatgcaggagacgtgaagaagctgcaggatgcagggatttacacttgcaatggcctaatgatgcatactaagaagaaccttacaggaatcaaaggtttatctgaagcaaaagttgataagatctgcgaggcagctgaaaaacttctgaaccagggcttcatgacaggaactgatctccttcttaagcggaagtctgttgttcggattacaactgggagccaggcacttgacgagctgcttggcggagggattgaaacactttgcatcacagaggcattcggggagttccggtcagggaagacccagttggctcatactctatgtgtctccactcagcttccaatccacatgcatggggggaatgggaaggttgcctacattgacactgagggaacattccgacctgaacgcattgtgccaattgctgagagatttgggatggatgccaatgctgttctcgacaatatcatatatgctcgtgcatacacctatgagcaccagtacaacttgctcctgggccttgctgccaagatggctgaagaacctttcagacttctgattgtggattctgtgattgcactatttcgtgttgatttcagtggcaggggtgaacttgcagagcgtcagcaaaagctagcacagatgctgtcccgacttaccaagattgctgaggagttcaatgttgcagtgtacatcaccaaccaagtgattgccgatccaggtggtggtatgttcataactgatccaaagaaaccagcaggcggccatgtgttggcgcatgctgccaccatcagattgatgctgaggaaaggcaaaggcgaacaacgtgtctgcaagatcttcgatgccccaaaccttcctgaaggagaagttacgtcaggtggaatcatggacgcaaaagactga

SEQ ID NO: 11152 - protein, 340 aa, Sorghum bicolor
  misc_feature: Ceres ANNOT ID no. 6120950
  misc_feature (84)..(339): Pfam Id: Rad51 Pfam Desc: Rad51
  misc_feature (1)..(340): NCBI GI: 21805945 NCBI Desc: dmc1 protein type b [oryza sativa (indica cultivar-group)]
  misc_feature (1)..(340): NCBI GI: 14588672 NCBI Desc: rilim15b [oryza sativa]
  misc_feature (1)..(340): NCBI GI: 21322144 NCBI Desc: dmc1 [oryza sativa (japonica cultivar-group)]
  misc_feature (1)..(340): NCBI GI: 115484153 NCBI Desc: os11g0146800 [oryza sativa (japonica cultivar-group)]
  misc_feature (1)..(340): NCBI GI: 14669856 NCBI Desc: rilim15b [oryza sativa]
MAPSRHADEGGQLQLMDADRVDDEEECFESIDKLISQGINAGDVKKLQDAGIYTCNGLMMHTKKNLTGIKGLSEAKVDKICEAAEKLLNQGFMTGTDLLLKRKSVVRITTGSQALDELLGGGIETLCITEAFGEFRSGKTQLAHTLCVSTQLPIHMHGGNGKVAYIDTEGTFRPERIVPIAERFGMDANAVLDNIIYARAYTYEHQYNLLLGLAAKMAEEPFRLLIVDSVIALFRVDFSGRGELAERQQKLAQMLSRLTKIAEEFNVAVYITNQVIADPGGGMFITDPKKPAGGHVLAHAATIRLMLRKGKGEQRVCKIFDAPNLPEGEVTSGGIMDAKD

SEQ ID NO: 11153 - DNA, 978 bp, Sorghum bicolor
  misc_feature: Ceres ANNOT ID no. 6120983
  misc_feature: Encodes the peptide sequence at SEQ ID NO 11154
atggcgccggcgtccttgttgttgacgcgagtggcggcggcgacggtggccgtggcgtgcgtggtggcgctcggcgccatggcgcagcagctgtcgccgacgttctacgacgcgagctgccccaacctgcagagcatcgtgcgctccggcatggccgccgccgtgcagcaggagccccggatgggggcctccatcctccgcctcttcttccacgactgcttcgtccaggggtgcgacgcgtccgtgctcctcgacgactcggcgacgctgacgggggagaagaacgcggcgcccaacgccaactcgctgcggggcttcgaggtcatcgacgccatcaagtcccaggtggaggccgcctgccccggcaccgtctcctgcgccgacatcctcgccctcgccgcgcgcgacggcgtcaacctgctgagcgggccgacatgggcggtgcagctagggcggcgggacacgcggacggcgagccagtcggcggcgaacagcaacctcccgtcgccatcctcgagcgcggcggcactggtgtcggcgttcgcgtccaagggtctggactcgcgggacctggtggcgctctccggcgcgcacacgatcggggcggcgcggtgcgcgagcttccggtcgcggatctacaacgacagcaacatcaacgccgggttcgcggcgaagcggaagcagatctgcgggccgcagtcgggcggcaccgacggcaacctggcgccgctggacgccatgagctccgtcaagttcgacaacggctacttccgggacctcgtgtcccagttcggcctcctccactccgaccaggagctcttcggcgccggcgtcgtcgactccgtcacggcgaggtacgcgcgcaacggcgccgccttctcgtcggacttcgtcaccgccatcgtcaagatgggtaacatcagcccgctcaccggctcctccggcgagatccgcgccaactgccggaaacccaactag

SEQ ID NO: 11154 - protein, 325 aa, Sorghum bicolor
  misc_feature: Ceres ANNOT ID no. 6120983
  misc_feature (47)..(289): Pfam Id: peroxidase Pfam Desc: Peroxidase
  misc_feature (13)..(325): NCBI GI: 5453379 NCBI Desc: bacterial-induced peroxidase precursor [gossypium hirsutum]
  misc_feature (15)..(325): NCBI GI: 61697137 NCBI Desc: peroxidase [populus alba x populus tremula var. glandulosa]
  misc_feature (11)..(325): NCBI GI: 55700871 NCBI Desc: tpa: class iii peroxidase 2 precursor [oryza sativa (japonica cultivar-group)]
  misc_feature (21)..(325): NCBI GI: 32351452 NCBI Desc: class iii peroxidase [gossypium hirsutum]
  misc_feature (6)..(325): NCBI GI: 66840766 NCBI Desc: peroxidase [picea abies]
  misc_feature (30)..(325): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Useful for making plants with modulated oxidative stress sensitivity
  misc_feature: Functional homolog of the protein sequence given in SEQ ID NO 13607
MAPASLLLTRVAAATVAVACVVALGAMAQQLSPTFYDASCPNLQSIVRSGMAAAVQQEPRMGASILRLFFHDCFVQGCDASVLLDDSATLTGEKNAAPNANSLRGFEVIDAIKSQVEAACPGTVSCADILALAARDGVNLLSGPTWAVQLGRRDTRTASQSAANSNLPSPSSSAAALVSAFASKGLDSRDLVALSGAHTIGAARCASFRSRIYNDSNINAGFAAKRKQICGPQSGGTDGNLAPLDAMSSVKFDNGYFRDLVSQFGLLHSDQELFGAGVVDSVTARYARNGAAFSSDFVTAIVKMGNISPLTGSSGEIRANCRKPN

SEQ ID NO: 11155 - DNA, 1293 bp, Sorghum bicolor
  misc_feature: Ceres ANNOT ID no. 6120991
  misc_feature: Encodes the peptide sequence at SEQ ID NO 11156
atggcgatgctctcccgcgcggcctcctccgcggcccggcgcccggcactgctgccgccgaggctgctggcggcgagggcgatggcgtcgtcgctcttcggccacgtcgagccggcgcccaaggacccaatcctcggcgtcaccgaggctttcctcgccgacccctcgcccgacaaagtcaacgtcggcgtcggcgcctaccgggacgacaacggccagcccgtcgtgctcagctgcgtgcgcgaggccgagcgccggatcgcgggcaacctcaacatggagtaccttccgatgggaggcagtatcaagatgattgaagagtcactgaagctggcgtacggtgaggattctggcttcatcaaagataagaggatagcagcggtgcaggctctttcaggcactggtgcctgccggctctttgctgatttccagaagcgttttttgccggattcgcagatctacataccaacaccaacgtggtccaaccatcacaatatctggagggatgctcacgtgccacagaagacattcacatactaccatccagagtcaagagggcttgatttttcaggattgatgaatgacatcaagaatgctccagacggttcattctttttgcttcatgcatgtgcccataatcctactggtgtagatcctacagaggaacaatggagagaaatatcccatcagttcaaggtgaaaaaacatttcccattctttgacatggcataccaagggtttgccagtggtgatccagagagagatgccaaggcaatccgaattttccttgaagatggacaccaaattggatgtgctcagtcatacgcaaagaacatgggactttatggacagagagcgggatgcctgagtattctgtgtgaggatgagatgcaagcagttgctgtcaagagccaactgcaacagatcgcgagaccaatgtacagcaacccacctgttcatggtgcactggttgtttctataatcctcaatgatccagaattgaagagtttatggttaaaagaagtcaagggtatggctgatcgtatcattggcatgcggaaggcacttaaggaaaatcttataaagctaggttcacctttgtcatgggatcatatcactaatcagattggaatgttctgctacagtggtatgacacctgaacaagttgaccgtttaacaaatgaataccatatttacatgacccgcaatgggaggataagcatggctggtgtaacaacaggaaatgttgcttacttggcaaatgcgattcatgaggttaccaaaccaaactga

SEQ ID NO: 11156 - protein, 430 aa, Sorghum bicolor
  misc_feature: Ceres ANNOT ID no. 6120991
  misc_feature (57)..(423): Pfam Id: Aminotran_1_2 Pfam Desc: Aminotransferase class I and II
  misc_feature (1)..(428): NCBI GI: 20601 NCBI Desc: aspartate aminotransferase [panicum miliaceum]
  misc_feature (1)..(428): NCBI GI: 20597 NCBI Desc: aspartate aminotransferase [panicum miliaceum]
  misc_feature (1)..(428): NCBI GI: 115468452 NCBI Desc: os06g0548000 [oryza sativa (japonica cultivar-group)]
  misc_feature (1)..(428): NCBI GI: 2696240 NCBI Desc: aspartate aminotransferase [oryza sativa (japonica cultivar-group)]
  misc_feature (1)..(428): NCBI GI: 22136256 NCBI Desc: aspartate aminotransferase aat1 [arabidopsis thaliana]
  misc_feature (1)..(428): SWISSPROT Homolog: EC 2.6.1.1 Aspartate aminotransferase, mitochondrial precursor
  misc_feature: Useful for making plants with modulated nitrogen use efficiency
  misc_feature: Functional homolog of the protein sequence given in SEQ ID NO 13663
MAMLSRAASSAARRPALLPPRLLAARAMASSLFGHVEPAPKDPILGVTEAFLADPSPDKVNVGVGAYRDDNGQPVVLSCVREAERRIAGNLNMEYLPMGGSIKMIEESLKLAYGEDSGFIKDKRIAAVQALSGTGACRLFADFQKRFLPDSQIYIPTPTWSNHHNIWRDAHVPQKTFTYYHPESRGLDFSGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLIKLGSPLSWDHITNQIGMFCYSGMTPEQVDRLTNEYHIYMTRNGRISMAGVTTGNVAYLANAIHEVTKPN

SEQ ID NO: 11157 - DNA, 1731 bp, Sorghum bicolor
  misc_feature: Ceres ANNOT ID no. 6120997
  misc_feature: Encodes the peptide sequence at SEQ ID NO 11158
atggcggtggtgcgaccaagatcggcggcgcacctctctctcctcttcctgctcctcctcgccccgccttgttccccgcaggagcaagacgacggcggcggcggcgtcgccctccacgggagcttcgtccgctgcgtcgcgcgcctctcgccggcgaccaccgacccgtcccggctcgtccacgcaccgtcggcggcgtcctacacttccctgctcaacgccaccatccagaacctccgcttcgcctccccacggacgccgcggccggcgctgctcctgacaccggcgaccgtcgccgaggtgcgggcctgcgtcgcctgctgccggcgccagggcctcacggtccgcgcccgcagcggcggccacgactacgagggcctctcctaccgctcggtcctccagagcgctggcaccgcccgccccttcgccgtggtcgacgtcgccgcgctgcgcgatgtccgcgtcgatgccgcgcgccgcgtggcgacggtcgggccgggcgccacgctcggggagctctactacgcagtggcgcgagacagcggcggggcgctggggttccccgcggggatctgccccacggtctgtgtgggcggccacctcagcggcggcgggttcggccccatgatgcggaagcacgggctgggcgcggacaacgtggtggacgccgaggtggtggacgccgacgggaggctcctggaccgcgcggccatgggcgagggccacttctgggcgatccgcggcggtgggggcgggagctttggcgtggtggtttcctggacggtgcggctggtccccgtgccgcgcgtcgtctccgccttcaccgtgcgccgcctggtccgccgcggggaccgacggcagacccaggcgacggtccggctgctggccaagtggcagcgcgtggcgcacgcgctccccgacgacctgttcgtgaaggcggccatggagccggagctcgacgacgccggcgagaggcacccgctggtgaccttcaagtcgctgttcctcggcggcaactgcagcgggatggtggcggagatgagcgcccacctaccggagctcggcgtcacggcgagcgactgcagagacatgagctggatccagtcaatgctctacttctacgggtacacgagcgggcagaccgccgcggaggtgctccttgaccggagcctgcagcccaaggactactacaaggtcaagctggactacgtgacgaccccgatcccggcggccgggctggcggggctcctcgccagggtggtggaggacaggggcgggtccatcgacgtggacccacagggtggcgccatgagcgcgacaccggagtcggacacgccgtacgcgcaccggcgagggtacctatacaacgtgcagtacttcgtcaagtggggcggcgacgccaacgtgtcgtacgaggacgcgcacctcgggtgggtgcggggcgtgcaccggtggatgacgccgtacgcgagcgcgagtccccgggcggcgtacgtcaacttcagggacctggacctagggcagaacgtggatgggaagacgacctacgaggccgccagggcgtggggggagatgtacttcaggggcaacttcaggaggctggccatggtgaaggccgaggtggatcctgaccaggtgttctggagtgagcagagcatccctcccctgtttgaggttggggaggagacaggggaatggcacagtcagagtgggttgttttcagacagttga

SEQ ID NO: 11158 - protein, 576 aa, Sorghum bicolor
  misc_feature: Ceres ANNOT ID no. 6120997
  misc_feature (89)..(236): Pfam Id: FAD_binding_4 Pfam Desc: FAD binding domain
  misc_feature (497)..(554): Pfam Id: BBE Pfam Desc: Berberine and berberine like
  misc_feature (49)..(312): NCBI GI: 41393750 NCBI Desc: fad-linked oxidoreductase bg60 [cynodon dactylon]
  misc_feature (36)..(337): NCBI GI: 115468468 NCBI Desc: os06g0549900 [oryza sativa (japonica cultivar-group)]
  misc_feature (56)..(312): NCBI GI: 55859456 NCBI Desc: pollen allergen sec c 4 [secale cereale]
  misc_feature (56)..(337): NCBI GI: 115468462 NCBI Desc: os06g0549300 [oryza sativa (japonica cultivar-group)]
  misc_feature (56)..(337): NCBI GI: 55859454 NCBI Desc: pollen allergen sec c 4 [secale cereale]
  misc_feature: Useful for making plants with modulated drought sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13491
MAVVRPRSAAHLSLLFLLLLAPPCSPQEQDDGGGGVALHGSFVRCVARLSPATTDPSRLVHAPSAASYTSLLNATIQNLRFASPRTPRPALLLTPATVAEVRACVACCRRQGLTVRARSGGHDYEGLSYRSVLQSAGTARPFAVVDVAALRDVRVDAARRVATVGPGATLGELYYAVARDSGGALGFPAGICPTVCVGGHLSGGGFGPMMRKHGLGADNVVDAEVVDADGRLLDRAAMGEGHFWAIRGGGGGSFGVVVSWTVRLVPVPRVVSAFTVRRLVRRGDRRQTQATVRLLAKWQRVAHALPDDLFVKAAMEPELDDAGERHPLVTFKSLFLGGNCSGMVAEMSAHLPELGVTASDCRDMSWIQSMLYFYGYTSGQTAAEVLLDRSLQPKDYYKVKLDYVTTPIPAAGLAGLLARVVEDRGGSIDVDPQGGAMSATPESDTPYAHRRGYLYNVQYFVKWGGDANVSYEDAHLGWVRGVHRWMTPYASASPRAAYVNFRDLDLGQNVDGKTTYEAARAWGEMYFRGNFRRLAMVKAEVDPDQVFWSEQSIPPLFEVGEETGEWHSQSGLFSDS

SEQ ID NO: 11159 - DNA, 543 bp, Sorghum bicolor
  misc_feature: Ceres ANNOT ID no. 6121012
  misc_feature: Encodes the peptide sequence at SEQ ID NO 11160
atgcatgaattggatggccaggtttatcactctagttttgttgatgatgatgggatcaaaaaagcttgcagctgtcctttgcttccactgaaaactcatatcaagggcccagcaccagcctctgaccctgataaagcggacattgttgatgaagccataactttctttcgggccaatgttttcttcaaaaatttccatgtcaaaagctcagcagacaagttattgatctatttgacgtcttatatcaatattgccttaaaaagactagaaggttgccggacactagctgttgggactaaggcaatcattaatctgggattggagaaagttcctgtacctggggaaccagggtttcctttccctggacttttcactcttccccagtcccaggaggaagcagaattgttgaggaattatttgaagcagataagggaggaaacaagtggaagattgctcaactgtgcatacagagctaatggctttccaaacaaatggtggttggcttttgctaagaggaagttcatgaacattgtcatcctttag

SEQ ID NO: 11160 - protein, 180 aa, Sorghum bicolor
  misc_feature: Ceres ANNOT ID no. 6121012
  misc_feature (9)..(179): Pfam Id: P21-Arc Pfam Desc: P21-ARC (ARP2/3 complex 21 kDa subunit)
  misc_feature (8)..(180): NCBI GI: 115445209 NCBI Desc: os02g0235000 [oryza sativa (japonica cultivar-group)]
  misc_feature (8)..(180): NCBI GI: 18406746 NCBI Desc: arp2/3 complex 21 kda subunit family [arabidopsis thaliana]
  misc_feature (8)..(180): NCBI GI: 21536845 NCBI Desc: contains similarity to 21 kd subunit of the arp2/3 protein complex (arc21) [arabidopsis thaliana]
  misc_feature (8)..(178): NCBI GI: 140068853 NCBI Desc: arp2/3 complex, 21 kda p21-arc subunit [medicago truncatula]
  misc_feature (11)..(180): NCBI GI: 3249086 NCBI Desc: contains similarity to 21 kd subunit of the arp2/3 protein complex (arc21) gbaf006086 from homo sapiens. est gbz37222 comes [arabidopsis thaliana]
MHELDGQVYHSSFVDDDGIKKACSCPLLPLKTHIKGPAPASDPDKADIVDEAITFFRANVFFKNFHVKSSADKLLIYLTSYINIALKRLEGCRTLAVGTKAIINLGLEKVPVPGEPGFPFPGLFTLPQSQEEAELLRNYLKQIREETSGRLLNCAYRANGFPNKWWLAFAKRKFMNIVIL

SEQ ID NO: 11161 - DNA, 1755 bp, Sorghum bicolor
  misc_feature: Ceres ANNOT ID no. 6121019
  misc_feature: Encodes the peptide sequence at SEQ ID NO 11162
atgaactgctcctcttgctgcgccgccgccgttccgtctcctccggtgcttctcgccaggccgcgggggggtttagctgctagctgctccacaagaacagatgagaaggtgcttttcctaggcccaaaacagtttccacggatcacatacagcccagtaagccgtgcgtcgtcacggttgtcacggagagaggtaatagcttttgccgggcaacaaccttgggacctcggcagatttttcaagacattgtacttcttcaacggccctccaaaccctctcaagattgtagaatctatcatcagcagtttcactggacctgcttctagtgaagcgccaaaaaaaatggaaacatcggatgtggtgctggttacaggagccactggtggtgttgggcgacgggtggtcgacatcctgcggaagaagggcatacctgttcgagtattggctagaaatggagacaaggcaaggagcatgttggggccggatgtaaatctgatcataggagatgttacaaaggaagatacgcttgatcctaagctcttcaaaggcataaaaaaagtagtcaatgcagtctctgtcatagtggggccaaaggaaggtgatacaccagacaggcagaagtacaaacaaatcaagggaccttcacctgaaatggttgagtacatcggaatgcaaaacttgattagtgccataaagaatagtgttggactgagtgaagggaaactgctatttgggctcaaaggcaatttatctggaaagattgtgtggggagctcttgatgacgttgtaatgggtggtgttagtgaaagtacattccaaatcctgccaacaggaagtgaaagtagtgaaccaactgggttgttcaaagggactgtatctacttcaaataacggtgggtttactagtataaggacaaagaattttaccgtgccagaggacctgtcagcatatgatggtattgaattacgagttaaaggtgatggacgacggtataaactcattatacggactagctatgaatgggatactgttggctatacagcaagttttgacacgactaagggggaatggcaaagtgttaaagtacctttctcttctctgaaaccggtattccgtgctcgtactatgactgatgctccacccttcgatgcaagcaacattacttcactacaacttatgtttagcaaattcgaatacgatggaatactcaacccaacatttactgaaggtccatttgagcttcctttttcgagtattagagcatacataaacgagccgatcactccaaggtttgttcatgtgagttctgcgggagtgacaagacctgaaagaccagggctagatttaagcaaacagccacctgctgttcgattgaacaaagagcttggctccattttaacttataagttgaagggagaggatttgattcgggaaagtggtattccgtacactattgtacggccatgtgcattaactgaggaaccagctggagccgatctcatctttgaccagggagacaacatcacaggaaagatatcaagggaagaagttgcccgtatttgtgtagcagctctggcaagcccaaatgcagtgggcaaaactttcgaggtcaagagcactgttccatttagtgaaccatatgtgattgaccctacaaatcccccatcagaaaaggactatgatgtatatttcaaagaactcaaagaaggcatcacgggtaaagaggcattagaggcaacacctgcccaagtttga

SEQ ID NO: 11162 - protein, 584 aa, Sorghum bicolor
  misc_feature: Ceres ANNOT ID no. 6121019
  misc_feature (242)..(421): Pfam Id: CIA30 Pfam Desc: Complex I intermediate-associated protein 30 (CIA30)
  misc_feature (54)..(584): NCBI GI: 20339364 NCBI Desc: uos1 [pisum sativum]
  misc_feature (71)..(537): NCBI GI: 67922003 NCBI Desc: similar to nucleoside-diphosphate-sugar epimerases [crocosphaera watsonii wh 8501]
  misc_feature (74)..(538): NCBI GI: 113476961 NCBI Desc: nmra-like [trichodesmium erythraeum ims101]
  misc_feature (256)..(440): NCBI GI: 86606344 NCBI Desc: conserved domain protein [cyanobacteria bacterium yellowstone a-prime]
  misc_feature (234)..(443): NCBI GI: 86609445 NCBI Desc: conserved domain protein [cyanobacteria bacterium yellowstone b-prime]
MNCSSCCAAAVPSPPVLLARPRGGLAASCSTRTDEKVLFLGPKQFPRITYSPVSRASSRLSRREVIAFAGQQPWDLGRFFKTLYFFNGPPNPLKIVESIISSFTGPASSEAPKKMETSDVVLVTGATGGVGRRVVDILRKKGIPVRVLARNGDKARSMLGPDVNLIIGDVTKEDTLDPKLFKGIKKVVNAVSVIVGPKEGDTPDRQKYKQIKGPSPEMVEYIGMQNLISAIKNSVGLSEGKLLFGLKGNLSGKIVWGALDDVVMGGVSESTFQILPTGSESSEPTGLFKGTVSTSNNGGFTSIRTKNFTVPEDLSAYDGIELRVKGDGRRYKLIIRTSYEWDTVGYTASFDTTKGEWQSVKVPFSSLKPVFRARTMTDAPPFDASNITSLQLMFSKFEYDGILNPTFTEGPFELPFSSIRAYINEPITPRFVHVSSAGVTRPERPGLDLSKQPPAVRLNKELGSILTYKLKGEDLIRESGIPYTIVRPCALTEEPAGADLIFDQGDNITGKISREEVARICVAALASPNAVGKTFEVKSTVPFSEPYVIDPTNPPSEKDYDVYFKELKEGITGKEALEATPAQV

SEQ ID NO: 11163 - DNA, 1488 bp, Sorghum bicolor
  misc_feature: Ceres ANNOT ID no. 6121024
  misc_feature: Encodes the peptide sequence at SEQ ID NO 11164
atgggactgagatccccgctcctgctcgttctcctcctcgccgccgccgccttccggcccggcgcggccgccttcgcccctcccacaggcagcatcgtgaagcagctgtcgtcggtcgtcaggtggccgcggggcgggggtccctcgacgcacgggcccaagctgcccggccactctcagtatgccgatggccatgtgggggtatctctgcaatttgagagcggctactttgtagagacacttgttgagggtgacaaacttggtgtcacgccgcacaccatcagagtgtctcctgttgagggtggagagctccttgcagtcgactcagcacatagcaacattgtgcggataaccccgccactttctgagtatagcaggggaagactggtcgctggttctttccagggtcattctggtcatatagatggtaaaccaagtgatgcccgattcaagcgccccacaggcgttgccgtggatgatatgggcaatgtttatgttgctgatacagcaaacttggcgattcgaaagattggagaatcaggagtgaccaccattgcgggtgggaaatcgaatatcccaggctacagggatggccccagtgaagatgcaaagttctctacagactttgacgtggtgtatgtgaagaaaatgtgctctcttctggttattgatcgtggaaatgcagcccttaggaagatttctcttccacaagaagactgtacttaccaggattctgcgcttctatcttcagatctcatattggtcattggtgctgttgtggctggatatatcttttctggtttccaacatgggtttggattctcaggctccgagaaggtagaggcacctgaaaacgagcagcatgagagcagcacaattgggaagccacctctggttgtggagagcctgaaagaggaaccaggagctggatggccatcccttgggacgcttatcgccgatctcctgaaacttgctattgagggagtggggaaactactactcagtgtcgtccctcagcgcatgcaacatggaaagaagaaaacagatctcactccgctgagggacaggctggtgatgcccgaggacagagaggagaccccagcagcacagaagctcagcagcacgccaatgaggcccgagacagtccatgcccctaatgctgtccctgagacagcagtaaaggcccagaagagcatcaagtcatcctccaagttcagggattcaaccctgtcaagcaagcacaggtcctctaagaggcaggaatacgcagacttctacggcacctccgagcccgcaccagtaggtgccaaggtcccaaaggacaggctccgccaccgtcaccaccgtgagaagagcggggaggtcgcctacggggccgcccatcccgatctgaagcccgcggaagcgaagcctgctgattacagtgatcccaagtacgatccctacatgaggagcaaatatgctgccgagagtggctacaggtattga

SEQ ID NO: 11164 - protein, 495 aa, Sorghum bicolor
  misc_feature: Ceres ANNOT ID no. 6121024
  misc_feature (150)..(177): Pfam Id: NHL Pfam Desc: NHL repeat
  misc_feature (24)..(495): NCBI GI: 42572439 NCBI Desc: nhl repeat-containing protein [arabidopsis thaliana]
  misc_feature (7)..(378): NCBI GI: 53793193 NCBI Desc: nhl repeat-containing protein-like [oryza sativa (japonica cultivar-group)]
  misc_feature (70)..(471): NCBI GI: 30698020 NCBI Desc: nhl repeat-containing protein [arabidopsis thaliana]
  misc_feature (70)..(243): NCBI GI: 3176691 NCBI Desc: contains homology to serine/threonine protein kinase gbx99618 from mycobacterium tuberculosis. ests gbf14403, gbf14404, and gbn96730 come from this gene. [arabidopsis
  misc_feature (70)..(243): NCBI GI: 3176691 (continued) thaliana]
  misc_feature (70)..(422): NCBI GI: 20856013 NCBI Desc: at1g23880/t23e23_8 [arabidopsis thaliana]
MGLRSPLLLVLLLAAAAFRPGAAAFAPPTGSIVKQLSSVVRWPRGGGPSTHGPKLPGHSQYADGHVGVSLQFESGYFVETLVEGDKLGVTPHTIRVSPVEGGELLAVDSAHSNIVRITPPLSEYSRGRLVAGSFQGHSGHIDGKPSDARFKRPTGVAVDDMGNVYVADTANLAIRKIGESGVTTIAGGKSNIPGYRDGPSEDAKFSTDFDVVYVKKMCSLLVIDRGNAALRKISLPQEDCTYQDSALLSSDLILVIGAVVAGYIFSGFQHGFGFSGSEKVEAPENEQHESSTIGKPPLVVESLKEEPGAGWPSLGTLIADLLKLAIEGVGKLLLSVVPQRMQHGKKKTDLTPLRDRLVMPEDREETPAAQKLSSTPMRPETVHAPNAVPETAVKAQKSIKSSSKFRDSTLSSKHRSSKRQEYADFYGTSEPAPVGAKVPKDRLRHRHHREKSGEVAYGAAHPDLKPAEAKPADYSDPKYDPYMRSKYAAESGYRY

SEQ ID NO: 11165 - DNA, 1569 bp, Sorghum bicolor
  misc_feature: Ceres ANNOT ID no. 6121039
  misc_feature: Encodes the peptide sequence at SEQ ID NO 11166
  misc_feature: Down-regulated in shoot tissues in response to salicylic acid treatment
atggacccgccgcggcccgcgagcggccgctccggcggggtcggcgctggtgactcgccggtgaggtgggacgacgacgattacgacggcggcggcggccgcgtcgaaggcttggcgggactccacatatttgaccaagaggcagacgagccaccagtcaataacgacatggctagcagccttgatactaactgcattcctattgctaacggattcaacactgaaacaaccgaaacttctctagagacagaacctggaaagggcattaacccgcttcatgagcatactggcatctgggtccctgtttctgtcccgccaatgacagcgcaggcccgcgaggagtggcacagggggtttggttgcaatggcggatacttccccgaagaagagttcggctgggagctggatgaagagaactatgagatgacgatgtgggatgtgtttgctgatatggttgtcgcagcaaaacgtaaggtgatatctgccgcaacatatgactttgggagacatgggatgtcagtggtgtccaacttctttctccaagaggcttggaaggacatggcacaaacacttgcagatgcaaacgctggtattgcgaacgagcttcttgagaccgagccaactaagtggttgcctgacagtgctgctacctcttgcatgctctgtggcgtgcggtttcatccaataatgtgctctcgccatcattgtcgtttctgtggtggagtattctgtaatggttgttcaaagggtagaagcttgatgcctccaaaatttatgactgcagaacctcagagggtttgtgatgtctgcggagtacgtctagagagtatccaacctcaattgatgaatcagatcagtcgggcctcacaacttccaactcgggatgtcacagacctgagtaccctgaggtcatggctgaatttcccttgggcacacacaatggaatatgagatatacaaggctgcaaattctttacgtagttactgtaaggtgggaggactgaaaccagagaaggctatccctgatactattcttagacaagcaaaaggtcttgctatagttactgtggtgaaggttgggatgatggttacatacaaacttggcactgggctggttgttgctcgaagagtggatggctcctggtcaccgccttcagcaatctccacctgtggtattggatatggggctcaggctggaggtgagatagctgactttattattgttctgaggaacacggatgctatcagaacattcagtgggaaggcacatctgtctgttggtgctggtgttagcgcttctgctggccatgttggacgtgcagctgaggctgacttccgtgctggtgatggtggttatgctgcatgttatacatacagttgtagcaaaggtgcctttgtgggctgtgcgttgaatggcagcatagtatcaactcgagatactgagaacgcacgattttacggaggtcctgtcaaggcatctgatatccttctaggatcaatggcgaggccgcctgcagcctctcctctgtacaaagctctgtcagaattgtttgacaagattggaagataa

SEQ ID NO: 11166 - protein, 522 aa, Sorghum bicolor
  misc_feature: Ceres ANNOT ID no. 6121039
  misc_feature (208)..(276): Pfam Id: FYVE Pfam Desc: FYVE zinc finger
  misc_feature (3)..(518): NCBI GI: 50251785 NCBI Desc: las17 binding protein; lsb3p-like [oryza sativa (japonica cultivar-group)]
  misc_feature (1)..(520): NCBI GI: 53792650 NCBI Desc: las17 binding protein-like [oryza sativa (japonica cultivar-group)]
  misc_feature (91)..(522): NCBI GI: 79318859 NCBI Desc: zinc ion binding [arabidopsis thaliana]
  misc_feature (195)..(522): NCBI GI: 34394538 NCBI Desc: las17 binding protein-like [oryza sativa (japonica cultivar-group)]
  misc_feature (201)..(520): NCBI GI: 144924363 NCBI Desc: zinc finger, fyve/phd-type [medicago truncatula]
  misc_feature: Down-regulated in shoot tissues in response to salicylic acid treatment
MDPPRPASGRSGGVGAGDSPVRWDDDDYDGGGGRVEGLAGLHIFDQEADEPPVNNDMASSLDTNCIPIANGFNTETTETSLETEPGKGINPLHEHTGIWVPVSVPPMTAQAREEWHRGFGCNGGYFPEEEFGWELDEENYEMTMWDVFADMVVAAKRKVISAATYDFGRHGMSVVSNFFLQEAWKDMAQTLADANAGIANELLETEPTKWLPDSAATSCMLCGVRFHPIMCSRHHCRFCGGVFCNGCSKGRSLMPPKFMTAEPQRVCDVCGVRLESIQPQLMNQISRASQLPTRDVTDLSTLRSWLNFPWAHTMEYEIYKAANSLRSYCKVGGLKPEKAIPDTILRQAKGLAIVTVVKVGMMVTYKLGTGLVVARRVDGSWSPPSAISTCGIGYGAQAGGEIADFIIVLRNTDAIRTFSGKAHLSVGAGVSASAGHVGRAAEADFRAGDGGYAACYTYSCSKGAFVGCALNGSIVSTRDTENARFYGGPVKASDILLGSMARPPAASPLYKALSELFDKIGR

SEQ ID NO: 11167 - DNA, 2127 bp, Sorghum bicolor
  misc_feature: Ceres ANNOT ID no. 6121101
  misc_feature: Encodes the peptide sequence at SEQ ID NO 11168
atggcttcggatccggatgatggaggcgaggtgcctccggcagaggctacatcaccggcggaggcggatccatcggcagaggcagaggtgactgcgccagagaacgagccggtgaaggcgagcggtggcagcatcgtcccagcggcgggcgctgagtcgtctcacccagagggactctcccttaattatgaggaggcaagagctctccttggaagattggaatttcagaaaggaaatgtggaagttgcccttcgtgtatttgacggaattgaccttcaagctgcaattcagcagttccaaccatccctttctaagacaccatcgaagaaagggcggacaaaatcagaattaccaagttctgtcacacaaaataatcaaaataatcctgctagccttgttctcgaagccatttacttgaaatcattgtcccttcaaaagctagggaaatcgacagaagctgctaaccagtgcaaaagtgtacttgattccgttgaaagtattttccagaatggtacgcctgatatcgaacaaaagttacaagaaactatcaataaatccgtagaactgcttcctgaagcctggaaacacgctggctcctaccaggaagcattagcttcttaccgacgagctcttcttagtccatggaatcttgatgatgaaagtcggactaggattcaaaagagatatgcgtcttttctgttgtacagcaatatagattggagccctcccagcatggctcaacaagttgaaggttcttttgttccaaagaataatttcgaagaagctcttctacttttgatggtagtacttaggaattggtaccaggggaagacccattgggatccttcagtgatggaacatttaacctatgccttgtctctttgtggtgaaccactgcttcttgcaaaacaacttgaagaggttttacctggaatatatcctcgcaccgagagatgggccacactagcactttgctactatgtagctggtcagaaagatatcgcactgaattttttgagaaagtctttaaacaagcttgagaatccaaatgacatacatgctttattattagctgctaagatatgcagtaaggaccaccatctctcttctgagggtgttgaatatgcaagaagagtaatcgcacttgctggatcatcagattctcatctgaagagcgttggcctccatttcttaggaagctgtctaggtaataagtccaaggttgtttcatcagactaccaaagatctctattgcagacagaaactctgaagtcacttacagagtcgattagtcttaaccgctacaacgtagacctaatatttgacatgggagttgaatatgctgagcaaaggaacatgaatgctgccctgagatgtgccaaggagtttatagaagcaactggtgggtcgatttcgaaaggctggaggctgctagcattggttctttctgcacaacagagatttacagaagcagaagtcgcaacagatgctgccttagatgagactgcaaagttggatcaaggatctttacttagggtaaaggccaagctgaaggttgctcagtcatcgcccatggaagcagtggaagcataccgtgctcttctggctctcgttcaggcccaaaagaattcctctgcatcttgcaagaacgctatagaggacacggatggtagtgtcactgagtttgaaatctggcaaggtcttgctaatttgtactccagtctctcgtactggagagatgctgagatatgtttgaagaaggctaaggcactgaagtcgtactcggctgcaacactccatgcagaaggctacatgcatcaggcgcgagaccaaacaaaggatgcactggccgcctacgtcaacgcgttctcgactgagcttgaacatgtgccgtcgaaggtggccatcggcgcaatgctctccaagcaagggcccaggtttctgccggcagcgaggtgcttcctctcggatgccctaagagtcgagcctacaaatcggatggcttggctttacttgggaaaagtgcataggtctgatgggagaatctctgacgctgccgactgcttccaagcaacggtgatgctagaggaatcggatccagtggagagtttcagttcactctcatga

SEQ ID NO: 11168 - protein, 708 aa, Sorghum bicolor
  misc_feature: Ceres ANNOT ID no. 6121101
  misc_feature (65)..(708): NCBI GI: 10086260 NCBI Desc: calmodulin-binding protein mpcbp [zea mays]
  misc_feature (1)..(708): NCBI GI: 32492890 NCBI Desc: calmodulin-binding protein [oryza sativa (indica cultivar-group)]
  misc_feature (14)..(707): NCBI GI: 77556181 NCBI Desc: calmodulin-binding protein mpcbp [oryza sativa (japonica cultivar-group)]
  misc_feature (51)..(707): NCBI GI: 27450574 NCBI Desc: pollen-specific calmodulin-binding protein [arabidopsis thaliana]
  misc_feature (51)..(704): NCBI GI: 78708807 NCBI Desc: new cdna-based gene [oryza sativa (japonica cultivar-group)]
MASDPDDGGEVPPAEATSPAEADPSAEAEVTAPENEPVKASGGSIVPAAGAESSHPEGLSLNYEEARALLGRLEFQKGNVEVALRVFDGIDLQAAIQQFQPSLSKTPSKKGRTKSELPSSVTQNNQNNPASLVLEAIYLKSLSLQKLGKSTEAANQCKSVLDSVESIFQNGTPDIEQKLQETINKSVELLPEAWKHAGSYQEALASYRRALLSPWNLDDESRTRIQKRYASFLLYSNIDWSPPSMAQQVEGSFVPKNNFEEALLLLMVVLRNWYQGKTHWDPSVMEHLTYALSLCGEPLLLAKQLEEVLPGIYPRTERWATLALCYYVAGQKDIALNFLRKSLNKLENPNDIHALLLAAKICSKDHHLSSEGVEYARRVIALAGSSDSHLKSVGLHFLGSCLGNKSKVVSSDYQRSLLQTETLKSLTESISLNRYNVDLIFDMGVEYAEQRNMNAALRCAKEFIEATGGSISKGWRLLALVLSAQQRFTEAEVATDAALDETAKLDQGSLLRVKAKLKVAQSSPMEAVEAYRALLALVQAQKNSSASCKNAIEDTDGSVTEFEIWQGLANLYSSLSYWRDAEICLKKAKALKSYSAATLHAEGYMHQARDQTKDALAAYVNAFSTELEHVPSKVAIGAMLSKQGPRFLPAARCFLSDALRVEPTNRMAWLYLGKVHRSDGRISDAADCFQATVMLEESDPVESFSSLS

SEQ ID NO: 11169 - DNA, 969 bp, Sorghum bicolor
  misc_feature: Ceres ANNOT ID no. 6121125
  misc_feature: Encodes the peptide sequence at SEQ ID NO 11170
atggagacggagggggagcgggaggggccggtgctgtacctcgacctgacgagctaccagctgcacgatctgagcgaggtggagatcccgcccacgctggaggaggtcgacctcaccgccaaccgcctctcttccgtcgacccacgcatcggccaactcccccgtctccgcaagctctccttccgccagaacctcctggaagacgacgccgtcgcgccgctctcgtcctgggagactatcgccggattgcaggagttggtccttagagataacaaacttacaaggattcctgatgctggcatattcaagggtcttctggtgtttgatgtatctttcaatgagatatcttccttgactggtatgtccaaggtttccagcaaattgaaggaactttatgtttcaaagaatgaagttgcaaagatggaagagcttgagcatttacatgcgctggaaattcttgaacttggtagcaacaggttacgggtaatggaaaatcttgaaacattgacaaatctgcaagaactgtggttgggaagaaatcgaattcgagctgtcaacttgtgtggtttgaagctaattaagaagataagtttgcaaagcaacagattgacttcaatggatgggtttcaggaatgtactgcgttagaggagctgtacctcagccataatggaattcaaaagatggaaggcctctctaccttgcagaacctccgcattttggatgtttcatctaacaagctaaccactatagaaaatattgaaaccttaaccaggctggaggacctgtggttgaatgacaaccaaataccatctctagatgggatagagactgctttggctggttcgcgggagaagttgacgacaatatatcttgaacgaaatccctgtgcaaaaactccagagtactcatcgacattgaagaaaatatttccaaaactcgagcaaatcgattcagatatcatagcatga

SEQ ID NO: 11170 - protein, 322 aa, Sorghum bicolor
  misc_feature: Ceres ANNOT ID no. 6121125
  misc_feature (3)..(322): NCBI GI: 92872668 NCBI Desc: imp dehydrogenase/gmp reductase [medicago truncatula]
  misc_feature (23)..(321): NCBI GI: 4633066 NCBI Desc: protein phosphatase-1 regulatory subunit 7 alpha2 [homo sapiens]
  misc_feature (23)..(321): NCBI GI: 54697128 NCBI Desc: protein phosphatase 1, regulatory subunit 7 [homo sapiens]
  misc_feature (23)..(321): NCBI GI: 61355994 NCBI Desc: protein phosphatase 1 regulatory subunit 7 [synthetic construct]
  misc_feature (2)..(322): NCBI GI: 90654515 NCBI Desc: leucine-rich repeat protein 1 [toxoplasma gondii]
METEGEREGPVLYLDLTSYQLHDLSEVEIPPTLEEVDLTANRLSSVDPRIGQLPRLRKLSFRQNLLEDDAVAPLSSWETIAGLQELVLRDNKLTRIPDAGIFKGLLVFDVSFNEISSLTGMSKVSSKLKELYVSKNEVAKMEELEHLHALEILELGSNRLRVMENLETLTNLQELWLGRNRIRAVNLCGLKLIKKISLQSNRLTSMDGFQECTALEELYLSHNGIQKMEGLSTLQNLRILDVSSNKLTTIENIETLTRLEDLWLNDNQIPSLDGIETALAGSREKLTTIYLERNPCAKTPEYSSTLKKIFPKLEQIDSDIIA

SEQ ID NO: 11171 - DNA, 879 bp, Sorghum bicolor
  misc_feature: Ceres ANNOT ID no. 6121145
  misc_feature: Encodes the peptide sequence at SEQ ID NO 11172
atgggggacgccgcagagaccaccagcaagactcttcacaactggatggccgagccgaggccgaggccgagcggccagggcgacgacgaggagacgcttcagctcagcctcggcctccccggcggcggcggaggaaatggagctggcgctgggctgccacccgccgccgcctggagaatgctgccggccagagacaaggagatgcactccgctgctgctgctgtcgacacctcctccatgctctcgctcggctactccgccccagctttctcgcccgcccgctcaccaggcaaggcaaaggggtccccagcagcggctacagagaatgcccggcttgcatccaccaacaacgcctcccaggcaaggcaaagatctccaaataccccagttattgggtggcctccggttcgtgcattccgaagaaatctggctacctctagcaaagcatcccttgaacatcacaatgggaagaaggcagccagacctgaagagaccacaaaaagagctccatttgtaaagattaacatggatggcatccctattggtagaaaaattgatctgaatgcccttggcagttacgacgagctgtctctgtctgttgacaagctattccggggacttcttgcagcacaacaagaccctctggatgccagcacgaaggagtgttcacaggaagaggtggcaatatcgggtttactagatggaactggggaatacactctggtttatgaggattatgaaggtgatagggtgctggttggtgatgtcccctgggggatgtttgtttcttcggtgaagaggctgcgagttctgaagacatctgacctctcctcatctctaacagcatcaggccggaagaggacggtaactgagtgttga

SEQ ID NO: 11172 - protein, 292 aa, Sorghum bicolor
  misc_feature: Ceres ANNOT ID no. 6121145
  misc_feature (30)..(284): Pfam Id: AUX_IAA Pfam Desc: AUX/IAA family
  misc_feature (1)..(292): NCBI GI: 75258740 NCBI Desc: auxin-responsive protein iaa7 (indoleacetic acid-induced protein 7)
  misc_feature (81)..(291): NCBI GI: 88911332 NCBI Desc: auxin-responsive protein iaa16 (indoleacetic acid-induced protein 16)
  misc_feature (57)..(291): NCBI GI: 75263885 NCBI Desc: auxin-responsive protein iaa2 (indoleacetic acid-induced protein 2)
  misc_feature (111)..(281): NCBI GI: 4093155 NCBI Desc: phytochrome-associated protein 1 [arabidopsis thaliana]
  misc_feature (111)..(281): NCBI GI: 21593333 NCBI Desc: phytochrome-associated protein 1 (pap1) [arabidopsis thaliana]
  misc_feature: The sequence is a functional homolog of SEQ ID NO 1149 in the 10/412,699US patent application
  misc_feature: The sequence is a functional homolog of SEQ ID NO 1757 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13232
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 1757 in the 20070022495 US patent application
  misc_feature: The sequence is a functional homolog of SEQ ID NO 1757 in the 11/479,226 US patent application
  misc_feature: Useful for making plants with altered alkaloid content
  misc_feature: Functional homolog of the protein sequence given in SEQ ID NO 13232
MGDAAETTSKTLHNWMAEPRPRPSGQGDDEETLQLSLGLPGGGGGNGAGAGLPPAAAWRMLPARDKEMHSAAAAVDTSSMLSLGYSAPAFSPARSPGKAKGSPAAATENARLASTNNASQARQRSPNTPVIGWPPVRAFRRNLATSSKASLEHHNGKKAARPEETTKRAPFVKINMDGIPIGRKIDLNALGSYDELSLSVDKLFRGLLAAQQDPLDASTKECSQEEVAISGLLDGTGEYTLVYEDYEGDRVLVGDVPWGMFVSSVKRLRVLKTSDLSSSLTASGRKRTVTEC

SEQ ID NO: 11173 - DNA, 1695 bp, Sorghum bicolor
  misc_feature: Ceres ANNOT ID no. 6121175
  misc_feature: Encodes the peptide sequence at SEQ ID NO 11174
atggcgagtgatccgtcgtcgttctcgccaatcggggtggtggaagccatgggcggcggctacttcatggccggcggcagcaacagctatggaggaaccggcggcggcattatgagtgccgaggtaccgcacttccaccccggcatgcttcttgaccacggcggcggcttcgggttcggcggcctcggcgacgcggcggtatgcggcgccggcgccgcgacggcgacggacctggtgggcgcgcactacgcggccaacaacatcgtcctggcctccttcgccagccagctcttcgccagcaccaccgcgcagccgcaggatgatcgtaccggcgggaggacgccgccggaggagatggacgacgaggtgtacggcgttcccggcagcgacagccgcgtcgtcgcggcgagcttgcggtgccccagccaatccgggcccatggcggtctggtcgtcgtccaagaagccgtacggtgtctggaccggcgccggcggaccagtagccgtgccggccaatgacccgtaccacctcgccggggccgagttccaccccgacgcgggaggcagcttccactactacccgctcgccgtcgccgcctgcagtggcgccaacgcgtccgcggcggcggcgagcgagctgtcgctgacgctgtgctccaactccatctcgtcctcggacagcgccgcgctgaacgccgcggagcagtgctcctctggagcgagccgctccgcgctgaccgagctgccgcgggcgcgctccgggtcccggatggcgccgcacttcgccgtggtggtggcgcggtcccggtacgcggccgtggtccaggaggtgctgaacgacgtcgtcggccacatgctggacggcgtcgccgacgtggccgacgactcgtgcagcggcgtcgacggcggcggctcggttggcgcgccgtccgcggtgagctccaaccggttcatggtggcctcgtcggccgacgccggcgcgcgctggggcgaggcgcagagggtccggagcaagctcctcaagacgcttcagctgatggaccagaagtacaaccaatgcttggacgagatccagagcacgacggccaagttcaacacgctgatgcactcgccgtcgggcgccggcaacggcggcagcatctgcgcgccgttcgcgcaccgcgccgtgtcggcgatgtaccgcggcctgaggcggcggctcgccggcgagatcatggcggcggcgagcagggccagctgctggggcgagtcgtcgtcgtcggtgaccgcgaccgcggccggcggcgacgtggagcggagctgggagtcggccttcatacagaagcactggtcggcgcagcagctgcggcgcgccgagaagcagtgctggcggccccagcgcggcctgccggagaagtccgtcgccgtgctcaaggcctggatgttcgagaacttcctgcacccgtatcccaaggaccatgagaaggacgtgctggctgcaagaagcggcctcagcaggaaccaggtgtcgaattggttcataaacgcacgagttcgtctgtggaagccgatgatcgaggagatgtaccaggacctgaaggggagctcgggtgcaggaggaggaggagggcagaggccgccggcgatggagctgctgcagcaccagcacatgagcaagcgtcgaataatctgcgagctagaagatggtggtcagtga

SEQ ID NO: 11174 - protein, 564 aa, Sorghum bicolor
  misc_feature: Ceres ANNOT ID no. 6121175
  misc_feature (263)..(402): Pfam Id: POX Pfam Desc: Associated with HOX
  misc_feature (240)..(537): NCBI GI: 115468552 NCBI Desc: os06g0562300 [oryza sativa (japonica cultivar-group)]
  misc_feature (262)..(536): NCBI GI: 13752407 NCBI Desc: homeodomain protein jubel1 [hordeum vulgare]
  misc_feature (254)..(525): NCBI GI: 31323449 NCBI Desc: bell-like homeodomain protein 4 [lycopersicon esculentum]
  misc_feature (183)..(523): NCBI GI: 15215857 NCBI Desc: at4g36870/c7a10_490 [arabidopsis thaliana]
  misc_feature (183)..(523): NCBI GI: 79326370 NCBI Desc: blh2 (bel1-like homeodomain 2); dna binding [arabidopsis thaliana]
  misc_feature: The plant produces a reduced number of seeds.
  misc_feature: Useful for biocontainment applications
  misc_feature: Useful for making plants with modulated light quality response
  misc_feature: Useful for making plants with modulated low light sensitivity
  misc_feature: GREAT-hit functional homolog of the protein sequence given in SEQ ID NO 13336
  misc_feature: The sequence is a functional homolog of SEQ ID NO. 320 in the 11/188,298 US application
  misc_feature: The sequence is a functional homolog of SEQ ID NO. 499 in the 11/188,298 US application
MASDPSSFSPIGVVEAMGGGYFMAGGSNSYGGTGGGIMSAEVPHFHPGMLLDHGGGFGFGGLGDAAVCGAGAATATDLVGAHYAANNIVLASFASQLFASTTAQPQDDRTGGRTPPEEMDDEVYGVPGSDSRVVAASLRCPSQSGPMAVWSSSKKPYGVWTGAGGPVAVPANDPYHLAGAEFHPDAGGSFHYYPLAVAACSGANASAAAASELSLTLCSNSISSSDSAALNAAEQCSSGASRSALTELPRARSGSRMAPHFAVVVARSRYAAVVQEVLNDVVGHMLDGVADVADDSCSGVDGGGSVGAPSAVSSNRFMVASSADAGARWGEAQRVRSKLLKTLQLMDQKYNQCLDEIQSTTAKFNTLMHSPSGAGNGGSICAPFAHRAVSAMYRGLRRRLAGEIMAAASRASCWGESSSSVTATAAGGDVERSWESAFIQKHWSAQQLRRAEKQCWRPQRGLPEKSVAVLKAWMFENFLHPYPKDHEKDVLAARSGLSRNQVSNWFINARVRLWKPMIEEMYQDLKGSSGAGGGGGQRPPAMELLQHQHMSKRRIICELEDGGQ

SEQ ID NO: 11175 - DNA, 942 bp, Sorghum bicolor
  misc_feature: Ceres ANNOT ID no. 6121179
  misc_feature: Encodes the peptide sequence at SEQ ID NO 11176
atggcggcgaccaacggcaacggcaccggcaacggcgccccccttgtggtgttcgatttcgacaagaccatcgtcgactgcgacagcgacaactgggtcgtcgacgccctcggcgccacccgccggttcgacgacctcctccgccacctcccctggaaccacgccatcgatgcgatgatgggcgagctgcactcggacggcaagacggcggaggacatcaggggcagcctcagaacggcgccgctgtcgccgcacgtcgccgccgccatcaaagccgcctacgccctcgggtgcgagctccgcgtcctcagcgacgccaacgccttcttcatcgacaccatcctcgcgcaccacggcctcgccgcctacttctccggcaccgacaccaaccctgcccacgtcgacgccgccggccgcctcaggatccgcccctaccacgacttcggcgccgccggccacggatgcaccctcccgacctgcccgcccaacatgtgcaagggcaaggtgatggagaggatcctccgccaagaagaagaagaagaagaagaagaagccgtctcggcggcggccggcaccgagaagaggcggcggaggaggagggccgtggtgtacctgggcgacggccggggcgactactgcccgtccctgaagctacgggagggtgactacgtgatgccgcgggcggggcaccccgtgtgcgacctcatcgcggcctcgccgcctgccgccgccgtccgcgggtgggccggcttcgaggacctcgccagggtgctcctcggcatcgtcgacggcgagatcgcccgcgccgccgccgccgctgaagaagaagacgctggcgctggcgcgggtgtgggcgtgggcgccgtcgtcgtcgtgccggcggactgccgcgcgccgcgtcaggaggcgctcatgccccaggccgtccgcgtgcccaactga

SEQ ID NO: 11176 - protein, 313 aa, Sorghum bicolor
  misc_feature: Ceres ANNOT ID no. 6121179
  misc_feature (14)..(262): Pfam Id: Put_Phosphatase Pfam Desc: Putative Phosphatase
  misc_feature (15)..(173): NCBI GI: 18461219 NCBI Desc: p0690b02.4 [oryza sativa (japonica cultivar-group)]
  misc_feature (15)..(173): NCBI GI: 115361863 NCBI Desc: acid phosphatase [oryza sativa (japonica cultivar-group)]
  misc_feature (15)..(177): NCBI GI: 82181472 NCBI Desc: probable phosphatase phospho2
  misc_feature (15)..(178): NCBI GI: 125983464 NCBI Desc: ga11499-pa [drosophila pseudoobscura]
  misc_feature (15)..(177): NCBI GI: 81884198 NCBI Desc: pyridoxal phosphate phosphatase phospho2
MAATNGNGTGNGAPLVVFDFDKTIVDCDSDNWVVDALGATRRFDDLLRHLPWNHAIDAMMGELHSDGKTAEDIRGSLRTAPLSPHVAAAIKAAYALGCELRVLSDANAFFIDTILAHHGLAAYFSGTDTNPAHVDAAGRLRIRPYHDFGAAGHGCTLPTCPPNMCKGKVMERILRQEEEEEEEEAVSAAAGTEKRRRRRRAVVYLGDGRGDYCPSLKLREGDYVMPRAGHPVCDLIAASPPAAAVRGWAGFEDLARVLLGIVDGEIARAAAAAEEEDAGAGAGVGVGAVVVVPADCRAPRQEALMPQAVRVPN

SEQ ID NO: 11177 - DNA, 1533 bp, Sorghum bicolor
  misc_feature: Ceres ANNOT ID no. 6121195
  misc_feature: Encodes the peptide sequence at SEQ ID NO 11178
  misc_feature: Up-regulated in shoot tissues in response to salicylic acid treatment
atggcggcctcccccacttcctccctcgccccgccggtggtgcctatggagctccacgccggcaaccgcgaccgcctcgttgccgcgctccgcggccacctctccgcctccgcccgcccgctccacggcctcgtcctcctccagggcggggaggagaagacgcggtactgcaccgatcacctcgagctcttcaggcaggagagctacttcgcttatctctttggagtgcgtgaaccagggttctacggtgcaattgacatcgcctctggacagtcaattttgtttgctccaagattgccagctgactatgctgtttggatgggtgaaatacaacctttgtcgtacttcagggatacatacaaggtcgatatggtattctatgttgatgagattgcacaggttgtgcaagatcgtttcggggaccatggaaagcctcttctgtttctgctacatgggaggaatactgactctggaaatttctcaaagcctgctagttttgaggggattgagaagtttgatactgatttaagtacacttcatccaattttgaccgaatgccgtgtgattaaatctgatctggagcttgctctcatccagtatgctaatgatgtcagttctgaagctcacattgaggttatgagacgagcaaggccaggcatgaaggaatatcagttagaaagtatcttccttcaccatgtttatatgtatggaggttgccgacattgctcttatacatgtatatgtgctactggagataatagtgctgttctacattatggacacgcggcagcgccaaatgaccggactttgaatgatggagacatggcactaatggatatgggagctgagtaccatttctatggatctgatatcacatgctcataccctataaatgggaaattcaacagcagtcagataataatatacaatgctgtgcttaaggctcataatgctgttatatcacacatgcggcctggagttaattggatggatatgcacaaattagcagaacgggcaatacttgaatctcttaggaaggaacaaattgtccaaggggatgttgatgatatgatggttcaaaggttaggggctgttttcatgcctcatggtcttggccacttacttgggattgacacccatgatccaggaggctaccctgagggattggagaggcccaaggatccaggattgagctccttgcggaccacaagagaactgaaagaaggaatggttatcacagtggagccaggctgctatttcattgatgctttgctgaataaaacaagggatgatccaatttcctcaaagttcttcaactggcaagaggttgaaaagtatagaaactttggtggcgttcgcattgaaagtgatgtgtatgtgacagctcaaggatgccggaacctcacaaactgccctcgagagacctgggagatcgaggctgtaatggctggcgcagcatggcctctgccggcttcaagttccatggcggcggcagcagcagagaatagaaatggcatatccaaagcattgtaa

SEQ ID NO: 11178 - protein, 510 aa, Sorghum bicolor
  misc_feature: Ceres ANNOT ID no. 6121195
  misc_feature (196)..(470): Pfam Id: Peptidase_M24 Pfam Desc: metallopeptidase family M24
  misc_feature (14)..(158): Pfam Id: AMP_N Pfam Desc: Aminopeptidase P, N-terminal domain
  misc_feature (7)..(488): NCBI GI: 22531162 NCBI Desc: x-pro dipeptidase-like protein [arabidopsis thaliana]
  misc_feature (14)..(484): NCBI GI: 20271451 NCBI Desc: xaa-pro dipeptidase [homo sapiens]
  misc_feature (14)..(484): NCBI GI: 62901944 NCBI Desc: xaa-pro dipeptidase [synthetic construct]
  misc_feature (14)..(484): NCBI GI: 112491420 NCBI Desc: chain b, crystal structure of human prolidase
  misc_feature (14)..(484): NCBI GI: 60652763 NCBI Desc: peptidase d [synthetic construct]
  misc_feature: Up-regulated in shoot tissues in response to salicylic acid treatment
MAASPTSSLAPPVVPMELHAGNRDRLVAALRGHLSASARPLHGLVLLQGGEEKTRYCTDHLELFRQESYFAYLFGVREPGFYGAIDIASGQSILFAPRLPADYAVWMGEIQPLSYFRDTYKVDMVFYVDEIAQVVQDRFGDHGKPLLFLLHGRNTDSGNFSKPASFEGIEKFDTDLSTLHPILTECRVIKSDLELALIQYANDVSSEAHIEVMRRARPGMKEYQLESIFLHHVYMYGGCRHCSYTCICATGDNSAVLHYGHAAAPNDRTLNDGDMALMDMGAEYHFYGSDITCSYPINGKFNSSQIIIYNAVLKAHNAVISHMRPGVNWMDMHKLAERAILESLRKEQIVQGDVDDMMVQRLGAVFMPHGLGHLLGIDTHDPGGYPEGLERPKDPGLSSLRTTRELKEGMVITVEPGCYFIDALLNKTRDDPISSKFFNWQEVEKYRNFGGVRIESDVYVTAQGCRNLTNCPRETWEIEAVMAGAAWPLPASSSMAAAAAENRNGISKAL

SEQ ID NO: 11179 - DNA, 1572 bp, Sorghum bicolor
  misc_feature: Ceres ANNOT ID no. 6121197
  misc_feature: Encodes the peptide sequence at SEQ ID NO 11180
atggagcgggagcccatgtcccccgacgaccgccccgagtcgtctgcggctgcggcggcgcagcagcagccgcagccgcagccgctggagtggcggttcgcgcaggtcttcggcgagcgcgccgcgggagaggatgtgcaggaagtggacataatctctgcaattgagtttgacaaatccggcaatcatcttgccactggagatagaggtggacgtgtggttttgttcgaaagaacagacatcagtgataatgctagtcgaagagaacttgagaggcaagaatatcaggctgctaggcatcctgagttccgttacaagaccgaatttcagagtcatgaacctgagtttgactacctaaaaagtttggaaatcgaagagaagattaacaagatcaagtggtgccaaacagccaacaatgcactctttctcttgtctacaaatgacaaaacaatcaagtattggaaggttcaagagaaaaaagtgaaacgtgtttcagtgatgaatttggatacctcccaaagttcagacaatggttcaacttcaagtccaggtaccagtagttgcagggctcttctcccaaatggtggatgctcagaaaagatgtacactccgaacaacaatttgtcgttttttccaggaggatgtgcttcgctgcgtttgcctgtggtggttacgggccaagaatttaatcatgtcgcgagatgccgacgtgtatatgcccatgctcatgactaccatattaattccatttcaaataatagtgacggagaaacattcatatcagcagatgatctgagaataaacctttggaatttagaaattagcaaccagagctttaacattgttgacatgaaacctgcaaacatggaggatctaactgaggtgattacttgtgcggagttccatccaactcactgtaatacactagcatatagtagctcaaagggtactatcaggcttattgatctgcggcagtcagcactgtgtgacaaccatgctaaactatttgaagaacatgaagcaccaggatcaagatccttttttacagagataatagcatcagtttcggatataaagtttgcaagggatggaagacacattcttagtcgtgattatatgacactcaagttgtgggatctaaacatggattcaggcccagttgcaacttttcaagttcatgaatacttacgtcctaagctttgtgatttatacgataatgattcaattttcgacaaatttgaatgttgtctcagtggtgatggactccgtgttgcaactggttcttatagtaatttgtttcgcgtttttggttgttctcctgaaagtacggaggcatcaactttggaagccagcagaaatcccatgaggagacaggttgttaatccagcaaggcctgcacggactctgacttctttgacccgtgctgtgaggagaggtggagaaaatacaagcattgaggccaatggaaactcttatgatctctcaacaaaactgctccatcttgcgtggcacccaaccgagaactccatcgcgtgtgctgccgcaaatagcttgtacatgtattatgcatag

SEQ ID NO: 11180 - protein, 523 aa, Sorghum bicolor
  misc_feature: Ceres ANNOT ID no. 6121197
  misc_feature (7)..(523): NCBI GI: 3421415 NCBI Desc: protein phosphatase 2a 55 kda b regulatory subunit [oryza sativa]
  misc_feature (7)..(523): NCBI GI: 3421413 NCBI Desc: protein phosphatase 2a 55 kda b regulatory subunit [oryza sativa]
  misc_feature (1)..(523): NCBI GI: 75325493 NCBI Desc: serine/threonine protein phosphatase 2a 55 kda regulatory subunit b beta isoform (pp2a, subunit b, beta isoform)
  misc_feature (6)..(523): NCBI GI: 110832726 NCBI Desc: serine/threonine protein phosphatase 2a 55 kda regulatory subunit b alpha isoform (pp2a, subunit b, alpha isoform)
  misc_feature (6)..(523): NCBI GI: 115468560 NCBI Desc: os06g0563300 [oryza sativa (japonica cultivar-group)]
MEREPMSPDDRPESSAAAAAQQQPQPQPLEWRFAQVFGERAAGEDVQEVDIISAIEFDKSGNHLATGDRGGRVVLFERTDISDNASRRELERQEYQAARHPEFRYKTEFQSHEPEFDYLKSLEIEEKINKIKWCQTANNALFLLSTNDKTIKYWKVQEKKVKRVSVMNLDTSQSSDNGSTSSPGTSSCRALLPNGGCSEKMYTPNNNLSFFPGGCASLRLPVVVTGQEFNHVARCRRVYAHAHDYHINSISNNSDGETFISADDLRINLWNLEISNQSFNIVDMKPANMEDLTEVITCAEFHPTHCNTLAYSSSKGTIRLIDLRQSALCDNHAKLFEEHEAPGSRSFFTEIIASVSDIKFARDGRHILSRDYMTLKLWDLNMDSGPVATFQVHEYLRPKLCDLYDNDSIFDKFECCLSGDGLRVATGSYSNLFRVFGCSPESTEASTLEASRNPMRRQVVNPARPARTLTSLTRAVRRGGENTSIEANGNSYDLSTKLLHLAWHPTENSIACAAANSLYMYYA

SEQ ID NO: 11181 - DNA, 1005 bp, Sorghum bicolor
  misc_feature: Ceres ANNOT ID no. 6121640
  misc_feature: Encodes the peptide sequence at SEQ ID NO 11182
atgagctctgcggcggcgatgacgggggcggggaaggtggtgtgcgtcaccggcgcatcagggtacatcgcgtcctggatcgtcaggctgctcctcgaccgcggctacaccgtccgcgccaccgtgcgggacaccgctgacccaaagaaaacattgcacctgactgctctggatggagccaaggataggctgcacttatttaaagctagcctgctagaagagggctcttttgacgctgcagttcatggatgtgacaccgtattccatactgcctctcccttttatcacaatgtcaaggatcctaaggctgagttacttgacccagcagttaagggaacactcaatgttcttggttcatgcaagaaagcttctattacaaaagtggttataacatcctctatggctgctgtttcctacaacgagaagccaaggactcctgaggtcacagttgacgagacatggtttactgatccacaaatttgtgaaaagactcagcaatggtatgttttgtccaagacactcgcagagcaggctgcttggaagttttcaagggataatggatttgaaattgttactataaacccagcaatggttattggtcccctgctccagcctacactaaataccagtgctgaagcaatcctgaagttaatcaatggatcatctacatatcccaattcaagctttggatgggttaatgtcaaagatgttgccctggcccatatccttgcatatgagattccctcggcaaatggaaggtattgcatggtggaaagagttgttcactactcagaactagtcaaaatcatccgcaagatgtatcctaccattcgtcttccagacaagtgtgcagatgacaagccatttgtcccaacctaccaagtatcaaaggagaagataagaagcataggcattgagttaattccagtggagacgagcgtcaaggagactatcgaaagcttgaaagagaagggatttgttagttttgactcgagcaacctgtga

SEQ ID NO: 11182 - protein, 334 aa, Sorghum bicolor
  misc_feature: Ceres ANNOT ID no. 6121640
  misc_feature (14)..(257): Pfam Id: Epimerase Pfam Desc: NAD dependent epimerase/dehydratase family
  misc_feature (16)..(270): Pfam Id: NAD_binding_4 Pfam Desc: Male sterility protein
  misc_feature (15)..(281): Pfam Id: 3Beta_HSD Pfam Desc: 3-beta hydroxysteroid dehydrogenase/isomerase family
  misc_feature (8)..(329): NCBI GI: 82655175 NCBI Desc: cinnamyl alcohol dehydrogenase [quercus ilex]
  misc_feature (5)..(329): NCBI GI: 1143445 NCBI Desc: cinnamyl alcohol dehydrogenase [eucalyptus gunnii]
  misc_feature (6)..(329): NCBI GI: 21594240 NCBI Desc: cinnamyl-alcohol dehydrogenase-like protein [arabidopsis thaliana]
  misc_feature (9)..(329): NCBI GI: 37029996 NCBI Desc: nadph-dependent cinnamyl alcohol dehydrogenase [quercus suber]
  misc_feature (8)..(329): NCBI GI: 82568689 NCBI Desc: cinnamyl alcohol dehydrogenase [prunus mume]
MSSAAAMTGAGKVVCVTGASGYIASWIVRLLLDRGYTVRATVRDTADPKKTLHLTALDGAKDRLHLFKASLLEEGSFDAAVHGCDTVFHTASPFYHNVKDPKAELLDPAVKGTLNVLGSCKKASITKVVITSSMAAVSYNEKPRTPEVTVDETWFTDPQICEKTQQWYVLSKTLAEQAAWKFSRDNGFEIVTINPAMVIGPLLQPTLNTSAEAILKLINGSSTYPNSSFGWVNVKDVALAHILAYEIPSANGRYCMVERVVHYSELVKIIRKMYPTIRLPDKCADDKPFVPTYQVSKEKIRSIGIELIPVETSVKETIESLKEKGFVSFDSSNL

SEQ ID NO: 11183 - DNA, 642 bp, Sorghum bicolor
  misc_feature: Ceres ANNOT ID no. 6121728
  misc_feature: Encodes the peptide sequence at SEQ ID NO 11184
atggggtgtgtctactccaaggggtccaaacgacctccgggatatgtggatcccaatatcttggctaaagagactacgttttctgtcaatgaagtggaggccctctatgagctctacaagaagataagctattccataatcaaagatggcctaattcacaaggaggagttccagcttgctctcttcaggaacagcaacaagaagaatcttttcgccgatcggatatttgatctgtttgatctgaagcgcaatggagtgattgattttgaggagttcgttcagtccctcagcattttccacccagatacgccgatggcagaaaagatcgcctttgcatttcggctatatgatctgagaggtactggattcattgaacgcgaagagttgaaggaaatggtgctggccatcctgaatgaatcagaattacttctttctgacgacgctgtcgaacaaattgttgatcagactttcaagcaagcagacatgaacgatgacgggaagatagatcctgatgaatggaaggtgttcgcaagtaaaaatccagctcttctaaagaacatgacgctaccatatctaaaggacataaccatggcgtttcccagctttgttctcaactctggagctagtgatgaagagttgtag

SEQ ID NO: 11184 - protein, 213 aa, Sorghum bicolor
  misc_feature: Ceres ANNOT ID no. 6121728
  misc_feature (71)..(99): Pfam Id: efhand Pfam Desc: EF hand
  misc_feature (108)..(136): Pfam Id: efhand Pfam Desc: EF hand
  misc_feature (152)..(180): Pfam Id: efhand Pfam Desc: EF hand
  misc_feature (1)..(213): NCBI GI: 76577799 NCBI Desc: calcineurin b-like protein 7 [oryza sativa (japonica cultivar-group)]
  misc_feature (1)..(213): NCBI GI: 76577801 NCBI Desc: calcineurin b-like protein 8 [oryza sativa (japonica cultivar-group)]
  misc_feature (1)..(213): NCBI GI: 133925823 NCBI Desc: calcineurin b-like protein 4-2 [populus trichocarpa]
  misc_feature (1)..(213): NCBI GI: 133925821 NCBI Desc: calcineurin b-like protein 4-1 [populus trichocarpa]
  misc_feature (1)..(210): NCBI GI: 79835718 NCBI Desc: calcium sensing protein [brassica juncea]
  misc_feature: Useful for making plants with modulated salt sensitivity
  misc_feature: Functional homolog of the protein sequence given in SEQ ID NO 13664
  misc_feature: Useful for making plants with modulated drought sensitivity
  misc_feature: Functional homolog of the protein sequence given in SEQ ID NO 13665
  misc_feature: Useful for making plants with modulated water use efficiency
  misc_feature: Functional homolog of the protein sequence given in SEQ ID NO 13666
  misc_feature: The sequence is a functional homolog of SEQ ID NO 2 in US patent 7250555
MGCVYSKGSKRPPGYVDPNILAKETTFSVNEVEALYELYKKISYSIIKDGLIHKEEFQLALFRNSNKKNLFADRIFDLFDLKRNGVIDFEEFVQSLSIFHPDTPMAEKIAFAFRLYDLRGTGFIEREELKEMVLAILNESELLLSDDAVEQIVDQTFKQADMNDDGKIDPDEWKVFASKNPALLKNMTLPYLKDITMAFPSFVLNSGASDEEL

SEQ ID NO: 11185 - DNA, 858 bp, Sorghum bicolor
  misc_feature: Ceres ANNOT ID no. 6121758
  misc_feature: Encodes the peptide sequence at SEQ ID NO 11186
atggggcggccttacggggtgaagggacggaagaagaagcgcaagctcgaggaggcggcgacctctgacgctgctccgcccgctgaagaggtggaggagctgccaccacaagaggaggccggtggcgaggagaagggcaacgaggaggatgaggcagcggctggggaggaggagcacgctgcggtggacgggatcccaatcgtacccagaacgcttgatgggaagcggcggcctggcgctatcttcgtgctcgagagggcctgcctcgaggtcggcaaagtcggcaagactatgcaaatcttgaactcagatgatcatgcaaattatttgaggaagcagaatcgcaatcctgcagattataggcctgatataattcatcaggctctactagcaatatttgatagccctctgactaaggctggaaggttacaggctgtttatgtgaggactgaaaagggagtattgtttgaaatcaaacctcatgttcgcatgccaagaacgtttaaacgtttctgtggtttaatgtcacaattgttacaaaaactgagcattacggcagttgggaagcgtgagaaacttcttaatgttgttaaaaatcctgttacccgctatctacctgttggtgcacgaaagattggcctttcatttagtgctgagaagtcagtcaacttgtttgactatgttgccaaatccagtgatgatgaaccccttgtgtttgtggttggtgccatggcccatggaaagatcgacaaggaatacacagatgattacatacaaatttgcaactaccctctcagtgccgcctgctgtttaaatcggatatgcagtgccctggagcaaaagtggaacatccaatga

SEQ ID NO: 11186 - protein, 285 aa, Sorghum bicolor
  misc_feature: Ceres ANNOT ID no. 6121758
  misc_feature (114)..(280): Pfam Id: Nep1 Pfam Desc: Nep1 ribosome biogenesis protein
  misc_feature (1)..(284): NCBI GI: 140069739 NCBI Desc: suppressor mra1 [medicago truncatula]
  misc_feature (81)..(284): NCBI GI: 55241966 NCBI Desc: ensangp00000016225 [anopheles gambiae str. pest]
  misc_feature (81)..(284): NCBI GI: 108882524 NCBI Desc: nucleolar essential protein 1 (nep1) [aedes aegypti]
  misc_feature (54)..(284): NCBI GI: 2276396 NCBI Desc: c2f [homo sapiens]
  misc_feature (54)..(284): NCBI GI: 119609102 NCBI Desc: emg1 nucleolar protein homolog (s. cerevisiae), isoform cra_c [homo sapiens]
MGRPYGVKGRKKKRKLEEAATSDAAPPAEEVEELPPQEEAGGEEKGNEEDEAAAGEEEHAAVDGIPIVPRTLDGKRRPGAIFVLERACLEVGKVGKTMQILNSDDHANYLRKQNRNPADYRPDIIHQALLAIFDSPLTKAGRLQAVYVRTEKGVLFEIKPHVRMPRTFKRFCGLMSQLLQKLSITAVGKREKLLNVVKNPVTRYLPVGARKIGLSFSAEKSVNLFDYVAKSSDDEPLVFVVGAMAHGKIDKEYTDDYIQICNYPLSAACCLNRICSALEQKWNIQ

SEQ ID NO: 11187 - DNA, 1041 bp, Sorghum bicolor
  misc_feature: Ceres ANNOT ID no. 6121815
  misc_feature: Encodes the peptide sequence at SEQ ID NO 11188
atggctgtggaaagagatgtatttggaatttcagggccaacatatctgaaaccaatcgattggaactgtgagcataatcggagatctgtggctgcaagcttagttcaggctgtatatgtgttggagagagaccgacaactgagtcgtctatctgttgaagccttggcacctgcttggtgggaattcttccattttgagctgattcgcaagctgattgatgatgctgatatgtccatatttggtgcaatatttgaattcaatcctccttcaagtgaagaagcttctgttgcaaatgctccaagatttgtcatcgctttcagaggcaccataacagagaaggatactatctccagggatatttccctggacctgcaccttgttcaaaatggtctccataggacctcgagatttaatatcgcaatgcaagctgttcaaaacgtagcctcagttttccctggatccacgatttggctagctgggcattcactaggtgcaggcatggccatccttacgggaagaaacatggttaagaagggtgtgtttttagaaagctttctcttcaacccaccatttgttgctgctccaattgaaaggatcagggatgaaagggtaaagcacggttttcgtattgcaagaagtgtaattactgctggattaactattgccatgaaagctaaaactgagggtaacagtcagagatctgttggtgaagaatctttcagcattttgtcatcatggacaccatatctattcgttaatccaggagaccacatctgttcagagtacattgggtacttccagcaccggaagaacatggaagatcttggtgctggatttattgagaagcttgcgacccagaattcaattggagacctgttcttcaaggcattaggatgggaatcagaaccactgcaccttcttccatctgctgatttaatcgtcaacgtgagcccttcatctgatttcaaatacgctcatggcatcagccagtggtggcaacctgagctgaatttgcagagcagtaaatatcggtactcatag

SEQ ID NO: 11188 - protein, 346 aa, Sorghum bicolor
  misc_feature: Ceres ANNOT ID no. 6121815
  misc_feature (103)..(223): Pfam Id: Lipase_3 Pfam Desc: Lipase (class 3)
  misc_feature (1)..(346): NCBI GI: 47847721 NCBI Desc: lipase class 3-like [oryza sativa (japonica cultivar-group)]
  misc_feature (24)..(309): NCBI GI: 3513738 NCBI Desc: similar to the gdsl family of lipolytic enzymes [arabidopsis thaliana]
  misc_feature (32)..(345): NCBI GI: 18461216 NCBI Desc: p0690b02.1 [oryza sativa (japonica cultivar-group)]
  misc_feature (1)..(278): NCBI GI: 145328270 NCBI Desc: lipase class 3 family protein [arabidopsis thaliana]
  misc_feature (1)..(336): NCBI GI: 145358378 NCBI Desc: triacylglycerol lipase [arabidopsis thaliana]
  misc_feature: Useful for making plants with modulated nitrogen use efficiency
  misc_feature: Functional homolog of the protein sequence given in SEQ ID NO 12978
MAVERDVFGISGPTYLKPIDWNCEHNRRSVAASLVQAVYVLERDRQLSRLSVEALAPAWWEFFHFELIRKLIDDADMSIFGAIFEFNPPSSEEASVANAPRFVIAFRGTITEKDTISRDISLDLHLVQNGLHRTSRFNIAMQAVQNVASVFPGSTIWLAGHSLGAGMAILTGRNMVKKGVFLESFLFNPPFVAAPIERIRDERVKHGFRIARSVITAGLTIAMKAKTEGNSQRSVGEESFSILSSWTPYLFVNPGDHICSEYIGYFQHRKNMEDLGAGFIEKLATQNSIGDLFFKALGWESEPLHLLPSADLIVNVSPSSDFKYAHGISQWWQPELNLQSSKYRYS

SEQ ID NO: 11189 - DNA, 2016 bp, Sorghum bicolor
  misc_feature: Ceres ANNOT ID no. 6121823
  misc_feature: Encodes the peptide sequence at SEQ ID NO 11190
atgcagatgcagacaatcaccttgcgcgccggccccgccgcccgccgccccacgccgccgccggccagctccgcgcacctcgccgcctccggaaggtgcctgctgcgtgcccccagctcgctccgacgccggagaacccgctctctcagggcctctgcctctctcgagcaggtcaaggaagtcgccggctccccggttccctccgcagggaagagtagtcaagcaactagaagagatgtgaggaatatagcaattgttgctcatgttgatcatgggaagacaactttggtggattcaatgttaaggcaagccaaggttttccgagataatcaagttgtgcaggaaagaataatggactcaaatgacctagaacgggaaagaggaatcacgattctgagcaagaatacatcaataacctataagggcactaaaatcaatataattgatactcctgggcattcagattttggcggggaggttgagcgtgttctcaacatggtggaaggagttctgctagtggttgattctgtagaggggcctatgccacagacaaggtttgttctgaagaaagctctagaatttggacatgctgttgttgtagttgtaaacaagatcgacagacctactgctcgtcctgagtttgtggtgaattcaacatttgaactatttattgaactaaatgcaactgatgaacagtgtgatttccaaacagtctatgcaagtggaattaaaggaaaggctggtctatctccagaaaatttagctgatgacctaggacccctttttgaggcgattcttagatgcataccagagccacgcattgagaaagatggtgccctgcaaatgcttgtatctaatactgaatatgatgagcacaaaggaagaatagcaattggacggctgcatgcaggagaacttcagcgtggcatggaggtcaaggtttgtacaccagacgatgcttgcagggttagtaaagtaagtgagcttttcgtttatcagaacttcagccgcgtccccgttgaatctgttagtgctggtgacatttgtgctgtatgtggaatggatgatatcatgattggggaaactatagctgataaagttacaggaacaccattgcccactatcaaagtggaggagccaacagtcagaatgtctttctccatcaatacatctccttttgttggacgggaggggaaatacgttactagccgaaatctccgtgacaggttatatcgtgagctcgaaaggaatttggctatgaaagtagaagatggggaaactgctgatacatttcttgttagtggcagaggcacactgcatctcacaatattgatagagaatatgcggagagaaggatatgaatttatgattggacctccaaaggtcataaacaagacagtggatggaaaactactagagccttatgagatagctgctgttgaggtcccagaagagtccatgggatcagttgttgaacttttgggaaaaaggcgtggacaaatggttgacatggaagctgatgggccggagggaacaacattgctaaaatacaagattcctaccagaggcctcattggacttcggaatgcagttcttacagcttctcgtggcagagctatactgaacacaatctttgacagctatggcccatgggctggggatcttagctcacgtgatcagggatccttggttgcttttgaagatggaagcactacttcttacgcacttcttaatgcacaagaaagaggtgtgttgtttgtccaaccagggcaggatgtttacaaaggtcaaattgttggtatccatcagagacctggtgatttagcaattaatgtgtgcaagaaaaaggctgctacaaatgttcgttccaacaaggaaactacagtggttcttgatgaagctttaagctacagtttggatgactgcatagagtttatccaagaagatgagctagtggaggttactcctgcaagcatccgcatgtgcaagaacccaaaaatttcaaagaaaaagtaa

SEQ ID NO: 11190 - protein, 671 aa, Sorghum bicolor
  misc_feature: Ceres ANNOT ID no. 6121823
  misc_feature (78)..(271): Pfam Id: GTP_EFTU Pfam Desc: Elongation factor Tu GTP binding domain
  misc_feature (470)..(559): Pfam Id: EFG_C Pfam Desc: Elongation factor G C-terminus
  misc_feature (294)..(364): Pfam Id: GTP_EFTU_D2 Pfam Desc: Elongation factor Tu domain 2
  misc_feature (81)..(206): Pfam Id: MMR_HSR1 Pfam Desc: GTPase of unknown function
  misc_feature (1)..(670): NCBI GI: 30684514 NCBI Desc: elongation factor family protein [arabidopsis thaliana]
  misc_feature (1)..(670): NCBI GI: 30684509 NCBI Desc: elongation factor family protein [arabidopsis thaliana]
  misc_feature (66)..(670): NCBI GI: 9758030 NCBI Desc: gtp-binding protein typa (tyrosine phosphorylated protein a) [arabidopsis thaliana]
  misc_feature (58)..(670): NCBI GI: 38327302 NCBI Desc: gtp-binding protein typa [trifolium pratense]
  misc_feature (77)..(663): NCBI GI: 118062835 NCBI Desc: gtp-binding protein typa [roseiflexus castenholzii dsm 13941]
MQMQTITLRAGPAARRPTPPPASSAHLAASGRCLLRAPSSLRRRRTRSLRASASLEQVKEVAGSPVPSAGKSSQATRRDVRNIAIVAHVDHGKTTLVDSMLRQAKVFRDNQVVQERIMDSNDLERERGITILSKNTSITYKGTKINIIDTPGHSDFGGEVERVLNMVEGVLLVVDSVEGPMPQTRFVLKKALEFGHAVVVVVNKIDRPTARPEFVVNSTFELFIELNATDEQCDFQTVYASGIKGKAGLSPENLADDLGPLFEAILRCIPEPRIEKDGALQMLVSNTEYDEHKGRIAIGRLHAGELQRGMEVKVCTPDDACRVSKVSELFVYQNFSRVPVESVSAGDICAVCGMDDIMIGETIADKVTGTPLPTIKVEEPTVRMSFSINTSPFVGREGKYVTSRNLRDRLYRELERNLAMKVEDGETADTFLVSGRGTLHLTILIENMRREGYEFMIGPPKVINKTVDGKLLEPYEIAAVEVPEESMGSVVELLGKRRGQMVDMEADGPEGTTLLKYKIPTRGLIGLRNAVLTASRGRAILNTIFDSYGPWAGDLSSRDQGSLVAFEDGSTTSYALLNAQERGVLFVQPGQDVYKGQIVGIHQRPGDLAINVCKKKAATNVRSNKETTVVLDEALSYSLDDCIEFIQEDELVEVTPASIRMCKNPKISKKK

SEQ ID NO: 11191 - DNA, 1269 bp, Sorghum bicolor
  misc_feature: Ceres ANNOT ID no. 6121959
  misc_feature: Encodes the peptide sequence at SEQ ID NO 11192
atggagagattaagcaccaaccagctctacaaatctggagttcctgtaaccataccaacatctctgccttctataccagcttctctggatgagagcttcccgaggcttccagatacacagagtgttttgatggagagagaattgaggagcactccactaccaactcaccagaccactgttgctcctatccgtggtcattttcactccaatactggatctgttggacctctgtgctcacctccgtctgtaaggttctgttcgctttcgaatcctgatcaatactccaaccacaatccatacaattctcaaccaccaagcactgcaagttcttcaacactgaattatgggtcacaatatggaggctttgaaccttccataaccgatttcccaagagacgttgaaccaacctggtgccctgatccagttgagagcatccttggatactctggtgatgtccctgctgggaataatgtgactgggaccacttctattggcgcttcagatgatcttactaagcaaactgaatggtggacagagtttatgaatgaggattggaaggacatggttgatatcccaacttccacagaaactcaacaggttgggcaacctgtgcaatcatccatctccgttcatcaatcagctacccaacaaacagtttcgtctcaatctgttgaaccgttggcagttgtggcaccctcacccactgctggctccaatactgccaaggcacgcatgagatggactcctgaacttcacgagcgctttgtggatgctgtcaatcaacttggtggcagtgaaaaagcaactcctaagggtgtcctgaagctaatgaaggccgacaatttgaccatttatcatgtaaaaagtcatcttcagaaatacagaacagctcgatacagaccagagttatctgaaggctcttctgaaaagaaagcggcatctaaagaagatataccatctattgacttgaaagggagttttgatctcactgaagcacttcggctccagttggaacttcaaaagcggcttcatgaacagcttgagatacaaagaagtttgcagctaagaattgaggaacaagggaagtgtcttcagaagatgctagagcagcagtgcataccggggacagaaaaggcacaggatgcttcaaccactgcagatgaattgaagttaccttctgaaattccagaatcttctaccgtcaaggaagttcgagaaaactgtcaaaatggatcaaccaagcaaacagaatcagctaacggccaataa

SEQ ID NO: 11192 - protein, 422 aa, Sorghum bicolor
  misc_feature: Ceres ANNOT ID no. 6121959
  misc_feature (244)..(295): Pfam Id: Myb_DNA-binding Pfam Desc: Myb-like DNA-binding domain
  misc_feature (1)..(306): NCBI GI: 29367483 NCBI Desc: phosphate starvation response regulator-like protein [oryza sativa (japonica cultivar-group)]
  misc_feature (7)..(422): NCBI GI: 6942190 NCBI Desc: cdpk substrate protein 1; csp1 [mesembryanthemum crystallinum]
  misc_feature (174)..(393): NCBI GI: 4519671 NCBI Desc: transfactor [nicotiana tabacum]
  misc_feature (125)..(415): NCBI GI: 140049104 NCBI Desc: homeodomain-related [medicago truncatula]
  misc_feature (136)..(421): NCBI GI: 145338102 NCBI Desc: transcription factor [arabidopsis thaliana]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1781 in the 11/479,226US patent application
  misc_feature: The sequence is a functional homolog of SEQ ID NO 1857 in the 10/374,780US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 270 in the 10/374,780US patent application
  misc_feature: The sequence is a functional homolog of SEQ ID NO 2862 in the 10/374,780US patent application
  misc_feature: The sequence is a functional homolog of SEQ ID NO 384 in the 10/374,780US patent application
  misc_feature: The sequence is a functional homolog of SEQ ID NO 4 in the 10/225,066US patent application
  misc_feature: The sequence is a functional homolog of SEQ ID NO 426 in the 10/225,066US patent application
  misc_feature: The sequence is a functional homolog of SEQ ID NO 933 in the 10/666,642US patent application
  misc_feature: The sequence is a functional homolog of SEQ ID NO 990 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 426 in the 20050160493 US patent application
  misc_feature: The sequence is a functional homolog of SEQ ID NO 990 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 933 in the 20070033671 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
MERLSTNQLYKSGVPVTIPTSLPSIPASLDESFPRLPDTQSVLMERELRSTPLPTHQTTVAPIRGHFHSNTGSVGPLCSPPSVRFCSLSNPDQYSNHNPYNSQPPSTASSSTLNYGSQYGGFEPSITDFPRDVEPTWCPDPVESILGYSGDVPAGNNVTGTTSIGASDDLTKQTEWWTEFMNEDWKDMVDIPTSTETQQVGQPVQSSISVHQSATQQTVSSQSVEPLAVVAPSPTAGSNTAKARMRWTPELHERFVDAVNQLGGSEKATPKGVLKLMKADNLTIYHVKSHLQKYRTARYRPELSEGSSEKKAASKEDIPSIDLKGSFDLTEALRLQLELQKRLHEQLEIQRSLQLRIEEQGKCLQKMLEQQCIPGTEKAQDASTTADELKLPSEIPESSTVKEVRENCQNGSTKQTESANGQ

SEQ ID NO: 11193 - DNA, 2715 bp, Sorghum bicolor
  misc_feature: Ceres ANNOT ID no. 6122014
  misc_feature: Encodes the peptide sequence at SEQ ID NO 11194
  misc_feature: Down-regulated in root tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
atggccaactcatcagctaccaagcatgctttcaagagtatattggccagcctccctaagcctggtggtggtgaatacggcaagttcttcagccttcctgcactaaatgatccaaggattgataggcttccctactccatccgtgttctcctggaatcggctatccgccattgtgataacttccaagttacagagagtgatgtcgagaaaatcattgattgggagaacacatctccaaagctggctgagatacctttcaagccagcgagatgcattctaatggacaacactggagtcccagcagttgtagaccttgcagctatgcgtgatatgatgccaaagttgggttgtgatccctacaagatcaatccactgattcccgtggatgctgttattgaccatgcagtgcgagtggactttgcagggaggcatgatgcattggatagaaacgaggagctggagttccagcgcaacaaagaaaggtttgcttttcttaaatgggcatccaatgctttccacaacatgcaggttttcccccctggttctggcactgtacaccaggtaaatattgagtatcttgcccgagttgtcttcaacgaagatggcattctgtacttcgacagtgtggttggcacagactcgcacaccactatggctaatagtcttggagttgctggttggggagtaggtggtattgaagcggttgttgcaatgcttggccagccaatgggcatggttttgcctggtgtagttggattcaagttgagtgggaagttacgggatggtgtcactacgactgaccttgttcttactatgacccaaatgctaaggaagcacggtgctattggcaaattcgttgaattctatggtgttggtgtgggcgagttatctttgcctgccagggcaacaatcgccaacatgtctccagaatatggagctaccatgggcttcttccctgtagaccaagtagcattggactatctcaaattgacaggccgaagcgatgaaactgtgtcgatgattgaagcatacctgcgagctaacaagatgtttgtggagcaccatgagcctgagacagaacgagtttactcttcatatctggagttggaccttagtgacgtggagccttgcgtttcaggccccaaaaggcctcatgatcgtgtccctttgaaggaaatgaagtcagactggcatgcttgcctggacaacgaagttggtttcaagggctatgcagtgccaaaggaacaacagggtaaagttgtgaaattcgacttccatggacggccagctgaaatcaagcatggcagtgttgttcttgcagcaatatgtagctccacaaacacatcgaatcccagcgtcatgattggtgctggccttgtggcaaagaaagcctgtgaattgggccttgaggtgaagccatgggtaaagacaagccttacccctggatctgtggttgctacggagtacttgaaacatagtggccttcaagattatctgaaccagcaagggttccatgtcgctgggcatggatgcgccacttgcgtcggcaactctggcgacctggatcaatttgtatcagctgctatcatcgaaaatgatatcgttgctgctgcggtgctgtcggccaaccgaaactttgagggccgtgtgaaccctctcactcgggctaactaccttgcctcgccgcctctggttgttgcctatgctcttgccggcactgttgacattgacttcgagaaagagcccgttggagttggaaagggtggcaaggaagttttcttgagggacatatggccttcaaaccaagaaatcgatcaggttgtcgagtccagcgtgcagactcacttgttcaagaaagtgtatgattccatcatggaacgcaaccataggtggaacgagctgccagttccaaaggtggcgctgtacccatgggatgacaactccacctacatccgcaagcccacctaccttgagggcatgtccatgatgccacctggtccacccacggtgaaggaggcctactgcctgctcaaccttggggacagcatcaccacggaccacatttcctactcggggaagatccccgagggcacccctgcggccaagtatctgctcgagcatggcgtggaccccaagaacttcagctcctacggcggccgccgtggcaacaacgaggtggtgatgaggggagcttttgccaacatgaggatcgtgaacaagcttctgggtggcaaggctggtccctggacgatccatgttcctactggggagaagctctatgtttacgacgtggcaatgaaatacaagtcggaaggccatgatatggtcattatcgctggtgctgagtatggcagtggtagctctcgtgactctgctgccaagggaccaatgctactgggtgtcaagtcggtgattgcaaagagcttcgagcggatccaccggagcaacttggttggaatggggatcattcctctctgctttaaagcaggagaggatgccgattcacttggcctcaccggacgtgagcgctacaccatccacctccctaccagcattgctgagatcagtcctggccaggacgtgacagtcacaacccacgacggcagatccttcatttgcactcttcgcttggacacacagcttgaggtgacatacttcaaccatggaggcatccttccctacatggtccgcaacctggcagcacagatgaaataa

SEQ ID NO: 11194 - protein, 904 aa, Sorghum bicolor
  misc_feature: Ceres ANNOT ID no. 6122014
  misc_feature (62)..(572): Pfam Id: Aconitase Pfam Desc: Aconitase family (aconitate hydratase)
  misc_feature (700)..(830): Pfam Id: Aconitase_C Pfam Desc: Aconitase C-terminal domain
  misc_feature (6)..(902): NCBI GI: 3309243 NCBI Desc: aconitase-iron regulated protein 1 [citrus limon]
  misc_feature (6)..(902): NCBI GI: 7437043 NCBI Desc: aconitate hydratase (ec 4.2.1.3) - cucurbit
  misc_feature (6)..(902): NCBI GI: 868003 NCBI Desc: aconitase [cucurbita cv. kurokawa amakuri]
  misc_feature (6)..(902): NCBI GI: 1351856 NCBI Desc: aconitate hydratase, cytoplasmic (citrate hydro-lyase) (aconitase)
  misc_feature (6)..(902): NCBI GI: 4586021 NCBI Desc: cytoplasmic aconitate hydratase [arabidopsis thaliana]
  misc_feature (6)..(902): SWISSPROT Homolog: EC 4.2.1.3 Aconitate hydratase, cytoplasmic
  misc_feature: Down-regulated in root tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
MANSSATKHAFKSILASLPKPGGGEYGKFFSLPALNDPRIDRLPYSIRVLLESAIRHCDNFQVTESDVEKIIDWENTSPKLAEIPFKPARCILMDNTGVPAVVDLAAMRDMMPKLGCDPYKINPLIPVDAVIDHAVRVDFAGRHDALDRNEELEFQRNKERFAFLKWASNAFHNMQVFPPGSGTVHQVNIEYLARVVFNEDGILYFDSVVGTDSHTTMANSLGVAGWGVGGIEAVVAMLGQPMGMVLPGVVGFKLSGKLRDGVTTTDLVLTMTQMLRKHGAIGKFVEFYGVGVGELSLPARATIANMSPEYGATMGFFPVDQVALDYLKLTGRSDETVSMIEAYLRANKMFVEHHEPETERVYSSYLELDLSDVEPCVSGPKRPHDRVPLKEMKSDWHACLDNEVGFKGYAVPKEQQGKVVKFDFHGRPAEIKHGSVVLAAICSSTNTSNPSVMIGAGLVAKKACELGLEVKPWVKTSLTPGSVVATEYLKHSGLQDYLNQQGFHVAGHGCATCVGNSGDLDQFVSAAIIENDIVAAAVLSANRNFEGRVNPLTRANYLASPPLVVAYALAGTVDIDFEKEPVGVGKGGKEVFLRDIWPSNQEIDQVVESSVQTHLFKKVYDSIMERNHRWNELPVPKVALYPWDDNSTYIRKPTYLEGMSMMPPGPPTVKEAYCLLNLGDSITTDHISYSGKIPEGTPAAKYLLEHGVDPKNFSSYGGRRGNNEVVMRGAFANMRIVNKLLGGKAGPWTIHVPTGEKLYVYDVAMKYKSEGHDMVIIAGAEYGSGSSRDSAAKGPMLLGVKSVIAKSFERIHRSNLVGMGIIPLCFKAGEDADSLGLTGRERYTIHLPTSIAEISPGQDVTVTTHDGRSFICTLRLDTQLEVTYFNHGGILPYMVRNLAAQMK

SEQ ID NO: 11195 - DNA, 921 bp, Sorghum bicolor
  misc_feature: Ceres ANNOT ID no. 6122015
  misc_feature: Encodes the peptide sequence at SEQ ID NO 11196
atggccacggcctcttccttcaccgccatcttcttcagcagcgccttcgccgcctgcttcgcagaggtgtgcaccattcctttggacacagccaaagtgcggctccagctgcagaggaagacgcagctgccggctccacccactgctgcagctgctgctggtggaggaatgctagccacgatcatgtgcatcgccagggaggaaggtgttgctgcgctctggaagggtgtcgtccctggccttcaccgccagttcctctatggtggcctccgaatcggcttgtatgagcctgtgaaggctttctttgttggaggtgctgctgtcggtgatgtcagtttgctaagcaagattcttgctgcgcttacaacgggtgtcatagcgattgttgtggcaaatccaactgatcttgtcaaagttaggttgcaagctgatggaaaggctaacactgtcaagaggagttattccggagcccttaatgcatatgctacaataatcagacaggaaggtattggagctttgtggactggtcttggtccaaatgtcgcacgcaatgccataattaacgctgctgagttggccagctacgatcagttcaaacagatgtttctaaaacttcctgggtttactgataacgtttttacccatcttttagctggacttggtgctgggtttctcgctgtttgcattggctctccagtggatgtggtgaaatcaagaatgatgggtgattcaacgtacagaagtactcttgattgttttgccaagacactaaagaatgacggacctggtgctttctacaagggattcattgcaaacttttgtcggattgggtcatggaatgtgataatgttcttaactctggagcaggaacactttatgaagtttatgcatttagattcatatcatatcatatatgcttag

SEQ ID NO: 11196 - protein, 306 aa, Sorghum bicolor
  misc_feature: Ceres ANNOT ID no. 6122015
  misc_feature (6)..(106): Pfam Id: Mito_carr Pfam Desc: Mitochondrial carrier protein
  misc_feature (112)..(206): Pfam Id: Mito_carr Pfam Desc: Mitochondrial carrier protein
  misc_feature (211)..(296): Pfam Id: Mito_carr Pfam Desc: Mitochondrial carrier protein
  misc_feature (1)..(289): NCBI GI: 51860685 NCBI Desc: mitochondrial uncoupling protein 1 [saccharum officinarum]
  misc_feature (4)..(289): NCBI GI: 13537345 NCBI Desc: uncoupling protein [oryza sativa (japonica cultivar-group)]
  misc_feature (1)..(289): NCBI GI: 10716674 NCBI Desc: uncoupling protein [triticum aestivum]
  misc_feature (1)..(289): NCBI GI: 10716672 NCBI Desc: uncoupling protein [triticum aestivum]
  misc_feature (6)..(289): NCBI GI: 22002462 NCBI Desc: mitochondrial uncoupling protein [helicodiceros muscivorus]
  misc_feature: The sequence is a functional homolog of SEQ ID NO. 398 in the 11/188,298 US application
  misc_feature: The sequence is a functional homolog of SEQ ID NO. 385 in the 11/188,298 US application
  misc_feature: The sequence is a functional homolog of SEQ ID NO. 517 in the 11/188,298 US application
MATASSFTAIFFSSAFAACFAEVCTIPLDTAKVRLQLQRKTQLPAPPTAAAAAGGGMLATIMCIAREEGVAALWKGVVPGLHRQFLYGGLRIGLYEPVKAFFVGGAAVGDVSLLSKILAALTTGVIAIVVANPTDLVKVRLQADGKANTVKRSYSGALNAYATIIRQEGIGALWTGLGPNVARNAIINAAELASYDQFKQMFLKLPGFTDNVFTHLLAGLGAGFLAVCIGSPVDVVKSRMMGDSTYRSTLDCFAKTLKNDGPGAFYKGFIANFCRIGSWNVIMFLTLEQEHFMKFMHLDSYHIIYA

SEQ ID NO: 11197 - DNA, 708 bp, Sorghum bicolor
  misc_feature: Ceres ANNOT ID no. 6122038
  misc_feature: Encodes the peptide sequence at SEQ ID NO 11198
atggttggaaatcggacatggtttgggggccttttcaacggctcaggcaaaaggcgacaagtcagtgcagagaagatagtgcttgatctaacccctctacaggaacagagactgcaaaacttgaaggaaaggctaaatataccttatgacgaaaatcggcatgaacatcaagaatcgcttagggctctttggaaaatctcctttcctgatacagagctcactagctttgtttcagcacagtggaaagaaatggggtggcagggcatgaacccagcgactgatttcaggggctgtggatacgtttcccttgagaaccttctattctttgcaagaacatatccggcttctttcaagaggttaatgctgaagcagcaaggaacgcgagctacatgggagtacccctttgcagtcgcaggtgtaaacatctcatacatgctgattcaactgctggagctcaactcagtgcgtccgaaatctttgccagggattaacttcatcaaggtgttgacagaacatgaggatgcattcgacgtgctctactgcatagctttcgagatgatggatgcacagtggctagcaatgcgagcctcgtatatgcagttcaaagaggtgctggaggccacaaagcagcagcttgagagggagctctccctggaggatctcaatggcatccatgacctcccagcctgcaacctcttgtacaaatag

SEQ ID NO: 11198 - protein, 235 aa, Sorghum bicolor
  misc_feature: Ceres ANNOT ID no. 6122038
  misc_feature (54)..(215): Pfam Id: ELMO_CED12 Pfam Desc: ELMO/CED-12 family
  misc_feature (1)..(235): NCBI GI: 90265048 NCBI Desc: h0102c09.5 [oryza sativa (indica cultivar-group)]
  misc_feature (1)..(235): NCBI GI: 38344760 NCBI Desc: osjnba0068l06.3 [oryza sativa (japonica cultivar-group)]
  misc_feature (1)..(235): NCBI GI: 113563563 NCBI Desc: os04g0101700 [oryza sativa (japonica cultivar-group)]
  misc_feature (57)..(235): NCBI GI: 38567695 NCBI Desc: b1160f02.16 [oryza sativa (japonica cultivar-group)]
  misc_feature (1)..(235): NCBI GI: 15218859 NCBI Desc: phagocytosis and cell motility protein elmo1-related [arabidopsis thaliana]
MVGNRTWFGGLFNGSGKRRQVSAEKIVLDLTPLQEQRLQNLKERLNIPYDENRHEHQESLRALWKISFPDTELTSFVSAQWKEMGWQGMNPATDFRGCGYVSLENLLFFARTYPASFKRLMLKQQGTRATWEYPFAVAGVNISYMLIQLLELNSVRPKSLPGINFIKVLTEHEDAFDVLYCIAFEMMDAQWLAMRASYMQFKEVLEATKQQLERELSLEDLNGIHDLPACNLLYK

SEQ ID NO: 11199 - DNA, 1158 bp, Sorghum bicolor
  misc_feature: Ceres ANNOT ID no. 6122080
  misc_feature: Encodes the peptide sequence at SEQ ID NO 11200
atggcgtcgatccgccggccgcactcgccggcgaagcagcacctactgcggcaccaccacccgttcgccacctcctccccgccctcctcgccgctccgccactcctcctcttcgccccggacccaccaccacctcgccgccgccgccgccgccggcggatacccgcacccgttcctcttcttcacgcgccgcccgctcccacgcttcgcggccttcttcctgctcggctctttcctcggcctgctccacttcctctcccacctccctcaccagaccccacacctccgcccctcgacttcccccaacaatcccaccaccgccgccgtcctccccatcgtccgcctccacgacgacgacgacgcaaccaccaacaagctgctcgtcatcgtcacgcccacgcgcgcgcgcgccgcgcaggcgtactacctcagccggatgggccacacgctgcgcctcgtcgacccgcccgtcctctggctcgtcgtcgaggccggcaagcccacgcccgaggccgccgccacgctgaggggcaccaccgtcatgcaccgctacgtcggctgctgcgacaagctcaacgcctcatccgtcgatgacgaccggctccggctccgaccgcaccagatgaatgccgcgctcgagctcatcgagaaccaccgcctcgatggcattgtttatttcgccgacgaggagggcgtctactccctcgacctcttcaaacgcctccgccaagtcaggaggttcggcacatggcctgtgccagtgatctctgaaaacagaaaggatggtgtggtgctggaaggccctgtgtgtaaacagaaccaagttgtggggtggcacacaagtgagcatgccagcaagctccgtagatttcatgttgctatgtcgggtttcgcgttcaacagcaccatgctctgggaccccaaactccgctcccatttggcatggaattcaatccggcatcccgacacagagaaagaaggttttcaagtaaccacgttcatagagcaactagtggaggatgaaagccagatggaaggcatacccgctgactgctctcaaataatgaactggcatgtgccatttggatctgagaatcttgcctatcccaaaggatggcgagttccgacgaatctggatgtggtcattcctcttaaatag

SEQ ID NO: 11200 - protein, 385 aa, Sorghum bicolor
  misc_feature: Ceres ANNOT ID no. 6122080
  misc_feature (146)..(363): Pfam Id: Glyco_transf_43 Pfam Desc: Glycosyltransferase family 43
  misc_feature (1)..(385): NCBI GI: 116317779 NCBI Desc: osigba0123d13.6 [oryza sativa (indica cultivar-group)]
  misc_feature (1)..(385): NCBI GI: 38344768 NCBI Desc: osjnba0068l06.11 [oryza sativa (japonica cultivar-group)]
  misc_feature (118)..(385): NCBI GI: 32968176 NCBI Desc: beta3-glucuronyltransferase [hordeum vulgare]
  misc_feature (120)..(385): NCBI GI: 64967536 NCBI Desc: beta-1,3-glucuronosyltransferase [medicago truncatula]
  misc_feature (120)..(385): NCBI GI: 63087716 NCBI Desc: beta-1,3-glucuronosyltransferase [lotus corniculatus var. japonicus]
MASIRRPHSPAKQHLLRHHHPFATSSPPSSPLRHSSSSPRTHHHLAAAAAAGGYPHPFLFFTRRPLPRFAAFFLLGSFLGLLHFLSHLPHQTPHLRPSTSPNNPTTAAVLPIVRLHDDDDATTNKLLVIVTPTRARAAQAYYLSRMGHTLRLVDPPVLWLVVEAGKPTPEAAATLRGTTVMHRYVGCCDKLNASSVDDDRLRLRPHQMNAALELIENHRLDGIVYFADEEGVYSLDLFKRLRQVRRFGTWPVPVISENRKDGVVLEGPVCKQNQVVGWHTSEHASKLRRFHVAMSGFAFNSTMLWDPKLRSHLAWNSIRHPDTEKEGFQVTTFIEQLVEDESQMEGIPADCSQIMNWHVPFGSENLAYPKGWRVPTNLDVVIPLK

SEQ ID NO: 11201 - DNA, 2589 bp, Sorghum bicolor
  misc_feature: Ceres ANNOT ID no. 6122082
  misc_feature: Encodes the peptide sequence at SEQ ID NO 11202
atggaggacgtcctgacaccgccgccgccgccgccgcagcagcagcagcagccggaactcgccggagagaagcgtaagagggaggagggttcggtggacgcgtccaccgaagacgctccatccgcccccgcctccaccggcagtgctgaggatgcggccggcagcggcgtcgcccggcacccgatgtggaagacgagcctgtgctctttcttccgccgccgcggcgccggcgccgaagggtgtagccacggggagtcctgccgctacgcgcacaccgaggaggagctccgcccgcggcccgacggcacctgggaccccacctccgaccgcgccaagaagctccgcaaggtcgccgcggaggcccaggaggaggctgaggaggaggtcacggtggatgagcaggcactcgacaagtgcctcgtcgggctccccagggggtggacggctgataggctcaagtcattcctccaggagcaggaaatctcgtatgcaacagcaaagaagaagaagggaatgacagttggttttgtgacttttcagagtgttgaacaactaacaaatgctgttcaggtccttaaggagaacccttctggtggaaaagaaatcaagatagtagatgccaatcgtaggtcccatcaaaaagcacatgttgaagcaccggtatccaatactggaacagcaacagaaaatggcagtagtcctactaatgcagaggaaacacctgctcctgaatcggattcatcaagtaaaagaagtgcccgtgatgcagttactccccttgcccatatgacttacattgatcagctagaacacaaaaaacaatcgatggcacagatactgaagaaacttactcgcaatgctaggaaagcttgcccacctgccattccccttcctgattgggttttaaaatcaaaggaaatcggtggccttccttgcaagcttgaaggcattttggagtccccagttgttaatggataccgtaacaagtgtgagttctctgtaggatattccttagagggcaaaaagacggtgggatttatgctcggaaatttcagggaaggtgtgactgctgttgaggaacctgtgaactgtccaaatgtctcagaaatttcctgcaaatatgcccagatgttccaagattttcttcaatcatcaggcttccctttgtggagcaagattgacaactctgggttttggcgccaactcacagttcgtgagggaagatgtccagctgaagctgttgtttcacagaatgcagaatcacaaatatcagaagtcatgcttattgtgcaggtgtgttcaacaggtgttgatgaagctcttatgaaagaagagtttgacaagctgtctgctgccttgatacaaggagcagcaacatgctcacctcccttgccactgacaactattgtagtgcaagatcataaagggatatcaaatgctgcacctactgattgcccactgatcccgctattggtaccaaatggagatcagttggatggcacaacagaagataaaacaagaatccatgatcacataagcaacttaaagttctctatatcaccaacagcttttttccaggttaatactcttgctgcagaaagattgtatacccttgctggtgattgggctaatctcaattcagacacattactttttgatgtgtgctgtgggactggaactattggcctgaccttagcacatcgtgttggaatggttgttgggattgaaatgaatgaatcagcagtttcagatgctcacaaaaatgctcttatcaatggcataaaaaattgtcgctttgtttgtagtaaggctgaagatgtgatggggccccttctgacagaatatcttggttcaccacagcagcaggctgcagcttctgaaagtaattctgaaattgatgatacaaacaaaaatgaggatacaattgactgcacaaattgtgatggtgaaaatatagatagttcaaagcacagaaatgacaatggtgaaggtcagcagcctatggacacgtcagttgactatcctacctgtgcaagcaacgaggaggtggatggggtgaacaaagtggttgattgcagtcatgatgaacacaatgtggcttctggtgaacagaattgtggggaagcatcgttgctcaatgataaacccattgagacatcatcggataatagtttggagcaaggcaaagcatgtcaggatggttcttccaatccaaacgataatgtccttgctgctaatgcatgccagtttaagaatgttgttgctattgtagaccctccacgtgttggccttcaccctactgtgatcaaggcattgaggacgcacccacgtattcgacgtctagtgtacatctcctgcaaccctgagagtctagtcgctaatgcgattgagctttgcacgccaacatctgagaaacaagagaagaacaaaggcaaccgagggtggcgatctatgagcagcgccggtcttgcacggcagaggacgaagtcgatgcccaactctgaaccttttatacccaagagggcaatggctgtcgatctgttccctcacacgccgcactgcgagatggttatgctttttgagaggtga

SEQ ID NO: 11202 - protein, 862 aa, Sorghum bicolor
  misc_feature: Ceres ANNOT ID no. 6122082
  misc_feature (63)..(93): Pfam Id: zf-CCCH Pfam Desc: Zinc finger C-x8-C-x5-C-x3-H type (and similar)
  misc_feature (1)..(862): NCBI GI: 38346207 NCBI Desc: osjnba0094o15.14 [oryza sativa (japonica cultivar-group)]
  misc_feature (1)..(472): NCBI GI: 115456810 NCBI Desc: os04g0105000 [oryza sativa (japonica cultivar-group)]
  misc_feature (6)..(691): NCBI GI: 22135822 NCBI Desc: at2g28450/t1b3.3 [arabidopsis thaliana]
  misc_feature (508)..(623): NCBI GI: 122890880 NCBI Desc: novel protein (zgc:55519) [danio rerio]
  misc_feature (508)..(623): NCBI GI: 41053969 NCBI Desc: hpaii tiny fragments locus 9c [danio rerio]
  misc_feature: The sequence is a functional homolog of SEQ ID NO. 291 in the 11/188,298 US application
MEDVLTPPPPPPQQQQQPELAGEKRKREEGSVDASTEDAPSAPASTGSAEDAAGSGVARHPMWKTSLCSFFRRRGAGAEGCSHGESCRYAHTEEELRPRPDGTWDPTSDRAKKLRKVAAEAQEEAEEEVTVDEQALDKCLVGLPRGWTADRLKSFLQEQEISYATAKKKKGMTVGFVTFQSVEQLTNAVQVLKENPSGGKEIKIVDANRRSHQKAHVEAPVSNTGTATENGSSPTNAEETPAPESDSSSKRSARDAVTPLAHMTYIDQLEHKKQSMAQILKKLTRNARKACPPAIPLPDWVLKSKEIGGLPCKLEGILESPVVNGYRNKCEFSVGYSLEGKKTVGFMLGNFREGVTAVEEPVNCPNVSEISCKYAQMFQDFLQSSGFPLWSKIDNSGFWRQLTVREGRCPAEAVVSQNAESQISEVMLIVQVCSTGVDEALMKEEFDKLSAALIQGAATCSPPLPLTTIVVQDHKGISNAAPTDCPLIPLLVPNGDQLDGTTEDKTRIHDHISNLKFSISPTAFFQVNTLAAERLYTLAGDWANLNSDTLLFDVCCGTGTIGLTLAHRVGMVVGIEMNESAVSDAHKNALINGIKNCRFVCSKAEDVMGPLLTEYLGSPQQQAAASESNSEIDDTNKNEDTIDCTNCDGENIDSSKHRNDNGEGQQPMDTSVDYPTCASNEEVDGVNKVVDCSHDEHNVASGEQNCGEASLLNDKPIETSSDNSLEQGKACQDGSSNPNDNVLAANACQFKNVVAIVDPPRVGLHPTVIKALRTHPRIRRLVYISCNPESLVANAIELCTPTSEKQEKNKGNRGWRSMSSAGLARQRTKSMPNSEPFIPKRAMAVDLFPHTPHCEMVMLFER

SEQ ID NO: 11203 - DNA, 1551 bp, Sorghum bicolor
  misc_feature: Ceres ANNOT ID no. 6122096
  misc_feature: Encodes the peptide sequence at SEQ ID NO 11204
atggcaagaggagggttggaggcggcagatggtcacagctatggcggtagcttgacggccgctgtcatggccatctgcctcatggctgcttcctgtggcctcgtcttcggctaccatgttggtgtcgcaggtggtgtcacacaaatggagtcattcttgaataagttcttcccggaagtggtgagcgggatgaagagtgcaaagcgtgatgcctattgcatgtacgacaaccagcttcttacagcattcacgtcatcgatgtacattggtagctccctgtcatcattagtggcaagccgtgtgacaatggcaagccgtgtgacaagaagggttggacgccaatctgtcatgctcatcggtggcgtcttattcctcttcggctctatcatcaacgctggggctgttactgtcagcatgctcatcatgggccagatgctactaggcttcggtgttggcttcactacgcaggctgctccactctatctcgccgaaacatcaccgccaaggtggcgtggagcattcacaatagcctaccacatattcgtttgtatcggctcagtgatcgcgaacatggtgaactatctaacaaactccatgccctactggggctggcggatctcactcggtgtcgctgccataccagccatcatcatcatcgtgggtgcccttttggtaacagacagcccaagcagcctagtgctacgtggtgagccggataaggctcgtgtgtcactgcagcacatccgtgggtcagatgctaacatcgaagccgagttcaaggacattgtttgtgcagtcgaagaggcatgccagaacgagcaaggtgcgttcaagaggctatgcaataagaggtaccgaccttacgcggtgatgatggtggccatacctgtgttcttccagctcacgggcatgatcgtcgtcttcgtcttcgcgccagtgctgttccggaccgtaggcttcagcagccagaaggcgattcttggttctgccatcgttaaccttgtgaccttgtgcgccgtcatcacatccaccttcgtcgtggacagatatggccggaggtccttgttcctcataggtggcatcagcatgataatttttcaggtggccgtgtcatggatacttgcggagcaccttgggaagcacaatgcagtgacgatggcgaggagctatgcgatgggcgtgttggtgctcatgtgcctgtacaccttcagcttgggtctgtcgtgggattcactcaagtgggtgattctgagcgagatccaccccgttgaaactaggtccgtggggcaggccatctccatgaccatcgcgttcgtcctctactttatacaggcacaggtgttcacgaccctgctctgcaatctgaaattcgggatattcctcttctttgccggctgggtgctggccatgacggctttcatcgtggtgctcctgccggagacgaaaggagtgccactagaggctatgcgggcagtatgggcacgccattggtactggaagaggttcttcctgcaggatatcaacaaacacgaccttagttcaactggttaa

SEQ ID NO: 11204 - protein, 516 aa, Sorghum bicolor
  misc_feature: Ceres ANNOT ID no. 6122096
  misc_feature (25)..(493): Pfam Id: Sugar_tr Pfam Desc: Sugar (and other) transporter
  misc_feature (25)..(445): Pfam Id: MFS_1 Pfam Desc: Major Facilitator Superfamily
  misc_feature (5)..(502): NCBI GI: 21741620 NCBI Desc: osjnba0027g07.5 [oryza sativa (japonica cultivar-group)]
  misc_feature (5)..(502): NCBI GI: 116309958 NCBI Desc: h0505f09.4 [oryza sativa (indica cultivar-group)]
  misc_feature (1)..(511): NCBI GI: 115458712 NCBI Desc: os04g0453300 [oryza sativa (japonica cultivar-group)]
  misc_feature (1)..(511): NCBI GI: 116309959 NCBI Desc: h0505f09.5 [oryza sativa (indica cultivar-group)]
  misc_feature (1)..(502): NCBI GI: 32489200 NCBI Desc: osjnba0027g07.27 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MARGGLEAADGHSYGGSLTAAVMAICLMAASCGLVFGYHVGVAGGVTQMESFLNKFFPEVVSGMKSAKRDAYCMYDNQLLTAFTSSMYIGSSLSSLVASRVTMASRVTRRVGRQSVMLIGGVLFLFGSIINAGAVTVSMLIMGQMLLGFGVGFTTQAAPLYLAETSPPRWRGAFTIAYHIFVCIGSVIANMVNYLTNSMPYWGWRISLGVAAIPAIIIIVGALLVTDSPSSLVLRGEPDKARVSLQHIRGSDANIEAEFKDIVCAVEEACQNEQGAFKRLCNKRYRPYAVMMVAIPVFFQLTGMIVVFVFAPVLFRTVGFSSQKAILGSAIVNLVTLCAVITSTFVVDRYGRRSLFLIGGISMIIFQVAVSWILAEHLGKHNAVTMARSYAMGVLVLMCLYTFSLGLSWDSLKWVILSEIHPVETRSVGQAISMTIAFVLYFIQAQVFTTLLCNLKFGIFLFFAGWVLAMTAFIVVLLPETKGVPLEAMRAVWARHWYWKRFFLQDINKHDLSSTG

SEQ ID NO: 11205 - DNA, 1017 bp, Sorghum bicolor
  misc_feature: Ceres ANNOT ID no. 6122129
  misc_feature: Encodes the peptide sequence at SEQ ID NO 11206
atggcaatggcatcctccgagctgccgacgctcctcgtgttccgcgtccgggaactgcgcttccacgccgcgctgcgtgagcggtaccgcgtcctcgacttcttgacgtcgggcgagcccctcccggccttcctcgccgccgcagcggccgccgacccgccacgcgcggcgctcgtcgtgggaggagactccgcccgcgtggacgcggcgttcctcgacgccgtcccgtcgctccgcttcgtcttcagcacgggcgccgggctagaccacatcgacctcgccgagtgcgcgcgccgcggcgtcgccgtcgccaactccggcaccgtctactccaccgacgtcgccgaccacgccgtcggcatgctcatcgacgtgctccgccgcgtctccgccgcccaacggttcctccgccgcgggctctggccgctccaccaccaccaggggaacgactaccaccaccatccccatggccatcccctcggcaccaaggtgggcggcaagcgcgtcggcatcatcggcctaggcaacatcggcatgctgatcgccaagaggctcgaagctttcggctgtgtcatctcctacaactcgagaaaacccaaggaatccgtcgtctcctacaggtacttcgctagcgtccacgacatggcgtcggaatcagacgtgctcgtcgtcgcgtgcgcgctgagcaaggagacgcggcacgtcgtgaacaaggacgttcttgacgcgctcgggaaagacggcgtcgtcataaacatcggccgggggctgaacgtcgacgaggcggagcttgtcagcgcgctggaagaggggaggatcgccggagctgggctcgatgtctacgagaaggaacccaaggtgcctgcggagctcttcgccatggacaatgtcgtgctgacgcatcattgcgcggctttcaccatggagtccaggtcggacctccgtgacgtcgccattgggaaccttgaagccttcttctccggtaagccgctgcttaccccggttcttcacaggtaa

SEQ ID NO: 11206 - protein, 338 aa, Sorghum bicolor
  misc_feature: Ceres ANNOT ID no. 6122129
  misc_feature (119)..(304): Pfam Id: 2-Hacid_dh_C Pfam Desc: D-isomer specific 2-hydroxyacid dehydrogenase, NAD bindingdomain
  misc_feature (11)..(336): Pfam Id: 2-Hacid_dh Pfam Desc: D-isomer specific 2-hydroxyacid dehydrogenase, catalyticdomain
  misc_feature (9)..(336): NCBI GI: 38346877 NCBI Desc: osjnbb0004g23.11 [oryza sativa (japonica cultivar-group)]
  misc_feature (9)..(336): NCBI GI: 116310892 NCBI Desc: b0616e02-h0507e05.8 [oryza sativa (indica cultivar-group)]
  misc_feature (9)..(336): NCBI GI: 116310894 NCBI Desc: b0616e02-h0507e05.10 [oryza sativa (indica cultivar-group)]
  misc_feature (9)..(336): NCBI GI: 115456830 NCBI Desc: os04g0107200 [oryza sativa (japonica cultivar-group)]
  misc_feature (48)..(335): NCBI GI: 38345308 NCBI Desc: osjnbb0085f13.13 [oryza sativa (japonica cultivar-group)]
MAMASSELPTLLVFRVRELRFHAALRERYRVLDFLTSGEPLPAFLAAAAAADPPRAALVVGGDSARVDAAFLDAVPSLRFVFSTGAGLDHIDLAECARRGVAVANSGTVYSTDVADHAVGMLIDVLRRVSAAQRFLRRGLWPLHHHQGNDYHHHPHGHPLGTKVGGKRVGIIGLGNIGMLIAKRLEAFGCVISYNSRKPKESVVSYRYFASVHDMASESDVLVVACALSKETRHVVNKDVLDALGKDGVVINIGRGLNVDEAELVSALEEGRIAGAGLDVYEKEPKVPAELFAMDNVVLTHHCAAFTMESRSDLRDVAIGNLEAFFSGKPLLTPVLHR

SEQ ID NO: 11207 - DNA, 960 bp, Sorghum bicolor
  misc_feature: Ceres ANNOT ID no. 6122138
  misc_feature: Encodes the peptide sequence at SEQ ID NO 11208
atgacgccggcggccgccggcgcgggggccaagccgttggtgctgctgtcgcagccgtcggactctggcttaacaccggtgatggagggccagttcaggttcgtcctggcggcggacgccgacgcggcgacggcggccgaggcccgggtcctgttcgtgccggggctcaggccagtgaccgccgacctcatcgaccggctcccggcgctggagctcgtggccgcgatctccgtcgggttggaccacgtggacctcgacgcctgccgccgccgcgggatcaccgtcaccaacgccggcacgacgttctccgtggacattgcggactatgctgtcggcctcgtcgtcgccgtcctccgcaaggtggccgccgccgacgcacacctccggcgcggccgatgggccatggacggcgactacccgctcgccaccaaggtgagcgggaagcgcgtcggcattgtggggctaggcagcatcggctcgctggtggcgcggcggctggcggcgttcggttgcgccgtggcgtaccactcccggacgcgcaagccgccgccgtgcccctacacgttctacccgacggtgcgcgcgctggcggcggacagcgacgtgctggtgctggcgtgcgcgctgacggaggagacgcggcgcgcggtggaccgggaggtgatggaggcgctgggccgcggcggcggcgtgctcgtcaacgtcggccgcggcgcgctggtggacgagccggagctggtgcgctgcctgcgggacggcgtcatcggcggcgccgggctcgacgtgttcgagaacgagccggacgtgccggcggagctcttcgacatggacaacgtcgtgctgtcgagccacaaggccgtggccacgacggagtccatccgtggcgtgctcgataccgtctccgggaacctcgaggccttcttcgccgggaagccgctgctgagccccgtcgcgctctga

SEQ ID NO: 11208 - protein, 319 aa, Sorghum bicolor
  misc_feature: Ceres ANNOT ID no. 6122138
  misc_feature (111)..(286): Pfam Id: 2-Hacid_dh_C Pfam Desc: D-isomer specific 2-hydroxyacid dehydrogenase, NAD bindingdomain
  misc_feature (14)..(318): Pfam Id: 2-Hacid_dh Pfam Desc: D-isomer specific 2-hydroxyacid dehydrogenase, catalyticdomain
  misc_feature (1)..(319): NCBI GI: 116310896 NCBI Desc: b0616e02-h0507e05.12 [oryza sativa (indica cultivar-group)]
  misc_feature (1)..(319): NCBI GI: 38345308 NCBI Desc: osjnbb0085f13.13 [oryza sativa (japonica cultivar-group)]
  misc_feature (6)..(319): NCBI GI: 38346877 NCBI Desc: osjnbb0004g23.11 [oryza sativa (japonica cultivar-group)]
  misc_feature (6)..(319): NCBI GI: 116310892 NCBI Desc: b0616e02-h0507e05.8 [oryza sativa (indica cultivar-group)]
  misc_feature (3)..(317): NCBI GI: 115456830 NCBI Desc: os04g0107200 [oryza sativa (japonica cultivar-group)]
MTPAAAGAGAKPLVLLSQPSDSGLTPVMEGQFRFVLAADADAATAAEARVLFVPGLRPVTADLIDRLPALELVAAISVGLDHVDLDACRRRGITVTNAGTTFSVDIADYAVGLVVAVLRKVAAADAHLRRGRWAMDGDYPLATKVSGKRVGIVGLGSIGSLVARRLAAFGCAVAYHSRTRKPPPCPYTFYPTVRALAADSDVLVLACALTEETRRAVDREVMEALGRGGGVLVNVGRGALVDEPELVRCLRDGVIGGAGLDVFENEPDVPAELFDMDNVVLSSHKAVATTESIRGVLDTVSGNLEAFFAGKPLLSPVAL

SEQ ID NO: 11209 - DNA, 753 bp, Sorghum bicolor
  misc_feature: Ceres ANNOT ID no. 6122217
  misc_feature: Encodes the peptide sequence at SEQ ID NO 11210
atggcggcgcggggaaggaacgcggcggatgtcctggtgctcttcgacgtcgacgacaccctcaccgcgccccgcaagccggtgacgccggagatgctggagttcatgagacagctgcgacagcacgtggctcttggcgtggtgggtggatctgatctggccaagattaccgagcagctcggcaaatcagtttttactgattacgattacgtcttctctgaaaatggcctggttgcacacaagaacggagagctaattggaactcaaagtttgaaatcatttctcggagacgacaagctgaaggaaattattaacttcactcttcactacattgctgacttggatatcccaattaaaacgggtacattcatagagctccgaaatgggatgattaacgtgtctcctatagggagaaattgcagtcaggaggagcgtgatgaatttgagaagtatgataaggtgcataacatccggcctaagatggtgtctgtgcttcgtgaaaggtttacacacttgaacctgacattttctatcggtgggcagattagtttcgatgtttttccccaaggctgggacaaaacttactgtttgagatatcttgaggagtttcaggaaatccatttctttggtgataagacttacaagggtggcaatgattatgagatttttgtatctgacagaacagttgggcatacagttaccagccctgatgacacgttacaacaatgcagagatctcttcatggctaagtga

SEQ ID NO: 11210 - protein, 250 aa, Sorghum bicolor
  misc_feature: Ceres ANNOT ID no. 6122217
  misc_feature (32)..(249): Pfam Id: PMM Pfam Desc: Eukaryotic phosphomannomutase
  misc_feature (1)..(250): NCBI GI: 90399073 NCBI Desc: h0124b04.12 [oryza sativa (indica cultivar-group)]
  misc_feature (1)..(250): NCBI GI: 90762172 NCBI Desc: phosphomannomutase [triticum aestivum]
  misc_feature (1)..(248): NCBI GI: 90762150 NCBI Desc: phosphomannomutase [glycine max]
  misc_feature (1)..(250): NCBI GI: 90762161 NCBI Desc: phosphomannomutase [nicotiana tabacum]
  misc_feature (11)..(248): NCBI GI: 87162644 NCBI Desc: had-superfamily hydrolase subfamily iib [medicago truncatula]
  misc_feature (6)..(247): SWISSPROT Homolog: EC 5.4.2.8 Phosphomannomutase
MAARGRNAADVLVLFDVDDTLTAPRKPVTPEMLEFMRQLRQHVALGVVGGSDLAKITEQLGKSVFTDYDYVFSENGLVAHKNGELIGTQSLKSFLGDDKLKEIINFTLHYIADLDIPIKTGTFIELRNGMINVSPIGRNCSQEERDEFEKYDKVHNIRPKMVSVLRERFTHLNLTFSIGGQISFDVFPQGWDKTYCLRYLEEFQEIHFFGDKTYKGGNDYEIFVSDRTVGHTVTSPDDTLQQCRDLFMAK

SEQ ID NO: 11211 - DNA, 2040 bp, Sorghum bicolor
  misc_feature: Ceres ANNOT ID no. 6122256
  misc_feature: Encodes the peptide sequence at SEQ ID NO 11212
atggcagcgaccgcgccggccaccgacccaccggatgcctcgcctgcggtcacagaggatgctcccactcctgctcgtcccaccccggcggagctggtagcccgcgccgtcgcccccgtgaagcccgccttccttcgcccgcctcccgtccgcgaggcacccaaggaggagggcggcggcggcggcgccgtcgtaaaggtggagaagaagtccaagcgccagctcaagcgcgagcgccaccaggaacaaaagtctacttctcatctttgtatccaagtagggaaaagtggaaatgtggactcatgcaaatacggcacttcttgtcgtttcagccatgacataaatgcttatttgtctcagaaaccagctgaccttgaaggcacatgcccatttacctcactgggacagttgtgtccatatggaataacttgtcgattccttagtacgcataaggatacccctgatcctcaaaatcatccagaaggaaaccatgagagaaatcctttgagcaaagaaattcaaaagctcttatggaagagcaaatataaatttcccaaggccagtgcccaaatcaaacttcttggtcttaaggatggaaacaagaataaagcagaagcagcaaatgataatccagatgaaacatgtgagctgaatggtgatgagaaaacgtctctttctagcattcctgtgaatgttgaacctgatcccacgttgtgcaaagaaatagataattcagagggacatcctttggttgttaactcggttgaatctgtggagccaaggccatcaaagaaatcaaaggttgaagttgatgaaactcaggaccatggaactggtatgcatgacaatggggctgaatctgaagctgttaatttaatcaatggagtaaaagtttcctcaaacaaccaaagttcctgcaaagttgatctgatcacaacacctcatttacgtgaaaagaaaattatagattttcgagagaagctgtaccttgctcccttgaccactgttgggaatcttccttttcggaggctctgtaaaaccttgggagctgatgttacttgtggagaaatggctatgagcacaaatcttttgcaggggcaagcttcagagtgggctttgctgcgacggcatccatcagaggatttgtttggggtgcaaatctgtggaccgtatccagatacggtagcacggacagttgaacttgtggataatgaatgtccagttgacttcatagacataaatatgggctgcccaattgatatagttgtcaacaagggtgctggatcatcattgctcacaaagcctatgaggattaggagtattgtacaagcagcatcttctgttactgaaaaaccattaactgttaaggtaagaacagctttctttgagggcaggaatcgtgctgattctatagtttcagatatctacgactggggtgcttcagccataacaatacatggtcgatcacggcaacaacgctacagcaaacttgctgattgggactatatctaccagtgtgcacagaaggctcctgactatttgcatgtcattggaaatggtgatgtattctcctttactgactggaacaaacatgtttcagactgctccaaaatttctacttgcatgattgctagaggtgcacttatcaagccctggttatttactgagataaaagaacaaaggcactgggatattacatctggtgagagattaaatattcttaaagattttgttcgttttggtctggaacattggggctctgattccaaaggagttgaaacaacacgccatttcctactggaatggcttagttacacctgtcgctacattccggtgggtctgctggatgtcattccacaacgattgaactggaggcctccaagctactatgggcgtgatgacctcgaaaccctgatggtctctgattcagcagctgactggataaggatctcagagatgttacttggcaaagttccagaaggatttaccttcgcaccgaaacacaaatccaatgcctatgaccgagcagaaaacggttaa

SEQ ID NO: 11212 - protein, 679 aa, Sorghum bicolor
  misc_feature: Ceres ANNOT ID no. 6122256
  misc_feature (329)..(623): Pfam Id: Dus Pfam Desc: Dihydrouridine synthase (Dus)
  misc_feature (2)..(679): NCBI GI: 116308867 NCBI Desc: h0613h07.1 [oryza sativa (indica cultivar-group)]
  misc_feature (2)..(679): NCBI GI: 38344118 NCBI Desc: osjnbb0050o03.15 [oryza sativa (japonica cultivar-group)]
  misc_feature (246)..(673): NCBI GI: 28436916 NCBI Desc: mgc53781 protein [xenopus laevis]
  misc_feature (246)..(673): NCBI GI: 89272495 NCBI Desc: dihydrouridine synthase 3-like protein [xenopus tropicalis]
  misc_feature (318)..(673): NCBI GI: 110808212 NCBI Desc: trna-dihydrouridine synthase 3-like
MAATAPATDPPDASPAVTEDAPTPARPTPAELVARAVAPVKPAFLRPPPVREAPKEEGGGGGAVVKVEKKSKRQLKRERHQEQKSTSHLCIQVGKSGNVDSCKYGTSCRFSHDINAYLSQKPADLEGTCPFTSLGQLCPYGITCRFLSTHKDTPDPQNHPEGNHERNPLSKEIQKLLWKSKYKFPKASAQIKLLGLKDGNKNKAEAANDNPDETCELNGDEKTSLSSIPVNVEPDPTLCKEIDNSEGHPLVVNSVESVEPRPSKKSKVEVDETQDHGTGMHDNGAESEAVNLINGVKVSSNNQSSCKVDLITTPHLREKKIIDFREKLYLAPLTTVGNLPFRRLCKTLGADVTCGEMAMSTNLLQGQASEWALLRRHPSEDLFGVQICGPYPDTVARTVELVDNECPVDFIDINMGCPIDIVVNKGAGSSLLTKPMRIRSIVQAASSVTEKPLTVKVRTAFFEGRNRADSIVSDIYDWGASAITIHGRSRQQRYSKLADWDYIYQCAQKAPDYLHVIGNGDVFSFTDWNKHVSDCSKISTCMIARGALIKPWLFTEIKEQRHWDITSGERLNILKDFVRFGLEHWGSDSKGVETTRHFLLEWLSYTCRYIPVGLLDVIPQRLNWRPPSYYGRDDLETLMVSDSAADWIRISEMLLGKVPEGFTFAPKHKSNAYDRAENG

SEQ ID NO: 11213 - DNA, 375 bp, Sorghum bicolor
  misc_feature: Ceres ANNOT ID no. 6122258
  misc_feature: Encodes the peptide sequence at SEQ ID NO 11214
atgtcgtcggcggcgggaggagacggggagacggtgcgggcgtcgcacatcctcatcaagcaccagggttcccgccgcaaggcctcctggaaggaccccgacggccgcatcatctccgccaccacgcgcgccgacgccgccgcgcgcctcctcgacctccgcaaccagatcctctccggccaggccaacttcgccgacctcgccgcgcgccactccgactgctcctccgcgcgacgcggcggggacctaggtacctttgggaggaagcagatgcagaaaccatttgaggacgctacatatgccctcaaggttggtgagctcagcgagatcgtggacacggacagtggggttcacgtcatcctgcggactgcctga

SEQ ID NO: 11214 - protein, 124 aa, Sorghum bicolor
  misc_feature: Ceres ANNOT ID no. 6122258
  misc_feature (16)..(124): Pfam Id: Rotamase Pfam Desc: PPIC-type PPIASE domain
  misc_feature (1)..(124): NCBI GI: 116308872 NCBI Desc: h0613h07.6 [oryza sativa (indica cultivar-group)]
  misc_feature (1)..(123): NCBI GI: 15077233 NCBI Desc: pin1-type peptidyl-prolyl cis/trans isomerase [malus x domestica]
  misc_feature (10)..(123): NCBI GI: 8670992 NCBI Desc: peptidyl-prolyl cis-trans isomerase [digitalis lanata]
  misc_feature (1)..(123): NCBI GI: 92888352 NCBI Desc: peptidyl-prolyl cis-trans isomerase 1 (ec 5.2.1.8) (rotamase pin1)(ppiase pin1) (mdpin1) [medicago truncatula]
  misc_feature (10)..(124): NCBI GI: 22218833 NCBI Desc: chain a, solution structure of pin1at from arabidopsis thaliana
  misc_feature (1)..(123): SWISSPROT Homolog: EC 5.2.1.8 Peptidyl-prolyl cis-trans isomerase 1
MSSAAGGDGETVRASHILIKHQGSRRKASWKDPDGRIISATTRADAAARLLDLRNQILSGQANFADLAARHSDCSSARRGGDLGTFGRKQMQKPFEDATYALKVGELSEIVDTDSGVHVILRTA

SEQ ID NO: 11215 - DNA, 717 bp, Sorghum bicolor
  misc_feature: Ceres ANNOT ID no. 6122266
  misc_feature: Encodes the peptide sequence at SEQ ID NO 11216
atgaggccggtcttcgtggggaacctggactatgacacccgccactcggagctcgaccaactcttctaccgctacggcagggtcgagcgcatcgacatgaagtcaggcttcgcttttgtctactttgaggatgaacgtgatggcaatgatgccatacgggctcttgatggttatccatttggccctggcagacgcaggctttcagtagagtggtcacggggtgatcgagctgctagacgtgatggtaacaaaccagaagcaaatactaagccaactaggacattgtttgtcatcaactttgatccaatcaacacaagggtcagtgacattgaaaggcacttcgcaccatttgggaacttatcaagtgtaaggataaggaagaactttgctttcgtccagtttgaaacactggaagaagccagaaaggctcttgatgctactcatgctaccacgcttttggacagggtgatttctgttgagtacgcctttagggatgatagtgaacggagtgataggtacgacagcccaagaagaggtggtggctatggtaggcgtggtgatagcccagtgtacaggtcacggcctagtccagactatggtcgcccagcaagtcctgtatatggttcatatgacagaagtcctgttcgtgatcgctatcggagatctcctgcttatcgatcaagatccccacgtgtgaaccgaagagcatatgactaa

SEQ ID NO: 11216 - protein, 238 aa, Sorghum bicolor
  misc_feature: Ceres ANNOT ID no. 6122266
  misc_feature (4)..(69): Pfam Id: RRM_1 Pfam Desc: RNA recognition motif. (a.k.a. RRM, RBD, or RNP domain)
  misc_feature (95)..(159): Pfam Id: RRM_1 Pfam Desc: RNA recognition motif. (a.k.a. RRM, RBD, or RNP domain)
  misc_feature (1)..(238): NCBI GI: 47680367 NCBI Desc: arginine/serine-rich splicing factor 1 [zea mays]
  misc_feature (1)..(238): NCBI GI: 47680373 NCBI Desc: arginine/serine-rich splicing factor 2 [zea mays]
  misc_feature (1)..(238): NCBI GI: 38344865 NCBI Desc: osjnba0020p07.8 [oryza sativa (japonica cultivar-group)]
  misc_feature (1)..(238): NCBI GI: 116317923 NCBI Desc: h0716a07.4 [oryza sativa (indica cultivar-group)]
  misc_feature (1)..(197): NCBI GI: 47680375 NCBI Desc: arginine/serine-rich splicing factor 2 variant 2 [zea mays]
  misc_feature: Useful for making plants with modulated biomass
  misc_feature: Functional homolog of the protein sequence given in SEQ ID NO 12876
  misc_feature: The sequence is a functional homolog of SEQ ID NO. 339 in the 11/188,298 US application
MRPVFVGNLDYDTRHSELDQLFYRYGRVERIDMKSGFAFVYFEDERDGNDAIRALDGYPFGPGRRRLSVEWSRGDRAARRDGNKPEANTKPTRTLFVINFDPINTRVSDIERHFAPFGNLSSVRIRKNFAFVQFETLEEARKALDATHATTLLDRVISVEYAFRDDSERSDRYDSPRRGGGYGRRGDSPVYRSRPSPDYGRPASPVYGSYDRSPVRDRYRRSPAYRSRSPRVNRRAYD

SEQ ID NO: 11217 - DNA, 1296 bp, Sorghum bicolor
  misc_feature: Ceres ANNOT ID no. 6122268
  misc_feature: Encodes the peptide sequence at SEQ ID NO 11218
  misc_feature: Down-regulated in root tissues in response to salicylic acid treatment
  misc_feature: Up-regulated in shoot tissues in response to methyl jasmonate treatment
  misc_feature: Down-regulated in shoot tissues in response to salicylic acid treatment
atggcggccgcgtccttcaccgccgccaagttcctggtgccggtggccgcgagatccggcggcgagagggcgcccccgcttccccccgtcggagcctcctcctcctccttcgccaggaccctgcgccgcggcggcggggcgcaccaccacccgcgcctccgcaccgcgctcgccgtctcctctgacctggtcgcgggcaacaaggccgcgcaggccgccgccacgcatccggctgttacacgggaagaggcactggaggtgtatgaggacatggttcttggtcgtgtatttgaggacatgtgtgcacaaatgtactaccgtggcaagatgtttggattcgtccacctttacaacggccaggaggctgtctccaccggcttcatcaagcttctgaaccaagctgactgtgttgttagcacgtatcgtgatcacgtccatgcgctgtccaagggtgtcccgccacgtaatgtcatggctgagctctttggcaaggccacaggctgctgccgtggacagggtggttccatgcacatgttctctgctccccacaacctccttggaggctttgccttcatcggagagggcatccctgttgccactggtgcagcctttgcagctaagtaccgtcatgaggtgctcaaggagtccggccctgatgggcttgatgtcacattggcgttctttggtgatggtacctgtaacaatggccagttctttgagtgcctgaacatggcacagctttggaagctacctattgtgtttgttgtggagaacaacctgtgggcaattggaatgtcgcaccttagggctacatcggacccagagatttggaagaaggggccatcatttggaatgcctggggtgcatgttgatggtatggatgtcctgaaggtcagggaggttgctaaggaggcaattgagagggcaaggagaggtgaagggccaaccctagttgagtgtgaaacctacaggttccgaggtcactcccttgcagaccctgatgagctcaggaagcctgatgagaaaacgcactatgctgcaagggatcctattacggccttgaagaagtacatcatcgaggagaaccttgccacggaatctgagctgaagagcattgaaaagaagattgatgatgttgttgaggaggctgttgagtttgctgacgcaagcccgcatccaccacggagccagctgttggaaaacgtgtttgctgaccccaagggctttggtatcggccctgatggaaagtacagatgtgaggatcccaagttcacccaaggcacagctcaagtttaa

SEQ ID NO: 11218 - protein, 431 aa, Sorghum bicolor
  misc_feature: Ceres ANNOT ID no. 6122268
  misc_feature (89)..(396): Pfam Id: E1_dh Pfam Desc: Dehydrogenase E1 component
  misc_feature (165)..(320): Pfam Id: TPP_enzyme_C Pfam Desc: Thiamine pyrophosphate enzyme, C-terminal TPP binding domain
  misc_feature (3)..(431): NCBI GI: 116317926 NCBI Desc: h0716a07.7 [oryza sativa (indica cultivar-group)]
  misc_feature (3)..(431): NCBI GI: 2454182 NCBI Desc: pyruvate dehydrogenase e1 alpha subunit [arabidopsis thaliana]
  misc_feature (3)..(420): NCBI GI: 6715645 NCBI Desc: t25k16.8 [arabidopsis thaliana]
  misc_feature (74)..(407): NCBI GI: 119492641 NCBI Desc: dehydrogenase, e1 component [lyngbya sp. pcc 8106]
  misc_feature (74)..(405): NCBI GI: 81300753 NCBI Desc: pyruvate dehydrogenase (lipoamide) [synechococcus elongatus pcc 7942]
  misc_feature (79)..(405): SWISSPROT Homolog: EC 1.2.4.1 Pyruvate dehydrogenase E1 component subunit alpha
  misc_feature: Down-regulated in root tissues in response to salicylic acid treatment
  misc_feature: Up-regulated in shoot tissues in response to methyl jasmonate treatment
  misc_feature: Down-regulated in shoot tissues in response to salicylic acid treatment
  misc_feature: The sequence is a functional homolog of SEQ ID NO. 476 in the 11/188,298 US application
  misc_feature: The sequence is a functional homolog of SEQ ID NO. 531 in the 11/188,298 US application
MAAASFTAAKFLVPVAARSGGERAPPLPPVGASSSSFARTLRRGGGAHHHPRLRTALAVSSDLVAGNKAAQAAATHPAVTREEALEVYEDMVLGRVFEDMCAQMYYRGKMFGFVHLYNGQEAVSTGFIKLLNQADCVVSTYRDHVHALSKGVPPRNVMAELFGKATGCCRGQGGSMHMFSAPHNLLGGFAFIGEGIPVATGAAFAAKYRHEVLKESGPDGLDVTLAFFGDGTCNNGQFFECLNMAQLWKLPIVFVVENNLWAIGMSHLRATSDPEIWKKGPSFGMPGVHVDGMDVLKVREVAKEAIERARRGEGPTLVECETYRFRGHSLADPDELRKPDEKTHYAARDPITALKKYIIEENLATESELKSIEKKIDDVVEEAVEFADASPHPPRSQLLENVFADPKGFGIGPDGKYRCEDPKFTQGTAQV

SEQ ID NO: 11219 - DNA, 1335 bp, Sorghum bicolor
  misc_feature: Ceres ANNOT ID no. 6122269
  misc_feature: Encodes the peptide sequence at SEQ ID NO 11220
  misc_feature: Down-regulated in root tissues in response to salicylic acid treatment
atgtcggctctcctcgatctattgatggggatcctccggcagcagaccatcggcggcgccgcgctggagctcgccgcgatagcggcgccgctgtggctcgccgcgctcgtcggcctcctcatcggctgggcgtggcgcccgaggtgggcgggggtcgtcgtcggcgtcggcggcggcggcggcgacaacaacgcacagcaccaggcggcggcgcacctcctccctacgccgccccctcctcctccggcgcgcgccaccgccaccgcggtggtctctcgcaacgaggcgcccgctgtcgtcccgaggactgtggtggctcctgcggcggcggcgcccgaggacgagcagctggcggtcaacaccggcgacttgatgcacctctggcggctcgtcgaggagaaggacggtggtccgtcgtggattcacatgatggatcgcaccttgcccaccatgagataccaagcctggcggagagacccaccgaatggtccgccacagtatcgcagtagcactatctttgaggatgcgtcaccagaggttgtgagagatttcttctgggacgatgagttccggattaagaacagctgggatgacatgcttcttcagcacgagacactggaggaatgcaccaggactggaaccttggttgtccggtgggtcaggaagttcccattcttctgcagcgacagggagtacatcataggtcgcaggatatgggcatctggaaagacgttttactgtgtcaccaagggtgtgcctcgaccctctgttccaagacataacaaacctcgacgtgtggacttatactactctagctggtgcatccgtccagttgaatcaaggaaaggcgatggttcaatgactgcatgtgaggtgctcttattccatcacgaagatatggggattccatgggagattgcaaagcttggtgtccggcaggggatgtggggctgcgtcaaaaggatagagcctggccttcgggcataccaagttgcaaggaccgctggagagcctatttcgaaatgtgctgccatggcacatgtcaccaccaggttcaatgcggatgagctcattacagaagagaacacagagggcagttcatccaacaacacagaggtcgagaagccaaagcactggacaaacaatatacccaaggttctcatgataggcggtgccgtcgccctggcttgcacctttgacggtggattgttgaccaaggccgtcatattcggcacggcgagaaggtttgcagggccaggagggccaggaaggcggaaggaaatcaagcaccaaaacattacatacatttatgctaacttgagtcatactgcataa

SEQ ID NO: 11220 - protein, 444 aa, Sorghum bicolor
  misc_feature: Ceres ANNOT ID no. 6122269
  misc_feature (37)..(420): NCBI GI: 116317927 NCBI Desc: h0716a07.8 [oryza sativa (indica cultivar-group)]
  misc_feature (47)..(420): NCBI GI: 46798907 NCBI Desc: membrane related protein [oryza sativa (japonica cultivar-group)]
  misc_feature (105)..(420): NCBI GI: 4741929 NCBI Desc: membrane related protein cp5 [arabidopsis thaliana]
  misc_feature (97)..(427): NCBI GI: 10178166 NCBI Desc: membrane related protein-like [arabidopsis thaliana]
  misc_feature (123)..(427): NCBI GI: 21593272 NCBI Desc: membrane related protein-like [arabidopsis thaliana]
  misc_feature: Down-regulated in root tissues in response to salicylic acid treatment
MSALLDLLMGILRQQTIGGAALELAAIAAPLWLAALVGLLIGWAWRPRWAGVVVGVGGGGGDNNAQHQAAAHLLPTPPPPPPARATATAVVSRNEAPAVVPRTVVAPAAAAPEDEQLAVNTGDLMHLWRLVEEKDGGPSWIHMMDRTLPTMRYQAWRRDPPNGPPQYRSSTIFEDASPEVVRDFFWDDEFRIKNSWDDMLLQHETLEECTRTGTLVVRWVRKFPFFCSDREYIIGRRIWASGKTFYCVTKGVPRPSVPRHNKPRRVDLYYSSWCIRPVESRKGDGSMTACEVLLFHHEDMGIPWEIAKLGVRQGMWGCVKRIEPGLRAYQVARTAGEPISKCAAMAHVTTRFNADELITEENTEGSSSNNTEVEKPKHWTNNIPKVLMIGGAVALACTFDGGLLTKAVIFGTARRFAGPGGPGRRKEIKHQNITYIYANLSHTA

SEQ ID NO: 11221 - DNA, 936 bp, Sorghum bicolor
  misc_feature: Ceres ANNOT ID no. 6122300
  misc_feature: Encodes the peptide sequence at SEQ ID NO 11222
atggccatgcatcccggcgccggcgccggcgccggtgcgccccccgtgtcgtcggtccacggcaacgttgatgagtacgacgacttccactgggacgacgcggccgaggcagagcttcaggccatcgaggccgcctacgcctcggcttccgccgccgcaaagcgccgccgcctacccgactggacctctccatccccttcgccctcctctcgcccccggtacagccaaagcccggtgtccggtggatccacgccgttgtgggccctcacgccgcacacaccccaaggtaatgtgagggcaagacgccaacaaatatcattcaacggtaagatagtttactgcaggacaccttcagaggcggagaaagctgcaactgacatcttactcaaaattgagaggatgaaagccccccgccaggtttctcttgggtttgatctcgagtggaggccctttccaagaagaggggaaccaccttgtaaggttgctgtaatgcagctatgcatggagaaaactctgtgctatgtcctgcatattgctcactcgggggtaccacctatactgaaaactcttttggaggatagttcgtccattaaagttggaatatgcatagacaatgatgcaaggaaaatgttgaatgactatgatgtctgtgtgcaaccactgatggatttgtcaaccctggcaaatgtaaagttagctactcctcccaaaagatggagtcttgcttctttaactgaaatgatcacatgcaaagagctgccgaagccgagcaacataagaatggggaactgggaggttgatgttctcaccaaacaacaacttcaatatgctgctacagatgcttatatctcatggtacttgtatgaggcactgcagactcttccagattatactactgaagctgaagctgagtctgagtctgtaaaggcacaataa

SEQ ID NO: 11222 - protein, 311 aa, Sorghum bicolor
  misc_feature: Ceres ANNOT ID no. 6122300
  misc_feature (115)..(296): Pfam Id: 3_5_exonuc Pfam Desc: 3'-5' exonuclease
  misc_feature (11)..(305): NCBI GI: 38346519 NCBI Desc: osjnba0027h09.14 [oryza sativa (japonica cultivar-group)]
  misc_feature (11)..(305): NCBI GI: 116317897 NCBI Desc: osigba0131j24.2 [oryza sativa (indica cultivar-group)]
  misc_feature (35)..(306): NCBI GI: 92889199 NCBI Desc: 3-5 exonuclease [medicago truncatula]
  misc_feature (30)..(296): NCBI GI: 38603882 NCBI Desc: at4g13870 [arabidopsis thaliana]
  misc_feature (30)..(296): NCBI GI: 11121455 NCBI Desc: exonuclease [arabidopsis thaliana]
MAMHPGAGAGAGAPPVSSVHGNVDEYDDFHWDDAAEAELQAIEAAYASASAAAKRRRLPDWTSPSPSPSSRPRYSQSPVSGGSTPLWALTPHTPQGNVRARRQQISFNGKIVYCRTPSEAEKAATDILLKIERMKAPRQVSLGFDLEWRPFPRRGEPPCKVAVMQLCMEKTLCYVLHIAHSGVPPILKTLLEDSSSIKVGICIDNDARKMLNDYDVCVQPLMDLSTLANVKLATPPKRWSLASLTEMITCKELPKPSNIRMGNWEVDVLTKQQLQYAATDAYISWYLYEALQTLPDYTTEAEAESESVKAQ

SEQ ID NO: 11223 - DNA, 1149 bp, Sorghum bicolor
  misc_feature: Ceres ANNOT ID no. 6122302
  misc_feature: Encodes the peptide sequence at SEQ ID NO 11224
atggcaaatgcaaagaagttgttcaagatgggaaatgcagatacagatactgctgcactgcacaaggagtgggatgatgttctctgtccgatatgcatggaccatccgcacaatgctgtccttctgttgtgcagttcccatgacaaaggatgccgatcctatatatgtgatacaagctataggcattcaaattgcctagacaggttcaagaaaatgaaagtcaatgatggggacagtccttcagagtcaagctcgtccatgcctaggggtacaagaaaccaaaatgttgtccagagatctcgttttggtctcactggagagagccccaggctacacatagacatatctgaacctgatgaagcttccaatcatcaagatgccagtcatagacctgctgccattgctggagaacaggaagaaaacaactacaatgaaggcccaaatttgacattggaagctcatgaggttgagatgaatggcccttcagagtcaagtgacgtgtcaagcttaaaccaattgttgtgtccactgtgcagagggggcgttagtggctggaagataatcaaagaagctagacagtatttggatgagaaatccagagcttgctcacgagaagcctgcacgttttctggtaactacagggagatccgtagacatgccagaagggtgcaccccacaacaaggcctgctgatgttgatccatcaagacgccgtgcgtggcaccacctggagcatcagcgtgaatatgctgacatagtaagcgcaatcaggtctgctatgcctggggcagttgtgcttggtgattatgctattgaaggtggtgaaatgttttcacatgaccgggaaaccagtggcccaagtgaaccaagtgggtctcttctgacaacattctttctatttcatatgctcagcagtagtccgattagatcaggtgatgagccaagaggcgcatcaaggggcctgagaaggcagagaagacgctatctgtggggagagaatttgttaggtctccaatatgatgatgataatgataatgatgatgatgatgatgatgagggggaggacgaaggggatgctgtggatgaagaagttcagagaccaaggagtcgccggaggttcataagatcaagatcagaggagcgggcgtaa

SEQ ID NO: 11224 - protein, 382 aa, Sorghum bicolor
  misc_feature: Ceres ANNOT ID no. 6122302
  misc_feature (1)..(382): NCBI GI: 116317899 NCBI Desc: osigba0131j24.4 [oryza sativa (indica cultivar-group)]
  misc_feature (1)..(382): NCBI GI: 38346521 NCBI Desc: osjnba0027h09.16 [oryza sativa (japonica cultivar-group)]
  misc_feature (161)..(381): NCBI GI: 82568695 NCBI Desc: pm27 [prunus mume]
  misc_feature (163)..(356): NCBI GI: 115438510 NCBI Desc: os01g0612600 [oryza sativa (japonica cultivar-group)]
  misc_feature (109)..(367): NCBI GI: 92895183 NCBI Desc: traf-like [medicago truncatula]
MANAKKLFKMGNADTDTAALHKEWDDVLCPICMDHPHNAVLLLCSSHDKGCRSYICDTSYRHSNCLDRFKKMKVNDGDSPSESSSSMPRGTRNQNVVQRSRFGLTGESPRLHIDISEPDEASNHQDASHRPAAIAGEQEENNYNEGPNLTLEAHEVEMNGPSESSDVSSLNQLLCPLCRGGVSGWKIIKEARQYLDEKSRACSREACTFSGNYREIRRHARRVHPTTRPADVDPSRRRAWHHLEHQREYADIVSAIRSAMPGAVVLGDYAIEGGEMFSHDRETSGPSEPSGSLLTTFFLFHMLSSSPIRSGDEPRGASRGLRRQRRRYLWGENLLGLQYDDDNDNDDDDDDEGEDEGDAVDEEVQRPRSRRRFIRSRSEERA

SEQ ID NO: 11225 - DNA, 3039 bp, Sorghum bicolor
  misc_feature: Ceres ANNOT ID no. 6122304
  misc_feature: Encodes the peptide sequence at SEQ ID NO 11226
atgcagccgccgatggggaacgagaggccgccgccgccgcccggccgccctgtctcagccttcgtgcccggcgcagctgtcccgcctccaccgtttggggccgcggccggtggcccgttcgccccgccgccgcggcagggagtgctgccgcctcctcagtctggtgctacggcgcccccttttggggctgcgccacccgccgcaatgggtgggttcagaggtccaccgccgtcacagggaccctttggagccggtccaccgccgtcacagggaccctttggagctggtccaccgcctcagggccctttcacctccgcaccgccgtcgcaaggtccctttgcctctgctccaccgtctcagggcccctttgcctctgctccaccgtctcagggcccctttacgtcccctccaccgtctcagggtccctttgctgctggaccaccgccgactggtccctttgctgctgcaccagcaccttttcgccctccgccgtcctcccttgcgcagccgcaatctcccacgggaggtcctttgcctccgccaccgacatatgcgaggccgccacagacgcaagggtattacaccggtgcaccacccgcgaaccctcagttcccgatgtcaaggccagcatttcaacaaccagtgcagactatgcctcctccaccaatgggacctgctgccacgtttggtaaccaggcagcgtatgctggccctccagtcggaggcacacttcagagcttagtggaggacttccagtcgttagcactgagttctgcgcctgggtcacttgaccctggtgttgatgtaaaagggctgccaaggcctttggatggtgatgaggagccagttaagcttatggaggcatacccattgaattgccacccgaggtacttccggctgacaacccatgcgatccctgcatctcagtcattggtctccaggtggcatttgcctcttggagctgtggtacaccctcttgcagaatcacctgatggggaggaagtgccagttatcaactttgggtccgccggtgtcattcgttgtcgaagatgcaggacgtacataaatccttatgcaacatttgcagatgctggaaggaaatggcgctgcaatctttgcacgttgctcaatgacgttcctggagagtacttttgtgcacttgatgctagtggcagaaggtatgatactgatcaaaggcctgaactttccaagggaactgtagagtttgttgctccaacagaatatatggtgcggccaccaatgccgccttcctatttctttcttattgatgtgtcagtatctgcagttcggagcggattgcttgaggttgttgcaaagaccatcaaatcatgcctcgatgaacttccaggctttccgcgaacacagattggattcttaaccttcgacagcaccttgcattttcataacttcaagtcttctttgtcacagcctcaaatgatggtggttgctgatttggatgatgtttttctaccattgcctgatgacctcttggttaatttggtcgactcaagacatgttgtggagtcatttcttgatagcttgccaaatatgtttcatgacaatgtaaatgtggagtctgctcttggtccagcacttaaagcagctttcatggttatgagtcaaattggggggaagttgcttgtcttccagagtactttgccatctcttggtattggtcgtttgagacttcgaggagatgatgttcgtgcatatggaacggataaggagcatactttgagggtaccagaagatcccttctacaaacagatggctgctgaattcacaaaaaatcagatcgcagtggacatattttctttcagcgagaagtactctgatatagcttctttggggtctttggcaaagtatactggtggtcaggtgtaccattatccatcattccaggcacctacacatggagacaaacttaaacttgagcttaatagggaccttacacgagagactgcctgggaatctgttatgcgtatcagatgtggaaaaggagtacggttcacaacctatcatggtcatttcatgcttcggtccacagacctgttagcccttccagctgttgactctgataaagcttttgcaatgcaactgtcgctggaggagacattaatgaccacccagactgtatacttccaagtggcattatacacatcatcctctggtgaaaggcgtatcagggtccacacagcagctgcacctgtggtcacagatcttagtgaaatgtatcgtcaagcagatactggtgccattgtgtcattgttgggtagaattgcggttgaaaattcactgtctgataagctggacagtgtccggcagcagttacagttaaagctcgtcagaagtctgaaggaataccgcaatttatatgttgtacaacaccggataggcgggagactgatttttcccgaatctctaaggtttttgccattatacatcctggctatctgcaaatctcttgctctccgtggaggttatgcagatgtttctcttgatgaacgatgtgctgctggtttcagcatgatgatattgcctgtaaacaggctgctcaattttatctatccttctctgtacagagttgatgaagtattaacaatggaaccaaataagattgatgcttcattgaagcgattgccattaacatttcagtgtttagatactggaggtttgtacctccttgatgatggcttcactttcttagtgtggttaggtaggatgctcccacctgaactcatgaacaacattcttggagtgagcttggcaaactaccctgacctatctaaggttttattgagagagtgtgacaatgagttgtcaagaaatttcatgaaaatactaagaaccctgcgggagaaggatccttcttatcaccagctatgccgtgtggtgcgacagggtgaacagccaagagaaggctatctgcttctatctaaccttgttgaggaccagatggctggaacaagcagttacgttgattggatactgcaaattcaccgtcaaacacaaagctaa

SEQ ID NO: 11226 - protein, 1012 aa, Sorghum bicolor
  misc_feature: Ceres ANNOT ID no. 6122304
  misc_feature (420)..(657): Pfam Id: Sec23_trunk Pfam Desc: Sec23/Sec24 trunk domain
  misc_feature (662)..(745): Pfam Id: Sec23_BS Pfam Desc: Sec23/Sec24 beta-sandwich domain
  misc_feature (757)..(862): Pfam Id: Sec23_helical Pfam Desc: Sec23/Sec24 helical domain
  misc_feature (344)..(383): Pfam Id: zf-Sec23_Sec24 Pfam Desc: Sec23/Sec24 zinc finger
  misc_feature (2)..(1012): NCBI GI: 115456982 NCBI Desc: os04g0129500 [oryza sativa (japonica cultivar-group)]
  misc_feature (2)..(1012): NCBI GI: 116317900 NCBI Desc: osigba0131j24.5 [oryza sativa (indica cultivar-group)]
  misc_feature (2)..(1012): NCBI GI: 38346522 NCBI Desc: osjnba0027h09.17 [oryza sativa (japonica cultivar-group)]
  misc_feature (4)..(1011): NCBI GI: 18407762 NCBI Desc: sec23/sec24 transport family protein [arabidopsis thaliana]
  misc_feature (12)..(1009): NCBI GI: 133777673 NCBI Desc: sec24a protein [mus musculus]
MQPPMGNERPPPPPGRPVSAFVPGAAVPPPPFGAAAGGPFAPPPRQGVLPPPQSGATAPPFGAAPPAAMGGFRGPPPSQGPFGAGPPPSQGPFGAGPPPQGPFTSAPPSQGPFASAPPSQGPFASAPPSQGPFTSPPPSQGPFAAGPPPTGPFAAAPAPFRPPPSSLAQPQSPTGGPLPPPPTYARPPQTQGYYTGAPPANPQFPMSRPAFQQPVQTMPPPPMGPAATFGNQAAYAGPPVGGTLQSLVEDFQSLALSSAPGSLDPGVDVKGLPRPLDGDEEPVKLMEAYPLNCHPRYFRLTTHAIPASQSLVSRWHLPLGAVVHPLAESPDGEEVPVINFGSAGVIRCRRCRTYINPYATFADAGRKWRCNLCTLLNDVPGEYFCALDASGRRYDTDQRPELSKGTVEFVAPTEYMVRPPMPPSYFFLIDVSVSAVRSGLLEVVAKTIKSCLDELPGFPRTQIGFLTFDSTLHFHNFKSSLSQPQMMVVADLDDVFLPLPDDLLVNLVDSRHVVESFLDSLPNMFHDNVNVESALGPALKAAFMVMSQIGGKLLVFQSTLPSLGIGRLRLRGDDVRAYGTDKEHTLRVPEDPFYKQMAAEFTKNQIAVDIFSFSEKYSDIASLGSLAKYTGGQVYHYPSFQAPTHGDKLKLELNRDLTRETAWESVMRIRCGKGVRFTTYHGHFMLRSTDLLALPAVDSDKAFAMQLSLEETLMTTQTVYFQVALYTSSSGERRIRVHTAAAPVVTDLSEMYRQADTGAIVSLLGRIAVENSLSDKLDSVRQQLQLKLVRSLKEYRNLYVVQHRIGGRLIFPESLRFLPLYILAICKSLALRGGYADVSLDERCAAGFSMMILPVNRLLNFIYPSLYRVDEVLTMEPNKIDASLKRLPLTFQCLDTGGLYLLDDGFTFLVWLGRMLPPELMNNILGVSLANYPDLSKVLLRECDNELSRNFMKILRTLREKDPSYHQLCRVVRQGEQPREGYLLLSNLVEDQMAGTSSYVDWILQIHRQTQS

SEQ ID NO: 11227 - DNA, 1338 bp, Sorghum bicolor
  misc_feature: Ceres ANNOT ID no. 6122307
  misc_feature: Encodes the peptide sequence at SEQ ID NO 11228
atggcaaaacaagatggtaatgacaaaagactttcaggatattgttccaaggaccacgtggtgaagcccccggcttcagacatgatgtccgtcgcttgcgctcggctcacaccggcagcttctgtctttccagcagcagtgtcagactactatcaatttgacgaacttctgacaccagaggagaaaaatttacgaatcaatattaggcagtttatggagaaggaagttgctccaatagtacccaaggtcgtattgcacttagtccattggctttactgggagacagcacaatttccattccatctcattccaaagctaggttctcttggtttccttggaggcatcatcaagggccacggatgtcctgggttatcagagaccgcttatgctgtgtgcatatcagaggttgctcgtgtggatgcaagcatagcctcattctgcttggttcagtcatgtcttgccatgctttgtattgcacaaatgggatctgaagcacagaaagagaaatatttgccgttattgagcaaacagcagaaagtctgtgcttatgccttgacagagccggactatggtagtgatgcaagctctctgaacactgtggcgagaaaggttccaggagggtgggtcctaaatggtaggaaacggtggcctgggaacagcagttttgcagacgtattagttgttcttgctcggaataccagcaccaatcaggtcaatgggttcatagtgaatggagggagctctggtctgaagatcaacaagatcgagaacaaggtgtcgatgagaatggttcagaactgtgacatccagctggacgacgtgtttgttcccgatgacgatcgtttgcccggcgccaattcttttcaggatcttgttgattcgctttctttcagtcgggtcatggcagcctgggtcagcattgggattgcagaaggggtgtacgatgcatgtcataggtaccttggagagaggaaacagtttggtgtgccactggcgacgttccagctgaaccaagagaagctggtcaggatgttgggcaacatccaggccatgtggcttctcggctggcgcctctgcaagctccatgcctctggcaacatcaccacaggccacgctagcctgggcaaggcatggatcacgaagcaggcaagggagacggtggcgctcggcagggagctcctcggcggcaacggcatcgtcaccgatttccacgtgggcaaggcgttgtgtgacatggagactgtgtacacgtacgagggcagctacgatgtgaacgcgctcatcgtcgcaagggagatcactggcatctccagcatcagacccactagcaggctctag

SEQ ID NO: 11228 - protein, 445 aa, Sorghum bicolor
  misc_feature: Ceres ANNOT ID no. 6122307
  misc_feature (288)..(434): Pfam Id: Acyl-CoA_dh_1 Pfam Desc: Acyl-CoA dehydrogenase, C-terminal domain
  misc_feature (182)..(234): Pfam Id: Acyl-CoA_dh_M Pfam Desc: Acyl-CoA dehydrogenase, middle domain
  misc_feature (58)..(178): Pfam Id: Acyl-CoA_dh_N Pfam Desc: Acyl-CoA dehydrogenase, N-terminal domain
  misc_feature (23)..(444): NCBI GI: 114794826 NCBI Desc: chain a, short chain specific acyl-coa oxidase from arabidopsis thaliana, acx4
  misc_feature (204)..(445): NCBI GI: 115467966 NCBI Desc: os06g0347100 [oryza sativa (japonica cultivar-group)]
  misc_feature (49)..(438): NCBI GI: 76260706 NCBI Desc: acyl-coa dehydrogenase, c-terminal:acyl-coa dehydrogenase, central region:acyl-coa dehydrogenase, n-terminal:acyl-coa dehydrogenase, n-terminal [chloroflexus
  misc_feature (49)..(438): NCBI GI: 76260706 (continued) aurantiacus j-10-fl]
  misc_feature (49)..(438): NCBI GI: 118046098 NCBI Desc: acyl-coa dehydrogenase-like [chloroflexus aggregans dsm 9485]
  misc_feature (49)..(436): NCBI GI: 113940286 NCBI Desc: acyl-coa dehydrogenase-like [herpetosiphon aurantiacus atcc 23779]
  misc_feature (23)..(444): SWISSPROT Homolog: EC 1.3.3.6 Acyl-coenzyme A oxidase 4, peroxisomal
MAKQDGNDKRLSGYCSKDHVVKPPASDMMSVACARLTPAASVFPAAVSDYYQFDELLTPEEKNLRINIRQFMEKEVAPIVPKVVLHLVHWLYWETAQFPFHLIPKLGSLGFLGGIIKGHGCPGLSETAYAVCISEVARVDASIASFCLVQSCLAMLCIAQMGSEAQKEKYLPLLSKQQKVCAYALTEPDYGSDASSLNTVARKVPGGWVLNGRKRWPGNSSFADVLVVLARNTSTNQVNGFIVNGGSSGLKINKIENKVSMRMVQNCDIQLDDVFVPDDDRLPGANSFQDLVDSLSFSRVMAAWVSIGIAEGVYDACHRYLGERKQFGVPLATFQLNQEKLVRMLGNIQAMWLLGWRLCKLHASGNITTGHASLGKAWITKQARETVALGRELLGGNGIVTDFHVGKALCDMETVYTYEGSYDVNALIVAREITGISSIRPTSRL

SEQ ID NO: 11229 - DNA, 354 bp, Sorghum bicolor
  misc_feature: Ceres ANNOT ID no. 6122309
  misc_feature: Encodes the peptide sequence at SEQ ID NO 11230
atggagaagtgtaacagcaatgctcgatttgcacccttgagtgatactccatttgctctccgtggagctcttggtagtactagttcaaatcttgagcaaaccaggggctacgcatcttcccccctagcagctcagcggcccaagatatctgcacctggaagccgacccctgcacacaagtcgccccctgtcatctcctgttgcaaaccgcccactgtcaccccaccttcctctgaagaagccgcagttcagcgctactttctctatctcgcaccgaattttcggtgtcgcattgggagttgccatcatatctgtccctctcgccaccaagttcagcctgatgtttggtgtttga

SEQ ID NO: 11230 - protein, 117 aa, Sorghum bicolor
  misc_feature: Ceres ANNOT ID no. 6122309
  misc_feature (1)..(117): NCBI GI: 41052751 NCBI Desc: succinate dehydrogenase subunit 3 [oryza sativa (japonica cultivar-group)]
  misc_feature (1)..(117): NCBI GI: 14861488 NCBI Desc: succinate dehydrogenase subunit 3 [oryza sativa]
  misc_feature (1)..(117): NCBI GI: 14861490 NCBI Desc: succinate dehydrogenase subunit 3 [oryza sativa]
  misc_feature (1)..(117): NCBI GI: 32400816 NCBI Desc: succinate dehydrogenase subunit 3 [triticum aestivum]
  misc_feature (40)..(115): NCBI GI: 14861484 NCBI Desc: succinate dehydrogenase subunit 3 [gossypium hirsutum]
  misc_feature: The sequence is a functional homolog of SEQ ID NO. 289 in the 11/188,298 US application
MEKCNSNARFAPLSDTPFALRGALGSTSSNLEQTRGYASSPLAAQRPKISAPGSRPLHTSRPLSSPVANRPLSPHLPLKKPQFSATFSISHRIFGVALGVAIISVPLATKFSLMFGV

SEQ ID NO: 11231 - DNA, 1233 bp, Sorghum bicolor
  misc_feature: Ceres ANNOT ID no. 6122312
  misc_feature: Encodes the peptide sequence at SEQ ID NO 11232
atggcgagcggcggcggcggcgctgcggcgcggatggacccggaggcggcaacggagctggtgcggaagggtgccaccctcctcctcctcgacgtcccccagcgcaccctcttcggaatcgacacccagatgttctctgttggccccaagttcaaagggatgaagatggtgcccccggggccccatttcgtctactactgctccccaaacaggcatgggaatgagtttgcacctactgtcggattctttcttactacacacccatctgaggtgattgttcgaaagtgggatgtgcaagaggaacggctaatcaaattgtcagaagaagaggatatcagatactcagaagctgtaagacgttttgaatttgatgatcagcttggaccatacaatttggattcttatggagattggaaacaactttcaaactacttgtcaccgaatgtcattgagcgtcttgaaccaatcggaggagaaatcacaattgcgtgggagtcatcatggatagatagagccccccaaagtgacatggagagacgtttggtcgaacaactaagagaaggaaagtttgcaaagaatgctcctgtgcagtctgagcggagaggatgctactacacaagtatccctgcttcaattaagcataaggacatctctgggggtgacttgacggccctgaacttggacaaaacaagtttgctggagattgttttggccaaaaattatgacggtcaagaagatctgttgttgggggagcttcagttcgctttcatagcttttatgatgggtcagtcactggaggcttttatgcagtggaaagcactagtcagtcttcttttgagctgcagtgaagctccccttcatacaaggactaacatgtttataaagtttataaggacattatactatcaactcaagcatggctttcaacatacccaagattccaaaagtggggatatgggcgattctctgtgtttggatgaagcatggttttcaagagacatattcctgtaccgtctttccaaggatttctttacggttgtacttgaagccccagtcgtggatggagaccttctgtcatgggttggcattcctgaactgatacttccacatgctagaaaactaaaatcgcttctggagactacatttgggtgggatcttgaggacaacgcagtgaaccttattgatgaagatgatgagtttgctcctgtggttgtggaaatggatggatcatag

SEQ ID NO: 11232 - protein, 410 aa, Sorghum bicolor
  misc_feature: Ceres ANNOT ID no. 6122312
  misc_feature (12)..(388): Pfam Id: AAR2 Pfam Desc: AAR2 protein
  misc_feature (3)..(410): NCBI GI: 115456990 NCBI Desc: os04g0132300 [oryza sativa (japonica cultivar-group)]
  misc_feature (3)..(360): NCBI GI: 38346780 NCBI Desc: osjnba0095h06.5 [oryza sativa (japonica cultivar-group)]
  misc_feature (12)..(408): NCBI GI: 92875601 NCBI Desc: aar2 [medicago truncatula]
  misc_feature (12)..(350): NCBI GI: 7657874 NCBI Desc: cepp protein [brassica napus var. napus]
  misc_feature (56)..(410): NCBI GI: 30697362 NCBI Desc: aar2 protein family [arabidopsis thaliana]
MASGGGGAAARMDPEAATELVRKGATLLLLDVPQRTLFGIDTQMFSVGPKFKGMKMVPPGPHFVYYCSPNRHGNEFAPTVGFFLTTHPSEVIVRKWDVQEERLIKLSEEEDIRYSEAVRRFEFDDQLGPYNLDSYGDWKQLSNYLSPNVIERLEPIGGEITIAWESSWIDRAPQSDMERRLVEQLREGKFAKNAPVQSERRGCYYTSIPASIKHKDISGGDLTALNLDKTSLLEIVLAKNYDGQEDLLLGELQFAFIAFMMGQSLEAFMQWKALVSLLLSCSEAPLHTRTNMFIKFIRTLYYQLKHGFQHTQDSKSGDMGDSLCLDEAWFSRDIFLYRLSKDFFTVVLEAPVVDGDLLSWVGIPELILPHARKLKSLLETTFGWDLEDNAVNLIDEDDEFAPVVVEMDGS

SEQ ID NO: 11233 - DNA, 1239 bp, Sorghum bicolor
  misc_feature: Ceres ANNOT ID no. 6122315
  misc_feature: Encodes the peptide sequence at SEQ ID NO 11234
atggcttgggaactcattgaggtcccgggcaacctgaatccctctctccaagactctactgttgatgtgctggccaccaagattgatcccaagctagccaatactcttattaggcagttaagccaggtatgccctttggagaatctgaggcatgtaaagcgtgtacgtcgacgtactgaatgtggcggaaaatctgagctatcaataatcctatgtgtttctactgggtctgaaccttgtagcatacagttttctgaagatctacaaaagatagtggatacttatcagctgagtccttttactgcgaaagttgccaagtattgtgctacatcaaaagaggagtgggaggaacaatgcaaactttggccaacatcttaccatcctgcacatgaccttgatattgtccgtggatttcaagaggaggaattaccatcaatatttaattgcatgaagactgctattcagttatcaaaggcgggcaatgctgcaatcattattgatccatcaagcatgcaaataattgcaaaggccaccgaccagacacacaagcatgatacgcctgaagaagggaacacattttctgaagcgaatgcagatgtgacctgctctttgaatgcatcaactgataatgactgcaatttgtcactgccaggatcctttctttctaaacgcaacagcttgaacatggaaatctcatgtataaatccttggggatggatgagaaaaaggacttgtgaacagaagccattgccctgtgatggctgttttgcatggcatcctctgagacatgctcccatggttgccattgaaaatgctgctgagagggatagaacgatgttcccgtcttcgacttcaataaccaagccagattcaaatggcaatccagagaactgttgtgataatgaaccagcaaaaaggctaaagacggatacaaaagataatgagcaatcgtcatctgaatcattccgtggtgacttgtctgaaacgagtagaccatatctctgcacaggatttgatatctaccttgtttgggaaccatgcacaatgtgtgcaatggcacttgtacatcatagattcaagcgcgtgttctacgctttccccaatcctgttactggagcactcggtggagtctacaggttgcacggggagagaagtttaaatcatcactacaatgtatttagggtttcagtacctgaggcatactcgaatggtttgaagtattgttcgaaggaatgctga

SEQ ID NO: 11234 - protein, 412 aa, Sorghum bicolor
  misc_feature: Ceres ANNOT ID no. 6122315
  misc_feature (143)..(366): Pfam Id: dCMP_cyt_deam_1 Pfam Desc: Cytidine and deoxycytidylate deaminase zinc-binding region
  misc_feature (1)..(412): NCBI GI: 50252628 NCBI Desc: cytidine/deoxycytidylate deaminase-like protein [oryza sativa (japonica cultivar-group)]
  misc_feature (5)..(399): NCBI GI: 144924826 NCBI Desc: cmp/dcmp deaminase, zinc-binding [medicago truncatula]
  misc_feature (2)..(399): NCBI GI: 55733733 NCBI Desc: at5g24670 [arabidopsis thaliana]
  misc_feature (2)..(399): NCBI GI: 79519581 NCBI Desc: hydrolase/ zinc ion binding [arabidopsis thaliana]
  misc_feature (291)..(394): NCBI GI: 37805396 NCBI Desc: scamp4 protein [mus musculus]
MAWELIEVPGNLNPSLQDSTVDVLATKIDPKLANTLIRQLSQVCPLENLRHVKRVRRRTECGGKSELSIILCVSTGSEPCSIQFSEDLQKIVDTYQLSPFTAKVAKYCATSKEEWEEQCKLWPTSYHPAHDLDIVRGFQEEELPSIFNCMKTAIQLSKAGNAAIIIDPSSMQIIAKATDQTHKHDTPEEGNTFSEANADVTCSLNASTDNDCNLSLPGSFLSKRNSLNMEISCINPWGWMRKRTCEQKPLPCDGCFAWHPLRHAPMVAIENAAERDRTMFPSSTSITKPDSNGNPENCCDNEPAKRLKTDTKDNEQSSSESFRGDLSETSRPYLCTGFDIYLVWEPCTMCAMALVHHRFKRVFYAFPNPVTGALGGVYRLHGERSLNHHYNVFRVSVPEAYSNGLKYCSKEC

SEQ ID NO: 11235 - DNA, 684 bp, Sorghum bicolor
  misc_feature: Ceres ANNOT ID no. 6122318
  misc_feature: Encodes the peptide sequence at SEQ ID NO 11236
atggcgttcttgacgcctttttccgcccccgcgtccgccgccgcggtcgtccttcccgtcccgccgccgccgtccgccgtggcactggtggcgcggcgccgcgcgccggtgccgtcggcggcggcggccctgctgcgcgccatgccgcagggcgggaagaacgcgcggcgtggcgcggcgctggtagtggtggtgccgtccgccgcgctcgatgacgttgacgtgcccccggcggccatcatcgacgacgccgacctccgcgcctacctcgagtcgcagatcgtcacctccgaccagatgagcccggcggcgaagctcaccgacgtgatgtcgcgcccggtgcaggtggcaacgccggggcagcggctagcggaggtcgacgcgttcttcgccgcgcggcagtactccggcctgcccgtggtggacgacgacggcaggtgcattggggtcatctccaacaaggacaaggccaaggcgcccaatgggatggagtcaactgtaggtgaagtcatgtcatctcctgcgataacgctgacactgtataagactgtcttggaggctgcagcgctaatgcttaaggagaaggttcacaggataccggttgtgaatgaacaacagcatgtgatcggaattgtgactcgctcggacgtattccagactcttgagcccaacaacaaagcatga

SEQ ID NO: 11236 - protein, 227 aa, Sorghum bicolor
  misc_feature: Ceres ANNOT ID no. 6122318
  misc_feature (108)..(222): Pfam Id: CBS Pfam Desc: CBS domain pair
  misc_feature (5)..(222): NCBI GI: 116317809 NCBI Desc: osigba0147b06.5 [oryza sativa (indica cultivar-group)]
  misc_feature (5)..(222): NCBI GI: 38347506 NCBI Desc: osjnba0095e20.4 [oryza sativa (japonica cultivar-group)]
  misc_feature (85)..(222): NCBI GI: 115449677 NCBI Desc: os02g0818000 [oryza sativa (japonica cultivar-group)]
  misc_feature (85)..(195): NCBI GI: 33771378 NCBI Desc: brown planthopper-induced resistance protein 1 [oryza sativa (indica cultivar-group)]
  misc_feature (166)..(221): NCBI GI: 23127710 NCBI Desc: cog0517: fog: cbs domain [nostoc punctiforme pcc 73102]
MAFLTPFSAPASAAAVVLPVPPPPSAVALVARRRAPVPSAAAALLRAMPQGGKNARRGAALVVVVPSAALDDVDVPPAAIIDDADLRAYLESQIVTSDQMSPAAKLTDVMSRPVQVATPGQRLAEVDAFFAARQYSGLPVVDDDGRCIGVISNKDKAKAPNGMESTVGEVMSSPAITLTLYKTVLEAAALMLKEKVHRIPVVNEQQHVIGIVTRSDVFQTLEPNNKA

SEQ ID NO: 11237 - DNA, 357 bp, Sorghum bicolor
  misc_feature: Ceres ANNOT ID no. 6122319
  misc_feature: Encodes the peptide sequence at SEQ ID NO 11238
atgaatgccccagatcgctatgagcgctttgtcgtgcctgagggcaccaagaaggtgtcatatgagagggacacaaagatcgtgaatgcagcatctttcactatcgagcgcgaggaccacaccatcggcaacattgtccgcatgcagctgcacagagacccaaatgtgctctttgctggctataagctccctcatccacttcagtacaagatcatcgtcaggatccatactaccagccagtcctccccaacacaggcctactcccaggcagtcaatgatctagacaaggagcttgagtacctcaagcaagcttttgagcttccgtgtgagtttttagacctcaactttagcctttaa

SEQ ID NO: 11238 - protein, 118 aa, Sorghum bicolor
  misc_feature: Ceres ANNOT ID no. 6122319
  misc_feature (29)..(103): Pfam Id: RNA_pol_L Pfam Desc: RNA polymerase Rpb3/Rpb11 dimerisation domain
  misc_feature (1)..(106): NCBI GI: 29029080 NCBI Desc: at3g52090 [arabidopsis thaliana]
  misc_feature (1)..(106): NCBI GI: 108869812 NCBI Desc: dna-directed rna polymerase ii 13.3 kda polypeptide [aedes aegypti]
  misc_feature (1)..(106): NCBI GI: 54644890 NCBI Desc: ga19897-pa [drosophila pseudoobscura]
  misc_feature (1)..(107): NCBI GI: 89268974 NCBI Desc: polymerase (rna) ii (dna directed) polypeptide j, 13.3kda [xenopus tropicalis]
  misc_feature (1)..(107): NCBI GI: 11595485 NCBI Desc: rpb11a protein [homo sapiens]
  misc_feature (1)..(106): SWISSPROT Homolog: EC 2.7.7.6 DNA-directed RNA polymerase II subunit J
MNAPDRYERFVVPEGTKKVSYERDTKIVNAASFTIEREDHTIGNIVRMQLHRDPNVLFAGYKLPHPLQYKIIVRIHTTSQSSPTQAYSQAVNDLDKELEYLKQAFELPCEFLDLNFSL

SEQ ID NO: 11239 - DNA, 1017 bp, Sorghum bicolor
  misc_feature: Ceres ANNOT ID no. 6122320
  misc_feature: Encodes the peptide sequence at SEQ ID NO 11240
atgatggcgtccggcggcgagcccccggctacgaaggtcgtcctccttctcgtcccccacatggacgcgtccttccacgccgcgctgcgcgggcgcttccgcgtcctcgacttcttcgcctcctccgagcgctcgccgctcccggccttcctcgccgccgcagcggccgctccggagcctcctcgtgccgccatcgtcgtgggggcggggctgatccccgtggacgccgcgttcctcgacgccgtcccgtccctccgctgcgtcacgtgcctggcggcgggcgttgacttcatcgacctggacgagtgcgcgcgccgcggcgtcgttgtcgccaactccggcagggtgttctccgccgacgtcgccgaccacgccgtcggcctgctcatcgacgtgctccgtcgcgtgtcggccgccgagcggttcgtccgccgcggcctctggcgcgtgcagggggacggctacccgctcggctccaagatcggtggccggcgtgtcggcatcgtcggcttggggaacatcggctcacaaatcgcgaagagactccaagctctcggctgcaccgtcttctacaactcgagaacgcgcaaggattccgtcccttacagatacttcaccagcgttcacgacctcgcggcggaatccgacgtgctcgtcgtcgcgtgcgcgctgaacaaggcgacgcggcacatcgtcggcaaggacgttctggaggcgctaggaaaagacggggtcatcgtgaacatcagccgcggcgcgaacgtcgaccaggcggagctggtcagggcgctgcaggagggtaggatcgccggcgccggcctcgatgtcttcgagaacgagcccggagcgcccggcgagctcttttccatggacaatgtcgtgatgacacctcatgtggctgttttcacggcggaatccatgtccgacctccgagaccacaccattgctaaccttgaagccttcttctccggtgagccgttgcttacgccggtgcttccccactcaccggtaatgtag

SEQ ID NO: 11240 - protein, 338 aa, Sorghum bicolor
  misc_feature: Ceres ANNOT ID no. 6122320
  misc_feature (126)..(300): Pfam Id: 2-Hacid_dh_C Pfam Desc: D-isomer specific 2-hydroxyacid dehydrogenase, NAD bindingdomain
  misc_feature (14)..(332): Pfam Id: 2-Hacid_dh Pfam Desc: D-isomer specific 2-hydroxyacid dehydrogenase, catalyticdomain
  misc_feature (4)..(332): NCBI GI: 38346877 NCBI Desc: osjnbb0004g23.11 [oryza sativa (japonica cultivar-group)]
  misc_feature (4)..(332): NCBI GI: 116310892 NCBI Desc: b0616e02-h0507e05.8 [oryza sativa (indica cultivar-group)]
  misc_feature (8)..(333): NCBI GI: 115456830 NCBI Desc: os04g0107200 [oryza sativa (japonica cultivar-group)]
  misc_feature (1)..(333): NCBI GI: 116310894 NCBI Desc: b0616e02-h0507e05.10 [oryza sativa (indica cultivar-group)]
  misc_feature (8)..(331): NCBI GI: 38345308 NCBI Desc: osjnbb0085f13.13 [oryza sativa (japonica cultivar-group)]
MMASGGEPPATKVVLLLVPHMDASFHAALRGRFRVLDFFASSERSPLPAFLAAAAAAPEPPRAAIVVGAGLIPVDAAFLDAVPSLRCVTCLAAGVDFIDLDECARRGVVVANSGRVFSADVADHAVGLLIDVLRRVSAAERFVRRGLWRVQGDGYPLGSKIGGRRVGIVGLGNIGSQIAKRLQALGCTVFYNSRTRKDSVPYRYFTSVHDLAAESDVLVVACALNKATRHIVGKDVLEALGKDGVIVNISRGANVDQAELVRALQEGRIAGAGLDVFENEPGAPGELFSMDNVVMTPHVAVFTAESMSDLRDHTIANLEAFFSGEPLLTPVLPHSPVM

SEQ ID NO: 11241 - DNA, 1101 bp, Sorghum bicolor
  misc_feature: Ceres ANNOT ID no. 6122325
  misc_feature: Encodes the peptide sequence at SEQ ID NO 11242
atgaagtcaaatccgatcctcgcggcagcaatcgggttcttaatcggcgttcatttttccgtacaaatcacatcaaagctattcccgttgaaccttgttggtgatggaaactgcaacgccagcggcagcaacatatttgccagattttcaacaccgttcagaaatagcacctctaattatactgcagttgggactcctctgttgcagtcaaatgccacttcagattcagagaagattgctctggcggcaaaaccaaaaggggcagagcggctaccaccaaacattgttgttcgagagtctgatcttcacctgcgccggctctggggacacccgcgtgaggacacccccactcgcaaataccttgtggcgctgacagtgggttacagcgagagagtcaatgtcaatgcgacagttcacaagttctcggacaattttgatgtgatgctgttccactacgacggtcggacgacagagtgggacaagttcgagtggtccaagcaagccattcatgtcagcgccaggaagcaggccaaatggtggtatgccaagaggttcatgcaccccagcgtcgtggcgccatacgactacatcttcctatgggaccaggaccttggagttgagacctttgacgcggaggagtacatcaagattgtgaagaagcacgggctggagatttcgcagccgggcctggacatcaccaggggggtcaagacctataatatcactatcagaaggaacgacaccgagatgcacaccgggttcgtcgaggtgatggctcccgtcttcaccagagaggcctggacttgcgtctggcacatgatccagaatgaccttgttcacggctggggtctcgactggaacttctggagatgcgtcgacgagcctgagcagcagatcggtgtggttgacgcgcagtatgttgcgcatcacaaggggtttacgctcgggaacaagggcaaggacatcgcggatggaagccgtcgcaaggtcagggaccgggcgacggctgagtttggcatgttgaaagccagattgtacagcgcggatagggcccaggcagcggctcttcttccacaatcgaatgcagcgccaccgtcatag

SEQ ID NO: 11242 - protein, 366 aa, Sorghum bicolor
  misc_feature: Ceres ANNOT ID no. 6122325
  misc_feature (8)..(355): NCBI GI: 54291145 NCBI Desc: storage protein-like [oryza sativa (japonica cultivar-group)]
  misc_feature (75)..(355): NCBI GI: 54291144 NCBI Desc: storage protein-like [oryza sativa (japonica cultivar-group)]
  misc_feature (11)..(251): NCBI GI: 23309021 NCBI Desc: at3g26440/f20c19_16 [arabidopsis thaliana]
  misc_feature (78)..(251): NCBI GI: 8778842 NCBI Desc: t6d22.12 [arabidopsis thaliana]
  misc_feature (83)..(251): NCBI GI: 9743342 NCBI Desc: f21j9.23 [arabidopsis thaliana]
MKSNPILAAAIGFLIGVHFSVQITSKLFPLNLVGDGNCNASGSNIFARFSTPFRNSTSNYTAVGTPLLQSNATSDSEKIALAAKPKGAERLPPNIVVRESDLHLRRLWGHPREDTPTRKYLVALTVGYSERVNVNATVHKFSDNFDVMLFHYDGRTTEWDKFEWSKQAIHVSARKQAKWWYAKRFMHPSVVAPYDYIFLWDQDLGVETFDAEEYIKIVKKHGLEISQPGLDITRGVKTYNITIRRNDTEMHTGFVEVMAPVFTREAWTCVWHMIQNDLVHGWGLDWNFWRCVDEPEQQIGVVDAQYVAHHKGFTLGNKGKDIADGSRRKVRDRATAEFGMLKARLYSADRAQAAALLPQSNAAPPS

SEQ ID NO: 11243 - DNA, 1413 bp, Sorghum bicolor
  misc_feature: Ceres ANNOT ID no. 6122336
  misc_feature: Encodes the peptide sequence at SEQ ID NO 11244
atggcagcagagacgggctcttccgcggcgaggaccaggacggcggggctcgccgcggcggcggcggtgacggcgctcctcgtcctcgtcgtggtcgttggcagcgcggcgctccctggcgggcgggtgacggtcctcgacggcctccggcacaggagcacggccgtggtggcaggcggcgcgaggcggtggctgagggactcctcctcctggccggctgcggcggcggcgacgacgacgacgagcacgcccgtcgtcgccggcgcggtggaggatccggaagccgtggccaacgacgtgcacgtgtccatcaggaacagcacggcccggcgaaatctcgggtacctgtcgtgcgggacaggcaaccccatcgatgactgctggcgttgcgactcggactggcacaacaaccgccagcgcctagctgactgtggcatcggcttcggccgcaacgccatcggtggccgcgacggcaagatctacgtggtcaccgacccgagcgatgacgatcctgtcaacccgcgcaagggcaccctccgctacgccgtcatccaggaagagccgctctggatcatcttcaagcgggacatggtcatcacgctcaaggaggagctcatcatgaacagcttcaagaccatcgacggccgcggcgccaacgtgcacatcgccaatggtgcctgcatcaccatccagtacatcaccaacgtcatcatccacggtctccacatccacgactgcaagcccacggggaacgccatggtgcgcagctcgcccagccactatgggtggcgcaccatggccgacggagatgctgtgtccatcttcggctccagccacgtctgggtggaccactgctcactctccaactgcgccgacggcctgatcgatgccatcatgggatccacggccattactgtgtccaacaactacttcacccaccacaacgaggtgatgcttcttggccacagtgactcctatgtgaaggacaaggcaatgcaggtgacaatagccttcaaccattttggtgaaggtctcattcagcgaatgccaaggtgccggcatggctacttccatgttgtgaacaatgactacacccactgggaaatgtacgccattggcgggagcgctgagcctaccatcaacagccagggcaaccgctaccttgctccaacaaacccattcgccaaggaggtgaccaagagggtcgaaactgctcagactgtctggaagagctggaactggagatcagagggcgacctgctgctgaatggcgcctacttcaccccatccggcgcaggcgcctcagccagctactcgcgcgcgtccagccttggcgccaagtcatcatctatggttggcaccatcacctcggatgctggtgccctgtcgtgccacaagggcacggcctgctag

SEQ ID NO: 11244 - protein, 470 aa, Sorghum bicolor
  misc_feature: Ceres ANNOT ID no. 6122336
  misc_feature (202)..(387): Pfam Id: Pec_lyase_C Pfam Desc: Pectate lyase
  misc_feature (20)..(470): NCBI GI: 38347510 NCBI Desc: osjnba0095e20.8 [oryza sativa (japonica cultivar-group)]
  misc_feature (20)..(470): NCBI GI: 116317811 NCBI Desc: osigba0147b06.7 [oryza sativa (indica cultivar-group)]
  misc_feature (20)..(455): NCBI GI: 115457006 NCBI Desc: os04g0137100 [oryza sativa (japonica cultivar-group)]
  misc_feature (41)..(470): NCBI GI: 6606534 NCBI Desc: pectate lyase 2 [musa acuminata]
  misc_feature (59)..(470): NCBI GI: 121308298 NCBI Desc: pectate lyase [prunus persica]
  misc_feature (93)..(470): SWISSPROT Homolog: EC 4.2.2.2 Pectate lyase precursor
  misc_feature: Useful for making plants with altered cell wall content and/or composition
  misc_feature: Useful for making plants with modulated phosphate use efficiency
  misc_feature: Functional homolog of the protein sequence given in SEQ ID NO 13129
  misc_feature: Functional homolog of the protein sequence encoded by LOCUS at1g11920
  misc_feature: Functional homolog of the protein sequence encoded by LOCUS at1g30350
  misc_feature: Functional homolog of the protein sequence encoded by LOCUS at1g67750
  misc_feature: Functional homolog of the protein sequence encoded by LOCUS at3g07010
  misc_feature: Functional homolog of the protein sequence encoded by LOCUS at3g24230
  misc_feature: Functional homolog of the protein sequence encoded by LOCUS at3g24670
  misc_feature: Functional homolog of the protein sequence encoded by LOCUS at3g27400
  misc_feature: Functional homolog of the protein sequence encoded by LOCUS at4g13210
  misc_feature: GREAT-hit functional homolog of the protein sequence encoded by LOCUS at4g13710
  misc_feature: Functional homolog of the protein sequence encoded by LOCUS at4g22080
  misc_feature: Functional homolog of the protein sequence encoded by LOCUS at4g22090
  misc_feature: Functional homolog of the protein sequence encoded by LOCUS at5g48900
  misc_feature: Functional homolog of the protein sequence encoded by LOCUS at5g55720
  misc_feature: Functional homolog of the protein sequence encoded by LOCUS at5g63180
  misc_feature: Useful for making plants with altered cell wall content and/or composition
  misc_feature: Functional homolog of the protein sequence given in SEQ ID NO 13667
  misc_feature: Useful for making plants with modulated phosphate use efficiency
  misc_feature: Functional homolog of the protein sequence given in SEQ ID NO 13129
  misc_feature: Useful for making plants with altered carbohydrate content
  misc_feature: Functional homolog of the protein sequence given in SEQ ID NO 13668
MAAETGSSAARTRTAGLAAAAAVTALLVLVVVVGSAALPGGRVTVLDGLRHRSTAVVAGGARRWLRDSSSWPAAAAATTTTSTPVVAGAVEDPEAVANDVHVSIRNSTARRNLGYLSCGTGNPIDDCWRCDSDWHNNRQRLADCGIGFGRNAIGGRDGKIYVVTDPSDDDPVNPRKGTLRYAVIQEEPLWIIFKRDMVITLKEELIMNSFKTIDGRGANVHIANGACITIQYITNVIIHGLHIHDCKPTGNAMVRSSPSHYGWRTMADGDAVSIFGSSHVWVDHCSLSNCADGLIDAIMGSTAITVSNNYFTHHNEVMLLGHSDSYVKDKAMQVTIAFNHFGEGLIQRMPRCRHGYFHVVNNDYTHWEMYAIGGSAEPTINSQGNRYLAPTNPFAKEVTKRVETAQTVWKSWNWRSEGDLLLNGAYFTPSGAGASASYSRASSLGAKSSSMVGTITSDAGALSCHKGTAC

SEQ ID NO: 11245 - DNA, 171 bp, Sorghum bicolor
  misc_feature: Ceres ANNOT ID no. 6003572
  misc_feature: Encodes the peptide sequence at SEQ ID NO 11246
atgaaaaatgtaacccattctttcgtttttttagctcactggccattcgctgggagtttcgggcttaataccgatattttagcaacaaatctaataaatctaactgtagtggttggtgtattgattttttttggaaagggagtgtgtgcgagttgtctatttcaagaatag

SEQ ID NO: 11246 - protein, 56 aa, Sorghum bicolor
  misc_feature: Ceres ANNOT ID no. 6003572
  misc_feature (1)..(53): NCBI GI: 902218 NCBI Desc: atpase subunit i [zea mays]
  misc_feature (1)..(53): NCBI GI: 50812524 NCBI Desc: atp synthase i subunit [saccharum officinarum]
  misc_feature (1)..(53): NCBI GI: 118614488 NCBI Desc: atp synthase cf0 subunit i [sorghum bicolor]
  misc_feature (1)..(56): NCBI GI: 224349 NCBI Desc: orf 3
  misc_feature (1)..(53): NCBI GI: 311717 NCBI Desc: cf-o subunit i [triticum aestivum]
  misc_feature (1)..(53): SWISSPROT Homolog: EC 3.6.3.14 ATP synthase B chain
MKNVTHSFVFLAHWPFAGSFGLNTDILATNLINLTVVVGVLIFFGKGVCASCLFQE

SEQ ID NO: 11247 - DNA, 114 bp, Sorghum bicolor
  misc_feature: Ceres ANNOT ID no. 6003587
  misc_feature: Encodes the peptide sequence at SEQ ID NO 11248
atgattgaagtttttctatttggaatcgtcttaggcctaattcctattactttagcgggattattcgtgactgcgtatttgcaatacaggcgtggggatcagttggatctttga

SEQ ID NO: 11248 - protein, 37 aa, Sorghum bicolor
  misc_feature: Ceres ANNOT ID no. 6003587
  misc_feature (1)..(37): Pfam Id: PetG Pfam Desc: Cytochrome B6-F complex subunit 5
  misc_feature (1)..(37): NCBI GI: 109945536 NCBI Desc: cytochrome b6/f complex subunit v [populus alba]
  misc_feature (1)..(37): NCBI GI: 42795500 NCBI Desc: cytochrome b6/f complex subunit v; pete [oryza sativa (indica cultivar-group)]
  misc_feature (1)..(37): NCBI GI: 11466809 NCBI Desc: cytochrome b6/f complex subunit v [oryza sativa (japonica cultivar-group)]
  misc_feature (1)..(37): NCBI GI: 226628 NCBI Desc: cytochrome b/f complex 5
  misc_feature (1)..(37): NCBI GI: 902240 NCBI Desc: cytochrome b /f complex subunit 5 [zea mays]
MIEVFLFGIVLGLIPITLAGLFVTAYLQYRRGDQLDL

SEQ ID NO: 11249 - DNA, 294 bp, Sorghum bicolor
  misc_feature: Ceres ANNOT ID no. 6003813
  misc_feature: Encodes the peptide sequence at SEQ ID NO 11250
atggattggctggggcagaagcgcgcggagatgctgatgcaggtgctgctggtggcgtctgcggtggtggcgttcgtggtgggctacgtgcgcgccgacttccagctcatgctgctcgtctacgccggcggcgtcgtgctcacggcgttcgtcaccgtccccaactggcccttcttcaaccgtaacccgctcaagtggctggacgctgctgaggccgagcgccacccgcgcccccaggtcagtgccggcggcgcggcgggagggggtaagaagaagtccgggaagaacaagtaa

SEQ ID NO: 11250 - protein, 97 aa, Sorghum bicolor
  misc_feature: Ceres ANNOT ID no. 6003813
  misc_feature (1)..(80): Pfam Id: SPC12 Pfam Desc: Microsomal signal peptidase 12 kDa subunit (SPC12)
  misc_feature (1)..(97): NCBI GI: 108862603 NCBI Desc: microsomal signal peptidase 12 kda subunit family protein [oryza sativa (japonica cultivar-group)]
  misc_feature (1)..(97): NCBI GI: 115488412 NCBI Desc: os12g0438900 [oryza sativa (japonica cultivar-group)]
  misc_feature (1)..(97): NCBI GI: 30102562 NCBI Desc: at4g40042 [arabidopsis thaliana]
  misc_feature (1)..(72): NCBI GI: 5138926 NCBI Desc: hspc033 [homo sapiens]
  misc_feature (1)..(72): NCBI GI: 20140350 NCBI Desc: microsomal signal peptidase 12 kda subunit (spase 12 kda subunit) (spc12) (hspc033)
MDWLGQKRAEMLMQVLLVASAVVAFVVGYVRADFQLMLLVYAGGVVLTAFVTVPNWPFFNRNPLKWLDAAEAERHPRPQVSAGGAAGGGKKKSGKNK

SEQ ID NO: 11251 - DNA, 618 bp, Sorghum bicolor
  misc_feature: Ceres ANNOT ID no. 6003886
  misc_feature: Encodes the peptide sequence at SEQ ID NO 11252
atgcaacgggcagtgcaagccgtcaggtcacatggcagtgtgcttaaatacgctgttctacaacacatcagcgctcccaaaccagcaatgcttcctgctgtcttttctcgtttcatgtcagtttcatctgctcgcctagaggatagtggatttgaaactgccactgtatcagatgtcttgaagtctaaagggaagagtgctgatggatcttggctctggtgcaccacagaggatactgtctatgatgctgtcaaatcgatgacgcagcacaacgtgggagctttggtggttgtcaaacctggagaggctaaatcaattgctggcattgtcactgagagagattatctaaggaaaatcatagtgcagggaagatcttccaagtcaactaaggttggcgacatcatgaccgaggagaacaaactgatcacagtgaaccccaacaccaaagtcctgcaagcaatgcagctgatgacagacaaccgcatcagacacatcccggtgattgacggcacagggatgctggggatggtctccatcggcgacgtcgtgcgcgcggtggtcgccgagcacagggaggagctgaaccggctcaacgactacatccagggaggctactag

SEQ ID NO: 11252 - protein, 205 aa, Sorghum bicolor
  misc_feature: Ceres ANNOT ID no. 6003886
  misc_feature (65)..(187): Pfam Id: CBS Pfam Desc: CBS domain pair
  misc_feature (12)..(205): NCBI GI: 47027028 NCBI Desc: cbs1 [hyacinthus orientalis]
  misc_feature (1)..(205): NCBI GI: 118162023 NCBI Desc: cbs domain-containing protein [solenostemon scutellarioides]
  misc_feature (53)..(203): NCBI GI: 84352379 NCBI Desc: cog0517: fog: cbs domain [burkholderia cenocepacia pc184]
  misc_feature (55)..(203): NCBI GI: 83650393 NCBI Desc: cbs domain protein [burkholderia thailandensis e264]
  misc_feature (55)..(203): NCBI GI: 53717172 NCBI Desc: cbs domain protein [burkholderia mallei atcc 23344]
MQRAVQAVRSHGSVLKYAVLQHISAPKPAMLPAVFSRFMSVSSARLEDSGFETATVSDVLKSKGKSADGSWLWCTTEDTVYDAVKSMTQHNVGALVVVKPGEAKSIAGIVTERDYLRKIIVQGRSSKSTKVGDIMTEENKLITVNPNTKVLQAMQLMTDNRIRHIPVIDGTGMLGMVSIGDVVRAVVAEHREELNRLNDYIQGGY

SEQ ID NO: 11253 - DNA, 879 bp, Sorghum bicolor
  misc_feature: Ceres ANNOT ID no. 6003919
  misc_feature: Encodes the peptide sequence at SEQ ID NO 11254
atggccggcatgatcagcttgcgcaccggcccgaggagttcgccggcacttcctcggctgtcgtctgctcggccaccacaagttgcagttcgttttacaagcccgctgtttcgttgtgccaaactttgtaagagccgtaatctactggcagcagcactggaggtctctaaggacgggccctccgcggttctggccaataccctgccttctgaaggggctattgagacattgcggaatgctgatgcggtatgtttcgatgtcgatagcaccgtcatcctggatgagggcattgacgagcttgctgatttctgtggggcagggaaagctgttgctgaatggacagcaaaggccatgacagggactgttccatttgaggaggcgctggcagccaggctgtctttaatcaagccatctctctcccaggtggaggaatgcctggagaagaggccaccaaggatttctcctggaatggctgatttagttaagaagctaaaatccaataatattgatgtgttccttgtgtcaggaggcttccgacaaatgatcaagcctgtggcatttcagcttggtattcctcctgaaaacatcactgcaaaccaattgttatttggcacttcgggggagtatgctggatttgatcccacagagcccacttcacgcagtgggggtaaagcaaaagcagtgcagaaaataaaacaggaccatggctacaagacagttgttatgattggtgatggtgcaactgatctggaggctcggcaacctggtggagcggacttgttcatctgttacgctggtgttcagatgagagagccagtcgcagcattagctgactgggtggtctttgattttcaagagctgatcactaagttgccataa

SEQ ID NO: 11254 - protein, 292 aa, Sorghum bicolor
  misc_feature: Ceres ANNOT ID no. 6003919
  misc_feature (80)..(266): Pfam Id: Hydrolase Pfam Desc: haloacid dehalogenase-like hydrolase
  misc_feature (66)..(291): NCBI GI: 3759179 NCBI Desc: 3-phosphoserin phosphatase [arabidopsis thaliana]
  misc_feature (69)..(291): NCBI GI: 117970179 NCBI Desc: pxphosphoserine phosphatase [plutella xylostella]
  misc_feature (75)..(291): NCBI GI: 114107987 NCBI Desc: psph protein [xenopus tropicalis]
  misc_feature (75)..(291): NCBI GI: 49898873 NCBI Desc: psph-prov protein [xenopus laevis]
  misc_feature (79)..(291): NCBI GI: 31615697 NCBI Desc: chain b, crystal structure of human phosphoserine phosphatase
  misc_feature (66)..(291): SWISSPROT Homolog: EC 3.1.3.3 Phosphoserine phosphatase, chloroplast precursor
MAGMISLRTGPRSSPALPRLSSARPPQVAVRFTSPLFRCAKLCKSRNLLAAALEVSKDGPSAVLANTLPSEGAIETLRNADAVCFDVDSTVILDEGIDELADFCGAGKAVAEWTAKAMTGTVPFEEALAARLSLIKPSLSQVEECLEKRPPRISPGMADLVKKLKSNNIDVFLVSGGFRQMIKPVAFQLGIPPENITANQLLFGTSGEYAGFDPTEPTSRSGGKAKAVQKIKQDHGYKTVVMIGDGATDLEARQPGGADLFICYAGVQMREPVAALADWVVFDFQELITKLP

SEQ ID NO: 11255 - DNA, 1650 bp, Sorghum bicolor
  misc_feature: Ceres ANNOT ID no. 6003953
  misc_feature: Encodes the peptide sequence at SEQ ID NO 11256
atgcacacacatctcttctgccactgtcatctcaaatgccatgctgttatgccagcagtggctgcaactcttcatctagttgtggcaaattttagcacatccccaacacttgagaaatcaagaaagcaaaggcatgccaaccttcaaaatgcattgagagttttggaccttgtaccatccaagcatcatcatgaccaagaggaagttccgtcgcatcaccgccttatcaatggttgtatgggtgacatcttgggagtacaatcaagactgcatgctatgcgtaagggtaaagagagctttgctaactcaagctcaaaccaagcacagcctgaacgcagtaacattttctcaaataatacctcagtttgcccctccataactaaactcacaaaggaggacatgtttatgcaaattgtggagttgcataggaggggacaaatcagttcagatgcatctattttggcatctgcactgagttactgtgctgatgggaaaactcttactgcaggtgtacagttccatgctctactagtgaaagtaggatatgtctcatctatccccattggcagctcactaatcagtttttattcaagatgcggccaattggaaattgctcatcgggtttttcaaaatatgacagcaaaaaatactgtgacatggacagcattaatttctggctatgcccaggataatcaggtcgaaccatgtctccatttgtttgcactgatgaggcggtctgtgtgcaagccaaatgacattacatttgcaactatcttcagtgtctgcactaatcatgcatttcttgtacttggtaaaagcgtgcaagccctacaaatgagaatgggttttgattcctatgtgcatgtgtccaatgcattgatatcaatgtatgcaaagtgtgggagtattggtgaagcacgagctgtatttgagagcattacatgcaaagacctggtctcttggaactccttgatctttggatattcacaacatggccttgctgagcattgcctaggcttgcttaaagaaatggaagggcatataataccggatgcaatctccttcctaggcgtgctctcatcatgccggcatgcatgccttgtggcggagggccgacgctgctttagggcaatgattgaacatggagtaataccagagatagatcactactcatgtatggtcgatctttttggccgtgcagggctgcttgatgaagcatgggatctgatccagacaatgcccatgcctccaaatggtgtcatatggggctccctgctagcttcctgtagggtgcatgggagcatttcgatcggaatacaagctgcagagcaccgtctaaagctggagccaagttgtgctgcaactcatgtccagctagcgaatttgtatgggagcattggctgctgggatgatgtggcaagagtgaggaaggtgatgaaggagagaggactgaaaacaaacatcgggtgcagttggatagaagttggcaataaagtttacactttcacagcagaaaacagatcaaagagccaggtaaacaatgtcctggatgttcttgattgcttgcagtcacatatggaccacaagtatgatgtactgattgagggtctggattgggagcatatcatgttaagtttaaacactatataa

SEQ ID NO: 11256 - protein, 549 aa, Sorghum bicolor
  misc_feature: Ceres ANNOT ID no. 6003953
  misc_feature (218)..(252): Pfam Id: PPR Pfam Desc: PPR repeat
  misc_feature (319)..(352): Pfam Id: PPR Pfam Desc: PPR repeat
  misc_feature (14)..(538): NCBI GI: 115485079 NCBI Desc: os11g0275400 [oryza sativa (japonica cultivar-group)]
  misc_feature (1)..(529): NCBI GI: 115475451 NCBI Desc: os08g0238100 [oryza sativa (japonica cultivar-group)]
  misc_feature (112)..(526): NCBI GI: 54695180 NCBI Desc: ppr986-12 [physcomitrella patens]
  misc_feature (152)..(527): NCBI GI: 78183583 NCBI Desc: ppr1106-17 [physcomitrella patens]
  misc_feature (150)..(526): NCBI GI: 87240430 NCBI Desc: tetratricopeptide-like helical [medicago truncatula]
MHTHLFCHCHLKCHAVMPAVAATLHLVVANFSTSPTLEKSRKQRHANLQNALRVLDLVPSKHHHDQEEVPSHHRLINGCMGDILGVQSRLHAMRKGKESFANSSSNQAQPERSNIFSNNTSVCPSITKLTKEDMFMQIVELHRRGQISSDASILASALSYCADGKTLTAGVQFHALLVKVGYVSSIPIGSSLISFYSRCGQLEIAHRVFQNMTAKNTVTWTALISGYAQDNQVEPCLHLFALMRRSVCKPNDITFATIFSVCTNHAFLVLGKSVQALQMRMGFDSYVHVSNALISMYAKCGSIGEARAVFESITCKDLVSWNSLIFGYSQHGLAEHCLGLLKEMEGHIIPDAISFLGVLSSCRHACLVAEGRRCFRAMIEHGVIPEIDHYSCMVDLFGRAGLLDEAWDLIQTMPMPPNGVIWGSLLASCRVHGSISIGIQAAEHRLKLEPSCAATHVQLANLYGSIGCWDDVARVRKVMKERGLKTNIGCSWIEVGNKVYTFTAENRSKSQVNNVLDVLDCLQSHMDHKYDVLIEGLDWEHIMLSLNTI

SEQ ID NO: 11257 - DNA, 1230 bp, Sorghum bicolor
  misc_feature: Ceres ANNOT ID no. 6004063
  misc_feature: Encodes the peptide sequence at SEQ ID NO 11258
atggatggcatctcgagccccatcgcggcgcacatcctagacttctgcgacgatggcagcggcggcgacctcttcgcggccgtgaacacggcctcggacatgttcacggcgtcatcagaggacgcctcgtcgtcgtccgtaacgacgcctcccgtgccctgcggccaaggcgacaacgtgtcgctgggcggcgccgcggccacggccgctgcctcggccttctccccgttgccgtccctggactccaccctctcggctctcctcgaagaagaagacccaccggttcctgacaccgaactcctcctccccatcgactaccagcagttcgcggcggcggcggccggagacgagcctcagcccgagcagcagttcgcgcaggtaccggtggtgcttccagtggccggcgcggcggaacacccgggtctgcagacgcagatgagcagcacggcgtcggagctgctgcacgtagcgtcctcagggtacaccgacgagtgcttcgcggcggcaatggctgccggaggagggtacgtgggcctggacgaggccctgtgccagcagcagcatcagccgcagccgcagccgcagcccggcgcgttgctccccgccggcatgatggaaaccgcggcgccgggctgctacttcggcaacggcaaggacacggcggcgccggcgcaagcagcaggcggcttcttcggggccggttgcagcggcatgatgatgtccatgatggggatggaggagatcggcgagtaccagcggatgatggagagcgccagcgccgcgctggccgccacgcacagccccgacgccgactccgccgccgccgcggcagcgcagcagatggcgttcggcggaaacgccgccggcgaaatgcagatgggcggcggcggcggcagcatgagcccggggcggctgccggcggcggcggaggcgtcgagcctggaggacgccaacttcaagagcgcccgcatcaccgtggaggagagacgggagaagatccacaggtacatcaagaagcggaacgagcgcaacttcagcaagaagatcaagtacgcttgcagaaagaccctggcggacagcaggccccgcgtccgcggcagattcgctaagaacgacgactacggcgagccgtcgagggtgatgcagaaccacgaggaatacgaccacatggcgcacatcaacgggatgaactcctacatgtacaaccacactgttgaatcctggatgtaa

SEQ ID NO: 11258 - protein, 409 aa, Sorghum bicolor
  misc_feature: Ceres ANNOT ID no. 6004063
  misc_feature (329)..(373): Pfam Id: CCT Pfam Desc: CCT motif
  misc_feature (232)..(409): NCBI GI: 115482424 NCBI Desc: os10g0466500 [oryza sativa (japonica cultivar-group)]
  misc_feature (305)..(388): NCBI GI: 42561691 NCBI Desc: zinc finger constans-related [arabidopsis thaliana]
  misc_feature (305)..(388): NCBI GI: 2341026 NCBI Desc: f19p19.3 [arabidopsis thaliana]
  misc_feature (306)..(384): NCBI GI: 87240457 NCBI Desc: cct [medicago truncatula]
  misc_feature (301)..(373): NCBI GI: 115483703 NCBI Desc: os11g0101200 [oryza sativa (japonica cultivar-group)]
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO. 370 in the 11/188,298 US application
MDGISSPIAAHILDFCDDGSGGDLFAAVNTASDMFTASSEDASSSSVTTPPVPCGQGDNVSLGGAAATAAASAFSPLPSLDSTLSALLEEEDPPVPDTELLLPIDYQQFAAAAAGDEPQPEQQFAQVPVVLPVAGAAEHPGLQTQMSSTASELLHVASSGYTDECFAAAMAAGGGYVGLDEALCQQQHQPQPQPQPGALLPAGMMETAAPGCYFGNGKDTAAPAQAAGGFFGAGCSGMMMSMMGMEEIGEYQRMMESASAALAATHSPDADSAAAAAAQQMAFGGNAAGEMQMGGGGGSMSPGRLPAAAEASSLEDANFKSARITVEERREKIHRYIKKRNERNFSKKIKYACRKTLADSRPRVRGRFAKNDDYGEPSRVMQNHEEYDHMAHINGMNSYMYNHTVESWM

SEQ ID NO: 11259 - DNA, 222 bp, Sorghum bicolor
  misc_feature: Ceres ANNOT ID no. 6005400
  misc_feature: Encodes the peptide sequence at SEQ ID NO 11260
atgaatattatcaagaccgataggagaaataagatgaatgatgattggatgaatgatagcatgatatgttatattgagcgggatttgtttgtatctattgaagatgacaaaattttggagcgctttcagggcataagaaatcgcaagataaactgccacgcaaggtcccaaggtgtgtattgttttaatacttttctttttgcttgttatcttgattattga

SEQ ID NO: 11260 - protein, 73 aa, Sorghum bicolor
  misc_feature: Ceres ANNOT ID no. 6005400
  misc_feature (1)..(50): NCBI GI: 115436080 NCBI Desc: os01g0293600 [oryza sativa (japonica cultivar-group)]
  misc_feature (1)..(49): NCBI GI: 124361195 NCBI Desc: hat dimerisation [medicago truncatula]
  misc_feature (1)..(51): NCBI GI: 92873506 NCBI Desc: hat dimerisation [medicago truncatula]
  misc_feature (1)..(52): NCBI GI: 92884968 NCBI Desc: hat dimerisation [medicago truncatula]
  misc_feature (1)..(42): NCBI GI: 92899410 NCBI Desc: myb, dna-binding [medicago truncatula]
MNIIKTDRRNKMNDDWMNDSMICYIERDLFVSIEDDKILERFQGIRNRKINCHARSQGVYCFNTFLFACYLDY

SEQ ID NO: 11261 - DNA, 1974 bp, Sorghum bicolor
  misc_feature: Ceres ANNOT ID no. 6005948
  misc_feature: Encodes the peptide sequence at SEQ ID NO 11262
atggccgttaagcccacatctatcaccgccgccagcgccgccgcagccctccatggagaccagcaagtcgccgccgctctactcgccaccgcgggagccctccgcggcgacggtgatgctatgcccgtgcctggcgttcttcatcctcgccctcatcatcatctccatcgcactcactgtccactttcgcctctactgccacacccctcttgcacacctcgtctccccgcaccgctgcccccaccacatctgacctccggctccgcccgcatcgctggcgcggtcctgcttcccagaggcgcgctccctctgccgccgccgagatcccgatcccttacgggttcccctctccacgcgacaccggcatgtggatcttatgacgtgctctggggcttcgcggccggaaggttcctctccacctcggctgcctccggtgaagacgggggcgcgtcggagcaggaggaggcggcgacgagcaaccccgaggtcgtgggccgcgtctgcgcggccatcgcggacgtcgtcgccgccggcgccgacgcgaacctggaggcggcgctatccgcgctctcgccaccgctctgcgaggctgtcgtgctcgctgtgctccaccgcttcaagcatgcacacaggccgtcctaccgcttcttcaggtgggccaccgcgtccggcggcttcacccacaccaccattacctactgcaagatgttacacatcttaggcaagacgaggcagttcgagatgatggttgcgataatccaagagatggggaaggtgggggccctgtccatggacgccttcaaggttgccattaagtccttcgctgcggctggtgaaatcaagaatgcggtcggcgtgttcgagttaatgaaaaagaacggttttgatgatggggtggagtcattcaattgcttgctcgttgctttagccaatgagggattgggcagggaggccaggcaggtgtttgacaaaatgcatggccagtactctccagacctgcgctcttatactgcactgatgctggcatggtgcaatgcgaggaatctggttgaggctgggcgggtttggaatgagatgctggagaagggaatgaagccagatgttgtcgtccacaacacaatgattgaggggttgctgcgtgggcagaggcgacctgaggccttgaagatgtttgagctgatgaaggcaaaggggcctccaccaaatgtgtggacttacacaatgttgatccgcgaccattgtaagagggggaagatggacatggcaatggagtgctttgaggagatgcaggaggccagatgccaaccagatgttgctacctatacatgtttgcttgttggatatgggaatgcaaagcgaatggacagagtgactgctgtgttggaggagatgacacagaagggatgcccccctgatgctcggacttacaacgcactgattaagctgctaacaaataggaaaatgccagacgatgcggcaaggatatacaagaagatgatcaagaaaggacttgagcccacaattcatacttacaacatgatgatgaagtcatatttccttggtgataggaactatgcaatgggttgtgcagtgtgggaggagatgcaccggaggggtatttgtcctgatgttaactcttacacagtgttcattaatgggcatatacgacatggcaggccagaggaggcatataaatatattgaggagatgattaataaagggatgacggctccacagatagactataataagtttgctgcagatttttctaaggctgggaaaccagatatattgtatgagttggctctgaaagtgaaatttgcggggaaatgcgatgcatctaatgtgttctttcagtgggcagatagaatgaagagtcgggtcaagagaactgtacctaatcagattggtaatagaatgtttcgagattaccacactgccagcaggaatgtggcatgctgtcatggtgcttga

SEQ ID NO: 11262 - protein, 657 aa, Sorghum bicolor
  misc_feature: Ceres ANNOT ID no. 6005948
  misc_feature (334)..(368): Pfam Id: PPR Pfam Desc: PPR repeat
  misc_feature (369)..(403): Pfam Id: PPR Pfam Desc: PPR repeat
  misc_feature (404)..(438): Pfam Id: PPR Pfam Desc: PPR repeat
  misc_feature (439)..(473): Pfam Id: PPR Pfam Desc: PPR repeat
  misc_feature (474)..(508): Pfam Id: PPR Pfam Desc: PPR repeat
  misc_feature (545)..(579): Pfam Id: PPR Pfam Desc: PPR repeat
  misc_feature (88)..(630): NCBI GI: 15228788 NCBI Desc: pentatricopeptide (ppr) repeat-containing protein [arabidopsis thaliana]
  misc_feature (139)..(579): NCBI GI: 115455297 NCBI Desc: os03g0746400 [oryza sativa (japonica cultivar-group)]
  misc_feature (213)..(609): NCBI GI: 92873408 NCBI Desc: peptidase s8 and s53, subtilisin, kexin, sedolisin; tetratricopeptide-like helical [medicago truncatula]
  misc_feature (192)..(593): NCBI GI: 115450929 NCBI Desc: os03g0165100 [oryza sativa (japonica cultivar-group)]
  misc_feature (161)..(611): NCBI GI: 92872658 NCBI Desc: imp dehydrogenase/gmp reductase [medicago truncatula]
MAVKPTSITAASAAAALHGDQQVAAALLATAGALRGDGDAMPVPGVLHPRPHHHLHRTHCPLSPLLPHPSCTPRLPAPLPPPHLTSGSARIAGAVLLPRGALPLPPPRSRSLTGSPLHATPACGSYDVLWGFAAGRFLSTSAASGEDGGASEQEEAATSNPEVVGRVCAAIADVVAAGADANLEAALSALSPPLCEAVVLAVLHRFKHAHRPSYRFFRWATASGGFTHTTITYCKMLHILGKTRQFEMMVAIIQEMGKVGALSMDAFKVAIKSFAAAGEIKNAVGVFELMKKNGFDDGVESFNCLLVALANEGLGREARQVFDKMHGQYSPDLRSYTALMLAWCNARNLVEAGRVWNEMLEKGMKPDVVVHNTMIEGLLRGQRRPEALKMFELMKAKGPPPNVWTYTMLIRDHCKRGKMDMAMECFEEMQEARCQPDVATYTCLLVGYGNAKRMDRVTAVLEEMTQKGCPPDARTYNALIKLLTNRKMPDDAARIYKKMIKKGLEPTIHTYNMMMKSYFLGDRNYAMGCAVWEEMHRRGICPDVNSYTVFINGHIRHGRPEEAYKYIEEMINKGMTAPQIDYNKFAADFSKAGKPDILYELALKVKFAGKCDASNVFFQWADRMKSRVKRTVPNQIGNRMFRDYHTASRNVACCHGA

SEQ ID NO: 11263 - DNA, 618 bp, Sorghum bicolor
  misc_feature: Ceres ANNOT ID no. 6005949
  misc_feature: Encodes the peptide sequence at SEQ ID NO 11264
atggagcatgaagaagagctgccttcatcttcttcctccttgggttacctgatgcagtgtaggatctgccacgaggaagagaacgaagggcgcgcgatcatggagtctccttgtggatgctccggctctctcaagtatgctcacaggggatgtgtgcagagatggtgtgatgagaaggggagcaccctctgtgagatttgccttcagaatttcgagccaggctacacaatgcctccaaagaaaactccggcgattgaaactgcggtcactatcagtgaacatgaggacatgcaacctttggaatctccggagggctccattgacggtgcagattacaccaggtgctcctacgccgcagatcaatgcgccacatggtgccggtcgctggcgatcacgttcaccattatgctgttggcatggcatctggttgcagtagtgacggttgaagcagcagatcactgcgcgttcagtctcctgacaatgtacttacttcgtgctgctggtatcctgctgccgctctatgttgtcatgcggctgattcgcatcgtccagaatgggcagaggcagtatcggttgcagctgctggaggaccaaagaagaaatgcatcaactatatga

SEQ ID NO: 11264 - protein, 205 aa, Sorghum bicolor
  misc_feature: Ceres ANNOT ID no. 6005949
  misc_feature (20)..(67): Pfam Id: zf-C3HC4 Pfam Desc: Zinc finger, C3HC4 type (RING finger)
  misc_feature (9)..(205): NCBI GI: 115463379 NCBI Desc: os05g0355300 [oryza sativa (japonica cultivar-group)]
  misc_feature (2)..(203): NCBI GI: 115436152 NCBI Desc: os01g0303600 [oryza sativa (japonica cultivar-group)]
  misc_feature (17)..(203): NCBI GI: 52077476 NCBI Desc: zinc finger protein-like [oryza sativa (japonica cultivar-group)]
  misc_feature (13)..(197): NCBI GI: 92867998 NCBI Desc: zinc finger, ring-type; ringv [medicago truncatula]
  misc_feature (17)..(203): NCBI GI: 4741923 NCBI Desc: pit1 [arabidopsis thaliana]
MEHEEELPSSSSSLGYLMQCRICHEEENEGRAIMESPCGCSGSLKYAHRGCVQRWCDEKGSTLCEICLQNFEPGYTMPPKKTPAIETAVTISEHEDMQPLESPEGSIDGADYTRCSYAADQCATWCRSLAITFTIMLLAWHLVAVVTVEAADHCAFSLLTMYLLRAAGILLPLYVVMRLIRIVQNGQRQYRLQLLEDQRRNASTI

SEQ ID NO: 11265 - DNA, 618 bp, Sorghum bicolor
  misc_feature: Ceres ANNOT ID no. 6006225
  misc_feature: Encodes the peptide sequence at SEQ ID NO 11266
atggatgaggccatgagccccagcccgcgcgccggcggcggcgccggcggcatccactgggaggcacacgggcggctgctcacggcgtgcctcgtcgcgctcaacgtcttcctcgtcctcctcgtctacgtctacttctggcgcttcttctcgcgctcgcgctcccgcggcggcggcggcgaggacgacgacgacgacgcgtcttcggtggcctcctcgccgccggcgtcgcccaaggcccgagaccggcgcgaggtggagctggccatcaccgcgctgcccgtcttcgtccactcctcgtcctcgtccggtggtggcggcggcgccgggccggcggcggcgtcggccgagtgcgcgatctgcatcgcggagttcgcggacggcgacgagggccgcctgctcccgcggtgtgggcacccattccacgcgcgctgcgtcgacacgtggttccgcttccacaccacctgcccgctctgccgcgccaccgtcctcgccgacgccgcgccgccggaggagccggcgccggcgcaaactgccaaccaaccgccgcctcagcaaattcagcatcgtacggatacgacgaatagtacggacgcccatacagattctccggtgtga

SEQ ID NO: 11266 - protein, 205 aa, Sorghum bicolor
  misc_feature: Ceres ANNOT ID no. 6006225
  misc_feature (118)..(159): Pfam Id: zf-C3HC4 Pfam Desc: Zinc finger, C3HC4 type (RING finger)
  misc_feature (20)..(171): NCBI GI: 115436206 NCBI Desc: os01g0311400 [oryza sativa (japonica cultivar-group)]
  misc_feature (32)..(165): NCBI GI: 108708054 NCBI Desc: zinc finger, c3hc4 type family protein [oryza sativa (japonica cultivar-group)]
  misc_feature (12)..(182): NCBI GI: 115445315 NCBI Desc: os02g0249300 [oryza sativa (japonica cultivar-group)]
  misc_feature (87)..(184): NCBI GI: 115489396 NCBI Desc: os12g0596200 [oryza sativa (japonica cultivar-group)]
  misc_feature (87)..(181): NCBI GI: 77556398 NCBI Desc: ring-h2 finger protein rha3b [oryza sativa (japonica cultivar-group)]
  misc_feature: The sequence is a functional homolog of SEQ ID NO 1939 in the 11/479,226US patent application
  misc_feature: Useful for making plants with modulated growth and phenotype characteristics
  misc_feature: The sequence is a functional homolog of SEQ ID NO 1939 in the 20070022495 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MDEAMSPSPRAGGGAGGIHWEAHGRLLTACLVALNVFLVLLVYVYFWRFFSRSRSRGGGGEDDDDDASSVASSPPASPKARDRREVELAITALPVFVHSSSSSGGGGGAGPAAASAECAICIAEFADGDEGRLLPRCGHPFHARCVDTWFRFHTTCPLCRATVLADAAPPEEPAPAQTANQPPPQQIQHRTDTTNSTDAHTDSPV

SEQ ID NO: 11267 - DNA, 492 bp, Sorghum bicolor
  misc_feature: Ceres ANNOT ID no. 6006416
  misc_feature: Encodes the peptide sequence at SEQ ID NO 11268
atggcctccgactcgttggagacggcgaggcagctgctggaggtgacctacacgactgaggcagaagcaacggcggaggcggagcagctgcccagcctaccctcggggttctacgacgccttcgtcctcaggggaatccgcgtcgtccaggccctccagcccggcacactcctctgccacttcaccgtcccttccagactactcaattcgggcggcttcctgcacggcggtgcaaccgcctccctagtcgatttggttgcctccgccgccttcgccactgccggcctccgcaccaggggctcgcccctggagatgaacatctcctacctcgatgctgcttttgctgatgaagagattgatattgaagcgaaggttctgcgcgctggcaaggcagtaggggtggccgttgtggaactgaagaagaaatctggcaaaatcatcgctcaagcccgctactccaagtatctcggtgtagcatctagtaaactctga

SEQ ID NO: 11268 - protein, 163 aa, Sorghum bicolor
  misc_feature: Ceres ANNOT ID no. 6006416
  misc_feature (71)..(148): Pfam Id: 4HBT Pfam Desc: Thioesterase superfamily
  misc_feature (6)..(161): NCBI GI: 13605902 NCBI Desc: at1g04290/f19p19_27 [arabidopsis thaliana]
  misc_feature (22)..(163): NCBI GI: 21740488 NCBI Desc: osjnba0006b20.3 [oryza sativa (japonica cultivar-group)]
  misc_feature (42)..(157): NCBI GI: 94733762 NCBI Desc: novel protein similar to vertebrate thioesterase superfamily member 2 (them2) [danio rerio]
  misc_feature (74)..(163): NCBI GI: 20161439 NCBI Desc: b1065e10.13 [oryza sativa (japonica cultivar-group)]
  misc_feature (42)..(157): NCBI GI: 49900160 NCBI Desc: mgc89869 protein [xenopus tropicalis]
MASDSLETARQLLEVTYTTEAEATAEAEQLPSLPSGFYDAFVLRGIRVVQALQPGTLLCHFTVPSRLLNSGGFLHGGATASLVDLVASAAFATAGLRTRGSPLEMNISYLDAAFADEEIDIEAKVLRAGKAVGVAVVELKKKSGKIIAQARYSKYLGVASSKL

SEQ ID NO: 11269 - DNA, 642 bp, Sorghum bicolor
  misc_feature: Ceres ANNOT ID no. 6006497
  misc_feature: Encodes the peptide sequence at SEQ ID NO 11270
atgatgcttctcgccaagctcggggcgccgagcgttccaggttgtgtgacggacagaaggaaattgctgttggtccctgcgattagtgtggctattggctcatttcagtacacttttttcaagggaacagcaaaagctgagtttgctgatatgcctgcacttcgaggtaaagattatggaaagacaaaaatgcggtatccagattacactgaaacggaatcaggcctccagtacaaggacttgcgggttggtgatggcccttctccaaaaaagggggagactgttgttgttgattgggatggctatacaattgggtactacggtcgtatctttgaagctcgaaacaagaccaaaggaggttcgtttgagggtggtgacaaagacttcttcaagttcaaagttggattaggacaggtcataccagcttttgaggaggctatatcaggcatggccccaggaggtgttaggaggatcattgtaccacccgatcttggatatccagataatgactacaacaagttgggtccaaaaccaacgacattctcgggacaaagagctcttgattttgttctacgtaatcaaggcttaatagataaaactctcttgtttgacatcgagcttctcaagataattccaaattaa

SEQ ID NO: 11270 - protein, 213 aa, Sorghum bicolor
  misc_feature: Ceres ANNOT ID no. 6006497
  misc_feature (84)..(208): Pfam Id: FKBP_C Pfam Desc: FKBP-type peptidyl-prolyl cis-trans isomerase
  misc_feature (51)..(210): NCBI GI: 145340673 NCBI Desc: peptidyl-prolyl cis-trans isomerase, fkbp-type [ostreococcus lucimarinus cce9901]
  misc_feature (69)..(207): NCBI GI: 145344355 NCBI Desc: peptidyl-prolyl cis-trans isomerase, fkbp-type [ostreococcus lucimarinus cce9901]
  misc_feature (72)..(166): NCBI GI: 119484326 NCBI Desc: fkbp-type peptidyl-prolyl cis-trans isomerase [lyngbya sp. pcc 8106]
  misc_feature (72)..(166): NCBI GI: 67924339 NCBI Desc: peptidylprolyl isomerase [crocosphaera watsonii wh 8501]
  misc_feature (70)..(166): NCBI GI: 113475169 NCBI Desc: peptidylprolyl isomerase [trichodesmium erythraeum ims101]
MMLLAKLGAPSVPGCVTDRRKLLLVPAISVAIGSFQYTFFKGTAKAEFADMPALRGKDYGKTKMRYPDYTETESGLQYKDLRVGDGPSPKKGETVVVDWDGYTIGYYGRIFEARNKTKGGSFEGGDKDFFKFKVGLGQVIPAFEEAISGMAPGGVRRIIVPPDLGYPDNDYNKLGPKPTTFSGQRALDFVLRNQGLIDKTLLFDIELLKIIPN

SEQ ID NO: 11271 - DNA, 1287 bp, Sorghum bicolor
  misc_feature: Ceres ANNOT ID no. 6006699
  misc_feature: Encodes the peptide sequence at SEQ ID NO 11272
atggaggcgcagtgggtcgtgattcccctgctacagcacctcctgctcttcgacggcgaccatctgccgccattcgacgccatcctccagtccctccgctcctccctcgcggcgaccctggccacccacgccccgctagccggcaagctccactacctcgcggacaccggcgacgtcgccatctgccgctccaccggcggcggcgacgacgacgacgacgaccgcggggtcaggttcgtcgccgcggagtgcgacgccgacgcccgccgcctcgcgggcgacgaggaccacgacgtgcacacgttcgagcgcctcgttccggagctcgacatgagcctgctgccggcgccggtgctcgccgtccaggcaacgcgtctcgcaggaggcggggtggcccttggggtcagcgtgcaccacggcgtcgccgacgggcaatcgctgtggaggttcatcgaggcgtgggccgcggcgtgccgcggcgacgcgccgcccgcgccgccggttttcgaccgctcccgtgtcagcctacctggcggcgaggaattggcccggagcatcctacggaactcccatgctctcctcgatcgccaccaggctagactgccggcaggcatgcaagaagaccgcctgcagttcacccgccggacgttcaccctggacactaacgacacgaagcggctgaagcagcgcatcgtcagcctcggcgaagcgcacggcgcgccgctgcgccgctccccgtccagcttcgtcgccgtcgtcgcgctggcctggacgtgcttcgtccgcggcaggggtttggccgcggacgacgaggacgtgttcctgttcttcttcgccgacgcccgcgaccggcttgaccctccggccggggcggactacttcggtgcctgcctgaccggatgcctggtgaggctgcccgcgcgggagctccacggcgagggggcgctggcgaccgcggcgtcggcggtgcagggagcgatcgagaagatggtggaggacccactcggttgccgtcccgggtgggagttctttaggttcgccggcgagccagggcttcggcttgaacggttcatgaacgtgtcgggttcgccgggcttcagggcgtacgaggtcgccgacttcgggtgggggagacccaggcggacggagaacatcaggatgaaccacgacgggcagctggcactgatgcgcgccagggacggcgacggggtgcaggcgtcggtgtccatgctccagcagaagcacgtggacgctttcaaatctgagttcctcaagctgctcggttga

SEQ ID NO: 11272 - protein, 428 aa, Sorghum bicolor
  misc_feature: Ceres ANNOT ID no. 6006699
  misc_feature (1)..(426): Pfam Id: Transferase Pfam Desc: Transferase family
  misc_feature (1)..(428): NCBI GI: 115460852 NCBI Desc: os04g0638100 [oryza sativa (japonica cultivar-group)]
  misc_feature (77)..(427): NCBI GI: 32492183 NCBI Desc: osjnbb0034i13.22 [oryza sativa (japonica cultivar-group)]
  misc_feature (2)..(424): NCBI GI: 115475015 NCBI Desc: os08g0174100 [oryza sativa (japonica cultivar-group)]
  misc_feature (2)..(425): NCBI GI: 115466378 NCBI Desc: os06g0145300 [oryza sativa (japonica cultivar-group)]
  misc_feature (76)..(427): NCBI GI: 57899019 NCBI Desc: acyltransferase -like [oryza sativa (japonica cultivar-group)]
MEAQWVVIPLLQHLLLFDGDHLPPFDAILQSLRSSLAATLATHAPLAGKLHYLADTGDVAICRSTGGGDDDDDDRGVRFVAAECDADARRLAGDEDHDVHTFERLVPELDMSLLPAPVLAVQATRLAGGGVALGVSVHHGVADGQSLWRFIEAWAAACRGDAPPAPPVFDRSRVSLPGGEELARSILRNSHALLDRHQARLPAGMQEDRLQFTRRTFTLDTNDTKRLKQRIVSLGEAHGAPLRRSPSSFVAVVALAWTCFVRGRGLAADDEDVFLFFFADARDRLDPPAGADYFGACLTGCLVRLPARELHGEGALATAASAVQGAIEKMVEDPLGCRPGWEFFRFAGEPGLRLERFMNVSGSPGFRAYEVADFGWGRPRRTENIRMNHDGQLALMRARDGDGVQASVSMLQQKHVDAFKSEFLKLLG

SEQ ID NO: 11273 - DNA, 2049 bp, Sorghum bicolor
  misc_feature: Ceres ANNOT ID no. 6006719
  misc_feature: Encodes the peptide sequence at SEQ ID NO 11274
atggcgtcgcggtcgcgcgatgacgattccgcgcatccaccgccgaagcggccccggcgcgatgccgaagcggaggcggacgccgcggagccatcgccgcgcgtggtgctcaacccggcagactgcgatctcgacttcgatgtcgacggtggcggtctccgggggagcgcgctgcacgagggcgggttcgcctactgctggtccggcgcgcgcgcgacggttggcgccaggggcggcgggcggtactgcttcgggtgcagaatcgtcgccgagcagccggtggagatggacctcacgacccccgaggagcgccacctctgccgcattggggtctcgagaggggatgatcccgtaggggtgctcggggagtcccagcacagcttcgggtttgggggcacggggaagttctcccaccagcgcaggttcgtcaactacggcgtcaagttcggggtcggggacacggtcgtctgcgccgtggacctcgattccaagcccatggcgtcgatcgggttcgcgaggaacggtgaatggcttggtatcgtgaggcattttgatgcgagtgagaaagggcttggtctggttgatgctcctctgaggccgatgcagtggggatccgcactctttccccatgtcctgctgaagaatgttgtcgtagagatgcagttcagcagagaggatgggctgctgccggttgatggttatgaaccctgggcctcggctgttactcatgggaattcagtatttggcccctcgtttgagcaaaataaatgtgaggtcatgatgatggttggtcttccggcctcaggcaagtcaacatgggcagagaagtgggtcaaggagcatcaggagaaacgttttatccttctgggaactaaccttgcattggagcaaatgaaggtgccaggattgttgcgtaagaataactatggtgagcgctttgatcgactgatggattgtgctacatggattttcaacaaattgctgactagggctgcaaacacccctcgcaacttcattattgatcaaacaaatgtttacaagaatgctcgtatccgcaagctgaggtcatttgctaactaccgcaagactgctgtggtcgtgttcccaactccaagtgaactgaaatccagggcagcaaagcgatttgatgagatgggaaaggaagtaccagctgaagcagttaatgaaatgatagccaattttgtcctaccactgtcaaaggacatgcctaattcgaaggagccttttgacaaggtaatcttcacagagctttctagggatgaggctcagagaaccctagatgaaatgcagcgtgtgttgccaagaattgtgaccccaagctatggaaattccagcaaccaaaatcatgctagttcaacatattctgggactgctgcttcacttgatcctagtgcaaggtcatcaatgccaggcttttacccaccagtggccaattcatatggagttgataccctacctagcagtgctgctactttcagcacaggtgtgtatactgcaggcaacacaacacatggacaggcatcacgcaatggtcgaagtttccagagtccaacaggaaaccaacatgaaatccgttcaggctatccaagtgctccaaaccaatatcagatgccctcaagctacctgagtaacccaaaccaatacgaagtccgtgcaagctacgaaagtacatcacttcctggatatggacagagtacatatggttcccataggaacccaagcccatacaaccctaatccttacaataccgagatgcaccaaagtagtcaggctcccatgagtagcaggaatctctaccaggcacctgggccagcagaagcctatagagcacctggctatgcagctgcaaatctgattgggaggccacatcaggtgtcatcaccatcaactcttccagcacatggcccacaaccagctgctcagtgggtgccaaatcaagatagttcttactcatggagttatgacagttacaggccgccgtactatggacaacagtctcatggttgcatgtcacttggttttgcctga

SEQ ID NO: 11274 - protein, 682 aa, Sorghum bicolor
  misc_feature: Ceres ANNOT ID no. 6006719
  misc_feature (79)..(226): Pfam Id: SPRY Pfam Desc: SPRY domain
  misc_feature (1)..(621): NCBI GI: 90265186 NCBI Desc: h0410g08.12 [oryza sativa (indica cultivar-group)]
  misc_feature (1)..(621): NCBI GI: 38344809 NCBI Desc: osjnba0043l09.29 [oryza sativa (japonica cultivar-group)]
  misc_feature (1)..(621): NCBI GI: 115460826 NCBI Desc: os04g0636000 [oryza sativa (japonica cultivar-group)]
  misc_feature (12)..(597): NCBI GI: 47086105 NCBI Desc: zgc:85971 [danio rerio]
  misc_feature (16)..(678): NCBI GI: 3319956 NCBI Desc: e1b-55kda-associated protein [homo sapiens]
MASRSRDDDSAHPPPKRPRRDAEAEADAAEPSPRVVLNPADCDLDFDVDGGGLRGSALHEGGFAYCWSGARATVGARGGGRYCFGCRIVAEQPVEMDLTTPEERHLCRIGVSRGDDPVGVLGESQHSFGFGGTGKFSHQRRFVNYGVKFGVGDTVVCAVDLDSKPMASIGFARNGEWLGIVRHFDASEKGLGLVDAPLRPMQWGSALFPHVLLKNVVVEMQFSREDGLLPVDGYEPWASAVTHGNSVFGPSFEQNKCEVMMMVGLPASGKSTWAEKWVKEHQEKRFILLGTNLALEQMKVPGLLRKNNYGERFDRLMDCATWIFNKLLTRAANTPRNFIIDQTNVYKNARIRKLRSFANYRKTAVVVFPTPSELKSRAAKRFDEMGKEVPAEAVNEMIANFVLPLSKDMPNSKEPFDKVIFTELSRDEAQRTLDEMQRVLPRIVTPSYGNSSNQNHASSTYSGTAASLDPSARSSMPGFYPPVANSYGVDTLPSSAATFSTGVYTAGNTTHGQASRNGRSFQSPTGNQHEIRSGYPSAPNQYQMPSSYLSNPNQYEVRASYESTSLPGYGQSTYGSHRNPSPYNPNPYNTEMHQSSQAPMSSRNLYQAPGPAEAYRAPGYAAANLIGRPHQVSSPSTLPAHGPQPAAQWVPNQDSSYSWSYDSYRPPYYGQQSHGCMSLGFA

SEQ ID NO: 11275 - DNA, 195 bp, Sorghum bicolor
  misc_feature: Ceres ANNOT ID no. 6006785
  misc_feature: Encodes the peptide sequence at SEQ ID NO 11276
atgtatctccagtactacatcaacgagaagggagacaaggtttacaccaccaagaaggagtcgcctcttggggtaccaacgcagtctgctcacccggctcgcttctcaccagatgacaagtactctcgccagaggtacctgttgaagaaaagatttgcacttctgccaacccagaagccagcaccgaagtactga

SEQ ID NO: 11276 - protein, 64 aa, Sorghum bicolor
  misc_feature: Ceres ANNOT ID no. 6006785
  misc_feature (3)..(53): Pfam Id: Nop10p Pfam Desc: Nucleolar RNA-binding protein, Nop10p family
  misc_feature (1)..(64): NCBI GI: 47847676 NCBI Desc: nucleolar rna-binding nop10p-like protein [oryza sativa (japonica cultivar-group)]
  misc_feature (1)..(64): NCBI GI: 79322535 NCBI Desc: nop10; rna binding [arabidopsis thaliana]
  misc_feature (1)..(64): NCBI GI: 24652542 NCBI Desc: cg7637-pa [drosophila melanogaster]
  misc_feature (1)..(64): NCBI GI: 55240537 NCBI Desc: ensangp00000015687 [anopheles gambiae str. pest]
  misc_feature (1)..(62): NCBI GI: 8923942 NCBI Desc: nucleolar protein family a, member 3 [homo sapiens]
MYLQYYINEKGDKVYTTKKESPLGVPTQSAHPARFSPDDKYSRQRYLLKKRFALLPTQKPAPKY

SEQ ID NO: 11277 - DNA, 390 bp, Sorghum bicolor
  misc_feature: Ceres ANNOT ID no. 6006791
  misc_feature: Encodes the peptide sequence at SEQ ID NO 11278
atggagatccagcaccacggcggggttggcaattcgaaggttgtgaaggttcagagccaggaggcatgggatctgttcaccgatcaagcaagcaaagaagggcgacctgttgttgctcattttggggcatcatggtgtgtgacgtccctgtccatgaactacaagtttgaagagcttgctcagacccaccctgaggtcttgttcctctacgtagacgttgatgatgtccagagtgtttcatccaagtacggagtgaaggcgatgccgacatttttcctcatcaagaacaaggaggtggtgagtaagatcgttggggcgaacccagatgaggtgaagaagctggtggacgcttctgctgaacccttccaaactcagattgtcgtggaatag

SEQ ID NO: 11278 - protein, 129 aa, Sorghum bicolor
  misc_feature: Ceres ANNOT ID no. 6006791
  misc_feature (13)..(118): Pfam Id: Thioredoxin Pfam Desc: Thioredoxin
  misc_feature (1)..(122): NCBI GI: 39546245 NCBI Desc: osjnba0089n06.15 [oryza sativa (japonica cultivar-group)]
  misc_feature (1)..(120): NCBI GI: 90399294 NCBI Desc: h0323c08.6 [oryza sativa (indica cultivar-group)]
  misc_feature (3)..(117): NCBI GI: 71533153 NCBI Desc: thioredoxin h [codonopsis lanceolata]
  misc_feature (1)..(126): NCBI GI: 4928460 NCBI Desc: thioredoxin h [hevea brasiliensis]
  misc_feature (12)..(116): NCBI GI: 4973262 NCBI Desc: thioredoxin-like 4 [arabidopsis thaliana]
MEIQHHGGVGNSKVVKVQSQEAWDLFTDQASKEGRPVVAHFGASWCVTSLSMNYKFEELAQTHPEVLFLYVDVDDVQSVSSKYGVKAMPTFFLIKNKEVVSKIVGANPDEVKKLVDASAEPFQTQIVVE

SEQ ID NO: 11279 - DNA, 1353 bp, Sorghum bicolor
  misc_feature: Ceres ANNOT ID no. 6006895
  misc_feature: Encodes the peptide sequence at SEQ ID NO 11280
atggaagagttacaagattgcaactcgaaatgcctggttgccctcccgggctctttggttctgcatctctttaggctgtttggccagcaggatcagagttcatggcagaagtacatactagcttactttctgttggtcaggaatgactacttctctggggagtcgaagaaacactcagatgtgttctgtgatatttcagaattagatttctttccatatgctacagatttggatagtgaagaacttgaactgaaggagcagaaacctatttcgaaggctcaatcaggaggtgattcaagtagcaacagatcaaatgattgctacttcccaggccttcatgatgacctgtctcaagactgccttgcttgggcaagcagatcagactacccttccctttcttgtctgaacaaaagattcaatttgttaattaacagtggatatctgtacaaactgagaaggaaatatggcatcgttgagcactgggtgtatctcgcttgtagcttgatgccctgggaagcatttgatcctttgcggaagcggtggatgaggctcccaagaatgccatgcgacgagtgcttctcctgtgcagataaggaatcacttgccgtcggaacacagctgcttgtctttggccgtgaatatactggccttgctatttggatgtacaacttactgactcgcagttggtccccatgcactccaatgaatctgccccgctgcctttttgcctcgggaagctcaggtgagattgctattgttgctggtgggtgtgataaggatggacaggtgctgagatctgttgagttgtacaactcagagattggccactgggagactatcccagacatgaacctgcccaggcggctctcttcaggtttcttcatggatggcaagttttacgttattgggggtgtatcgagtcagagggattcattgacttgtggagaggaatataaccttgaaacaaggacctggagaagaatacttgatatgtaccctggtggaaccagtgcatctcaatcgcctccccttgttgctgttgtgaataaccagctctatgctgctgatcagtcaacaaatgtggtcaagaagtatgacaaggtaaataacgcctggaacatagtgaagccattgcctgttagagctgactcatccaatggttggggtctagctttcaaggcttgtggcgatagattgctagtaattggagggcatagaggacctcgtggcgaggtaatactgctgcattcctggtgccccgaaggtggggaagatggtgctgactgggaggttctatcggtgaaggaacgtgcaggcgtcttcgtttacaactgtgcaataatggggtgctga

SEQ ID NO: 11280 - protein, 450 aa, Sorghum bicolor
  misc_feature: Ceres ANNOT ID no. 6006895
  misc_feature (238)..(284): Pfam Id: Kelch_1 Pfam Desc: Kelch motif
  misc_feature (286)..(332): Pfam Id: Kelch_1 Pfam Desc: Kelch motif
  misc_feature (238)..(284): Pfam Id: Kelch_2 Pfam Desc: Kelch motif
  misc_feature (1)..(450): NCBI GI: 38344328 NCBI Desc: osjnba0058k23.10 [oryza sativa (japonica cultivar-group)]
  misc_feature (1)..(450): NCBI GI: 90399335 NCBI Desc: h0313f03.20 [oryza sativa (indica cultivar-group)]
  misc_feature (1)..(450): NCBI GI: 5679844 NCBI Desc: l1332.8 [oryza sativa (indica cultivar-group)]
  misc_feature (1)..(450): NCBI GI: 115460594 NCBI Desc: os04g0619300 [oryza sativa (japonica cultivar-group)]
  misc_feature (102)..(450): NCBI GI: 92870610 NCBI Desc: cyclin-like f-box; serine/threonine protein phosphatase, bsu1 [medicago truncatula]
  misc_feature: The sequence is a functional homolog of SEQ ID NO. 315 in the 11/188,298 US application
  misc_feature: The sequence is a functional homolog of SEQ ID NO. 440 in the 11/188,298 US application
MEELQDCNSKCLVALPGSLVLHLFRLFGQQDQSSWQKYILAYFLLVRNDYFSGESKKHSDVFCDISELDFFPYATDLDSEELELKEQKPISKAQSGGDSSSNRSNDCYFPGLHDDLSQDCLAWASRSDYPSLSCLNKRFNLLINSGYLYKLRRKYGIVEHWVYLACSLMPWEAFDPLRKRWMRLPRMPCDECFSCADKESLAVGTQLLVFGREYTGLAIWMYNLLTRSWSPCTPMNLPRCLFASGSSGEIAIVAGGCDKDGQVLRSVELYNSEIGHWETIPDMNLPRRLSSGFFMDGKFYVIGGVSSQRDSLTCGEEYNLETRTWRRILDMYPGGTSASQSPPLVAVVNNQLYAADQSTNVVKKYDKVNNAWNIVKPLPVRADSSNGWGLAFKACGDRLLVIGGHRGPRGEVILLHSWCPEGGEDGADWEVLSVKERAGVFVYNCAIMGC

SEQ ID NO: 11281 - DNA, 1185 bp, Sorghum bicolor
  misc_feature: Ceres ANNOT ID no. 6007077
  misc_feature: Encodes the peptide sequence at SEQ ID NO 11282
atggcggcgtcccgggcatggctggcccgtgccacggcggcggcggtgctgggtttcgtcctggtggtggcgtcagctgaggcggcatcgggggacgtggagatggtgttcctcaaggccgcagtggccaaaggtgcagtgtgcttggacggcagcccaccggtttaccacttctctcccggctctggttctggcgccgataactgggtggttcacatggagggaggagggtggtgcaggaatcctgatgaatgtgcagtccggaagggcaacttcaggggctcctccaaatttatgagaccactctcattttcagggatattaggcggcagccaaaaatccaatcctgatttctacaactggaatagaataaaggtcagatactgtgatggttcatcatttactggtgacgttgaggctgtggacactgcgaaaaatctccattacagagggttcagagtttggcgtgccatcatggatgatctacttactgtgaggggaatgaacaaggcaaaatacgctcttctttctggatgttcagccgggggtctagcagcaatactacattgtgataggttccgtgatctgtttccagcgacaacaaaggtcaagtgtttttctgatgctggatattttttcgatgggaaggatatctctgggaactattacgccaggtcaatctataagaacgttgtgaatctacatggatcagccaaaaatttaccagcttcatgtacctcaaagcaacctgagctgtgtatgttcccacagtacgtagtaccgacaatgcgtacaccattgttcatacttaatgcagcctatgattcatggcaggtcaagaacgtcctagcacctagtccagctgatccgaagaagacttgggcccaatgcaaacttgatatcaagagctgctcccccagccaactcacaaccttgcagaatttcaggacagactttctggcagcacttcctaaaactccatctgtaggcatgttcatcgactcatgcaatgctcattgccaatcaggatctcaagatacatggctagccgatggttctcccacggttaataagacgcaaattggcaaggcagtgggggactggtacttcgacagggaggtctctcggcagattgattgcccgtatccctgcaacccaacttgcaagaaccgtgaggatgactga

SEQ ID NO: 11282 - protein, 394 aa, Sorghum bicolor
  misc_feature: Ceres ANNOT ID no. 6007077
  misc_feature (15)..(378): Pfam Id: PAE Pfam Desc: Pectinacetylesterase
  misc_feature (1)..(394): NCBI GI: 38344147 NCBI Desc: osjnba0041a02.14 [oryza sativa (japonica cultivar-group)]
  misc_feature (1)..(394): NCBI GI: 115460346 NCBI Desc: os04g0602500 [oryza sativa (japonica cultivar-group)]
  misc_feature (1)..(394): NCBI GI: 116310929 NCBI Desc: b0403h10-osigba0105a11.19 [oryza sativa (indica cultivar-group)]
  misc_feature (20)..(391): NCBI GI: 1431629 NCBI Desc: pectinacetylesterase precursor [vigna radiata var. radiata]
  misc_feature (20)..(388): NCBI GI: 21593445 NCBI Desc: pectin acetylesterase [arabidopsis thaliana]
  misc_feature: Useful for making plants with altered cell wall content and/or composition
  misc_feature: GREAT-hit functional homolog of the protein sequence encoded by LOCUS at4g19410
  misc_feature: Functional homolog of the protein sequence encoded by LOCUS at5g45280
  misc_feature: Useful for making plants with altered cell wall content and/or composition
  misc_feature: Functional homolog of the protein sequence given in SEQ ID NO 13669
  misc_feature: Useful for making plants with altered carbohydrate content
  misc_feature: Functional homolog of the protein sequence given in SEQ ID NO 13670
MAASRAWLARATAAAVLGFVLVVASAEAASGDVEMVFLKAAVAKGAVCLDGSPPVYHFSPGSGSGADNWVVHMEGGGWCRNPDECAVRKGNFRGSSKFMRPLSFSGILGGSQKSNPDFYNWNRIKVRYCDGSSFTGDVEAVDTAKNLHYRGFRVWRAIMDDLLTVRGMNKAKYALLSGCSAGGLAAILHCDRFRDLFPATTKVKCFSDAGYFFDGKDISGNYYARSIYKNVVNLHGSAKNLPASCTSKQPELCMFPQYVVPTMRTPLFILNAAYDSWQVKNVLAPSPADPKKTWAQCKLDIKSCSPSQLTTLQNFRTDFLAALPKTPSVGMFIDSCNAHCQSGSQDTWLADGSPTVNKTQIGKAVGDWYFDREVSRQIDCPYPCNPTCKNREDD

SEQ ID NO: 11283 - DNA, 558 bp, Sorghum bicolor
  misc_feature: Ceres ANNOT ID no. 6007143
  misc_feature: Encodes the peptide sequence at SEQ ID NO 11284
atgaaagggagccttagccacgagtttgagactggactcccagctgccgacgtgtgggaggtctatggaggtctccttgttggggatctgattccccaattgcttcctcaagtgttctcaaaggttgaacttgtagagggagatggtggcgttggaactgttctgcttgtcactttcccgccaggaactcctggatcagaagctttcaaagaagagttcatcaaggtcgataatgaaaactgcatcaaggaggtcctagtaactgaaggaagctttctagaccatggctttaagaagtacttggtacgaatcgagatcataggaaaagaacagaagacatccaccataagatcaaccattgaatatgaagttgatccagagcatgcaagcaacccccctgttgtcagtaccagtggtttagctactattgctaagagggagatggcggtgctggatcagtcctgcttattaccttccctccaggaactcctggatcagaaactttcaaagaaaagttcatcaaggtcgataatgaaaactacatcaaggagacaatag

SEQ ID NO: 11284 - protein, 185 aa, Sorghum bicolor
  misc_feature: Ceres ANNOT ID no. 6007143
  misc_feature (1)..(153): Pfam Id: Bet_v_I Pfam Desc: Pathogenesis-related protein Bet v I family
  misc_feature (1)..(145): NCBI GI: 58532137 NCBI Desc: osjnba0009p12.26 [oryza sativa (japonica cultivar-group)]
  misc_feature (1)..(145): NCBI GI: 116311047 NCBI Desc: osigba0142i02-osigba0101b20.21 [oryza sativa (indica cultivar-group)]
  misc_feature (1)..(146): NCBI GI: 58532136 NCBI Desc: osjnba0009p12.25 [oryza sativa (japonica cultivar-group)]
  misc_feature (1)..(146): NCBI GI: 116311046 NCBI Desc: osigba0142i02-osigba0101b20.20 [oryza sativa (indica cultivar-group)]
  misc_feature (5)..(144): NCBI GI: 38492394 NCBI Desc: (s)-norcoclaurine synthase [thalictrum flavum subsp. glaucum]
MKGSLSHEFETGLPAADVWEVYGGLLVGDLIPQLLPQVFSKVELVEGDGGVGTVLLVTFPPGTPGSEAFKEEFIKVDNENCIKEVLVTEGSFLDHGFKKYLVRIEIIGKEQKTSTIRSTIEYEVDPEHASNPPVVSTSGLATIAKREMAVLDQSCLLPSLQELLDQKLSKKSSSRSIMKTTSRRQ

SEQ ID NO: 11285 - DNA, 1197 bp, Sorghum bicolor
  misc_feature: Ceres ANNOT ID no. 6007204
  misc_feature: Encodes the peptide sequence at SEQ ID NO 11286
atgtcctcctcctcctccacctcctcctccctgtctctacagccgcctcccgccggtgcaatcggcggcacttccccctactccgcgtccacgtctttcctcccctcgttcatgatcatcgccgcgctgctcgccttcgtgttcctcgcctccgtctccatccacctcctgctccgcttcctctccgaccgctcctcctcgtcgtcgtcgtctggacctccgctcccgcggacccaccgcgacgaagcgggctcggcggggagtacgatggacgcgtcgtccgcggcgaggcctgccgctaccgcggctgctccagccgacgcagcgaacaaggaggcggcggcgggcgacaacgagaagcagcggctgatcgactcgctgccgctgttcacgatggcgtcgtcgctggcggagctccccaagagctcgcccgactgcgccgtctgcctgacgctgttcacgccagacgccgagctgaggctgatgcccgcgagccgccgcaagttctacgcagcgtgcgtcgacgcctggctgcgcaccacgccgtcctgcccgctctgccgcgccgccgtcgtcgcgttcccgcacccctcgctctccgccatgctcgccgccgcgcagcagcagcggccggcgtcgccgaggaccagggacccgcggtccgggtcgagcttcctcgtcgagatgggcaccgtcagcagcagccgcggctcgcccgtggcggccggcggcggtggcggggacaggaacaggaacagccgcacctactcgctcggctctttcgactaccaaatcgacgaggaggtggaagccgtggtgtcccgcgtcgcgcgcatcaccgcgagggaatccagcaccgtcaaggaggagatggagaagccttcgggtgaagaggtgtcggcacggccgccggcgccggcgccgtctccgccgcctccaggcgagacggtggccgaggcggcgggctcctcgcgcgggtggctgcgggagtacgtggaccggctggcgtcgtccgcctacacgttgtcggagcggtggagctcccgctggagccaggggcagagccagcagcagcggcaggaagagccgtggctgtgggacacggaggccgcggacatgtcggcggcgccggggtccgacgaggaggaggaggagacggcgttcatggtgatgtaccgctggatcgccggggtgtaa

SEQ ID NO: 11286 - protein, 398 aa, Sorghum bicolor
  misc_feature: Ceres ANNOT ID no. 6007204
  misc_feature (5)..(364): NCBI GI: 32488757 NCBI Desc: osjnbb0016d16.1 [oryza sativa (japonica cultivar-group)]
  misc_feature (123)..(300): NCBI GI: 144923183 NCBI Desc: zinc finger, ring-type [medicago truncatula]
  misc_feature (123)..(300): NCBI GI: 23451086 NCBI Desc: ring-h2 protein [medicago sativa]
  misc_feature (94)..(274): NCBI GI: 3790591 NCBI Desc: ring-h2 finger protein rhx1a [arabidopsis thaliana]
  misc_feature (15)..(268): NCBI GI: 49389042 NCBI Desc: ring finger 1 [oryza sativa (japonica cultivar-group)]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13153
  misc_feature: Functional homolog of the protein sequence given in SEQ ID NO 13535
  misc_feature: Useful for making plants with modulated flowering time
  misc_feature: Functional homolog of the protein sequence given in SEQ ID NO 13153
  misc_feature: The sequence is a functional homolog of SEQ ID NO. 329 in the 11/188,298 US application
MSSSSSTSSSLSLQPPPAGAIGGTSPYSASTSFLPSFMIIAALLAFVFLASVSIHLLLRFLSDRSSSSSSSGPPLPRTHRDEAGSAGSTMDASSAARPAATAAAPADAANKEAAAGDNEKQRLIDSLPLFTMASSLAELPKSSPDCAVCLTLFTPDAELRLMPASRRKFYAACVDAWLRTTPSCPLCRAAVVAFPHPSLSAMLAAAQQQRPASPRTRDPRSGSSFLVEMGTVSSSRGSPVAAGGGGGDRNRNSRTYSLGSFDYQIDEEVEAVVSRVARITARESSTVKEEMEKPSGEEVSARPPAPAPSPPPPGETVAEAAGSSRGWLREYVDRLASSAYTLSERWSSRWSQGQSQQQRQEEPWLWDTEAADMSAAPGSDEEEEETAFMVMYRWIAGV

SEQ ID NO: 11287 - DNA, 1332 bp, Sorghum bicolor
  misc_feature: Ceres ANNOT ID no. 6007243
  misc_feature: Encodes the peptide sequence at SEQ ID NO 11288
atggctcgttttcaggcgaggaacgatcaaagtcctgctgcagatcacgttggccatgggaacttcatggatcatcatctgaagaacactctgaactgcggcgaactggacttgccaggaggagcgcgagcccctaaggcacgcaagccatacacgatatccaaacagagggagaaatggaccgaggacgagcacaagctcttcttggaagccctccagcagcacggccgtgcctggcgccgtatacaagagcacataggcagtaagactgccgtgcaaatcaggagccacgctcagaagttcttctccaaggtcatccgagaatcctctggggatagcaacagcatagctgctccaccgcaaattcagattccgccgccacggcccaagaggaggccaacacacccgtacccgcgcaagctgggtaattcagtcggcaagggtgcctctgcgatcaaacagcttcagaagcccctgctgcagacacaatccctgtctgagcaggagaattgctcaccaaaatctgtgttatccacagcacagatagactccgacaccctgcaaactgaaggtagtggatcaccagcttcctcggtttacatggaggacaaatgcctcacaccaagcacatcagtagcactttccaaggatgccaccacttccaacgatgtggcatgtgaaatacctgaaggtccagttcttaggctatttggcaagagggttgtggttaataatttagatcagcagccaagctccaatactgggagtctacaacacgtggcagacatggaactggatgcttcagctgagacaccaactggtggaactggggagttgccttcccatgttgcagaagaagcaaagacatggtgcccgtggctgaccggtacacagcagattatgtactatcttcctcaaggagaggtgttctctatgcattctgcttgccaattcctcaactatggtaatggaagcatatcttacgtagtgttgaaccaacagacagttgcctcaaataagcagcagaaccaaccatctcaagttccacacagcaaggtcacgagggcagaaggatcatggacggagtcgatcacaacctccagcagtgtggctgaaacaactcagaattcagattctatagaatctacgaaagtaaacaacgatgaagacaaagtggtacctgttccaggttcaaggaaatgtgcaagcacagttccagcctgccttcgaggttttgtaccatacaagaagtgcacagctcaaagcaagatgctgcagccagaggcaactggggaggaggcagatagagagatgacaaggctgtgcctgtaa

SEQ ID NO: 11288 - protein, 443 aa, Sorghum bicolor
  misc_feature: Ceres ANNOT ID no. 6007243
  misc_feature (57)..(102): Pfam Id: Myb_DNA-binding Pfam Desc: Myb-like DNA-binding domain
  misc_feature (1)..(396): NCBI GI: 38346813 NCBI Desc: osjnba0088a01.20 [oryza sativa (japonica cultivar-group)]
  misc_feature (11)..(236): NCBI GI: 140067648 NCBI Desc: homeodomain-related [medicago truncatula]
  misc_feature (24)..(443): NCBI GI: 110931734 NCBI Desc: myb transcription factor myb177 [glycine max]
  misc_feature (49)..(227): NCBI GI: 110931762 NCBI Desc: myb transcription factor myb174 [glycine max]
  misc_feature (40)..(443): NCBI GI: 92875145 NCBI Desc: homeodomain-related [medicago truncatula]
  misc_feature: The sequence is a functional homolog of SEQ ID NO 12 in the 10/225,066US patent application
  misc_feature: The sequence is a functional homolog of SEQ ID NO 1889 in the 11/479,226US patent application
  misc_feature: The sequence is a functional homolog of SEQ ID NO 2676 in the 10/374,780US patent application
  misc_feature: Useful for making plants with modulated growth and phenotype characteristics
  misc_feature: The sequence is a functional homolog of SEQ ID NO 12 in the 20050160493 US patent application
  misc_feature: The sequence is a functional homolog of SEQ ID NO. 514 in the 11/188,298 US application
MARFQARNDQSPAADHVGHGNFMDHHLKNTLNCGELDLPGGARAPKARKPYTISKQREKWTEDEHKLFLEALQQHGRAWRRIQEHIGSKTAVQIRSHAQKFFSKVIRESSGDSNSIAAPPQIQIPPPRPKRRPTHPYPRKLGNSVGKGASAIKQLQKPLLQTQSLSEQENCSPKSVLSTAQIDSDTLQTEGSGSPASSVYMEDKCLTPSTSVALSKDATTSNDVACEIPEGPVLRLFGKRVVVNNLDQQPSSNTGSLQHVADMELDASAETPTGGTGELPSHVAEEAKTWCPWLTGTQQIMYYLPQGEVFSMHSACQFLNYGNGSISYVVLNQQTVASNKQQNQPSQVPHSKVTRAEGSWTESITTSSSVAETTQNSDSIESTKVNNDEDKVVPVPGSRKCASTVPACLRGFVPYKKCTAQSKMLQPEATGEEADREMTRLCL

SEQ ID NO: 11289 - DNA, 444 bp, Sorghum bicolor
  misc_feature: Ceres ANNOT ID no. 6007244
  misc_feature: Encodes the peptide sequence at SEQ ID NO 11290
atggcgagcgctcacgccagttttgccctcaccatcgctgcttccagaagcttcagcttcactatcgtgccatgcccctccccatcgcccacgcatcgtccggccgcctcctccgttggggtacgcaaccagcagcgcgcgtccactgccatggcctgcctccagcagccgagtgcttcccacgacgccgccaccaggctgtacgtcagcggtctttcgttccgcaccaccgaacggagcctccggggcgcgtttgagaagtttggtgaccttacggaagtttgtctcgtgatggatagagtagcgaaccgaccgagaggtttcgctttcctttcttacaccgaggaggaggaagccaggggcgccatggaaggaatgcacgggaagttcctggatggccgagtaatctttgtcgaggttgccaaacgaagacctggagcctga

SEQ ID NO: 11290 - protein, 147 aa, Sorghum bicolor
  misc_feature: Ceres ANNOT ID no. 6007244
  misc_feature (67)..(138): Pfam Id: RRM_1 Pfam Desc: RNA recognition motif. (a.k.a. RRM, RBD, or RNP domain)
  misc_feature (59)..(145): NCBI GI: 140052883 NCBI Desc: rna-binding region rnp-1 (rna recognition motif) [medicago truncatula]
  misc_feature (66)..(144): NCBI GI: 46390865 NCBI Desc: rna recognition motif (rrm)-containing protein-like [oryza sativa (japonica cultivar-group)]
  misc_feature (66)..(146): NCBI GI: 28173040 NCBI Desc: hyperosmotic glycine rich protein [salmo salar]
  misc_feature (66)..(144): NCBI GI: 92897903 NCBI Desc: rna-binding region rnp-1 (rna recognition motif) [medicago truncatula]
  misc_feature (33)..(144): NCBI GI: 38346331 NCBI Desc: oj000126_13.13 [oryza sativa (japonica cultivar-group)]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO. 458 in the 11/188,298 US application
MASAHASFALTIAASRSFSFTIVPCPSPSPTHRPAASSVGVRNQQRASTAMACLQQPSASHDAATRLYVSGLSFRTTERSLRGAFEKFGDLTEVCLVMDRVANRPRGFAFLSYTEEEEARGAMEGMHGKFLDGRVIFVEVAKRRPGA

SEQ ID NO: 11291 - DNA, 1170 bp, Sorghum bicolor
  misc_feature: Ceres ANNOT ID no. 6007347
  misc_feature: Encodes the peptide sequence at SEQ ID NO 11292
atggcgaccgccaccaccacacccaaccccaaggcgacgacgacaagggccaggagggagccgctgcgtccgcggagcaacaactccgccgcgtccccgtctccggccgtggcgagcgccaggcgcgggccggcggcgtccgcggagaaggagaaccagcggcccaagagcctcggccacgggaagaaggaggaggggaagacggcggcgctccgcatgaaggacgaggcggccgaggcagcggctgctgcgcaggcgccgcccgcgttcgttgtcgggcccaggggcagggagctgctgctcccgccgccgtcgtccaactacgaggcgtgggacctctccgacagcgagtccgcgccggcctcctcctgggccacgctccccaacagggcgctgctgtgccggcctctgccacaggacgtcggccggtgcacgtgcgtcatcgtcagggaggcggccaccggcgccagaggcgtcgcgctctactccctctacaccaacgaggggcagggccggcaggaccgcaagctggcggtggcgcggcaccggaggcggaggggaaggtccgagttcatcgtggcgcagaaccaggacggcatcttctgcaccgccgacaacaacttcctcggcacggtgggcgccaacctggtcggatccaagtaccaaatctggggccagggggggagccgagcggacgagctgaacaaccaggcgaagcggcttcttggcgttgtcgcgtttgcacccaccatcaccacgctcaccgggagtttcagaagcatgagggcatggatccccaagaaccagtccatgcagctcaagaccaacaattctgctcagattcagcatgtcagtgggctcccaaaggattggcaggagaagaagagcagagctgaccagttgtgctcaagagccccattctacaaccatatgacaaagcgctacgagctggacttcagagagagggcaggaaggatggggtataaggtgcaaacatcggtcaagaattttcagatgactttggaggaaaatgggaggcagactgtgttgcagcttggtagggttgggaaatccaagtacataatggacttcaggtacccgctgaccggctatcaagcgttctgcatttgcctggcatcgatcgacgcaaagctgtgctgcaccctgtga

SEQ ID NO: 11292 - protein, 389 aa, Sorghum bicolor
  misc_feature: Ceres ANNOT ID no. 6007347
  misc_feature (136)..(382): Pfam Id: Tub Pfam Desc: Tub family
  misc_feature (33)..(389): NCBI GI: 50252078 NCBI Desc: tubby protein-like [oryza sativa (japonica cultivar-group)]
  misc_feature (105)..(389): NCBI GI: 6587813 NCBI Desc: contains similarity to gi1171967 phosphodiesterase from mus musculus and is a member of the pf01167 tub family. [arabidopsis thaliana]
  misc_feature (117)..(387): NCBI GI: 119624244 NCBI Desc: tubby like protein 1, isoform cra_a [homo sapiens]
  misc_feature (117)..(387): NCBI GI: 21619193 NCBI Desc: tulp1 protein [homo sapiens]
  misc_feature (135)..(387): NCBI GI: 60593459 NCBI Desc: chain a, crystal structure analysis of the human tub protein (isoform a) spanning residues 289 through 561
MATATTTPNPKATTTRARREPLRPRSNNSAASPSPAVASARRGPAASAEKENQRPKSLGHGKKEEGKTAALRMKDEAAEAAAAAQAPPAFVVGPRGRELLLPPPSSNYEAWDLSDSESAPASSWATLPNRALLCRPLPQDVGRCTCVIVREAATGARGVALYSLYTNEGQGRQDRKLAVARHRRRRGRSEFIVAQNQDGIFCTADNNFLGTVGANLVGSKYQIWGQGGSRADELNNQAKRLLGVVAFAPTITTLTGSFRSMRAWIPKNQSMQLKTNNSAQIQHVSGLPKDWQEKKSRADQLCSRAPFYNHMTKRYELDFRERAGRMGYKVQTSVKNFQMTLEENGRQTVLQLGRVGKSKYIMDFRYPLTGYQAFCICLASIDAKLCCTL

SEQ ID NO: 11293 - DNA, 552 bp, Sorghum bicolor
  misc_feature: Ceres ANNOT ID no. 6007366
  misc_feature: Encodes the peptide sequence at SEQ ID NO 11294
atggcctcgcccgctccagccccgggaccggcgggaagagaagccaagcacagcgggcgcgccgccgccgccgtcccgcgccaccaccggcagtgcgccggcgcgcgccggctcctgtcgctcgccgtgcaggcgggcgtgatggcggcggcgctcgcggtcttcgtcctcttcgccgcggcctccgccttgctcctcctcgtcctcgtcctcgccgcgcgcgccttccgccaccaccgcggcagccgctaccgcgtcccgtcgctcgaccctccgcctccgcctctccacgcggggctctcgcccgccgacatccaccgcatcccaagcttcgccttccccggcggcggcggcgaggccgactcctccgcctcgtcgtgcgccgtgtgcctcgaggccgcgcgcgcaggggagcggtggcgtgcgatgccggcatgcacgcacgcgttccacgccgcctgcgtcgaccggtggctcgccaggacgcccgcctgccccgtctgccgcgccaccgtcgccgtcgccgtccccgtcccgacgagccaaggctga

SEQ ID NO: 11294 - protein, 183 aa, Sorghum bicolor
  misc_feature: Ceres ANNOT ID no. 6007366
  misc_feature (127)..(168): Pfam Id: zf-C3HC4 Pfam Desc: Zinc finger, C3HC4 type (RING finger)
  misc_feature (47)..(181): NCBI GI: 20160754 NCBI Desc: p0503c12.20 [oryza sativa (japonica cultivar-group)]
  misc_feature (128)..(175): NCBI GI: 115444597 NCBI Desc: os02g0178600 [oryza sativa (japonica cultivar-group)]
  misc_feature (99)..(181): NCBI GI: 115435246 NCBI Desc: os01g0213000 [oryza sativa (japonica cultivar-group)]
  misc_feature (105)..(177): NCBI GI: 32488757 NCBI Desc: osjnbb0016d16.1 [oryza sativa (japonica cultivar-group)]
  misc_feature (42)..(179): NCBI GI: 115480585 NCBI Desc: os09g0554200 [oryza sativa (japonica cultivar-group)]
  misc_feature: The sequence is a functional homolog of SEQ ID NO. 329 in the 11/188,298 US application
MASPAPAPGPAGREAKHSGRAAAAVPRHHRQCAGARRLLSLAVQAGVMAAALAVFVLFAAASALLLLVLVLAARAFRHHRGSRYRVPSLDPPPPPLHAGLSPADIHRIPSFAFPGGGGEADSSASSCAVCLEAARAGERWRAMPACTHAFHAACVDRWLARTPACPVCRATVAVAVPVPTSQG

SEQ ID NO: 11295 - DNA, 1563 bp, Sorghum bicolor
  misc_feature: Ceres ANNOT ID no. 6007432
  misc_feature: Encodes the peptide sequence at SEQ ID NO 11296
  misc_feature: Up-regulated in shoot tissues in response to salicylic acid treatment
atggcgatggcgatgatgactctgcgacgcgcggtggcgctcggtgcccgacacatccccgccgtcgcagccgcttcctcccgcatcgtccccctccgacacatgagcgcgggcgcgggcgccgcggtggagaagatccgcgccgccgggctgctcaggacgcaggggctcatcgccgggaagtgggtggacgcctacgacgggaagaccatcgaggtgcaaaatccagcaactggtgaggtccttgcaaacgtgccctgtatgggcagcagagaaacatctgatgctattgcttctgctcacagtacattctattgtgagaggagcaaggcactaagaaaatggtacgatctaattatttcacacaaggaagagcttgcacttctcatgacactggagcaggggaaacctatgaaagaagccctgggtgaggtcaattatggtgcaagtttcatagaatattttgcagaggaagcaaagcgtatatatggtgatatcattcccccaactttatctgatcgcagattgttggttctgaagcagcctgttggggtagttggagctattacaccatggaattttccattagcaatgataacccgaaaggttggaccagctttggcgtgtggctgcactgttgttgtcaagccatcagagttcacccctctgacagcattagctgcagcagatcttgctcttcaagctggaataccagcgggtgcactaaatgttgtgatgggtaatgctcctgagataggtgatgcattactgcagagtacacaggtcagaaagattacgttcactggatcaacagctgttggcaaaaaactgatggctggatctgcaaatactgtgaaaaaggtctccttggaacttggtgggaatgcaccttgcattgttttcgatgatgcagacattgatgttgctgttaaaggcagtcttgctgccaagttccgtaacagtggacagacatgtgtttgtgcaaacaggatattggtgcaagaaggtatctacgaaaagtttgcaactgcattcatcaaggctgttcagagtttgaaggttgggaatgggctagaagagagtacatctcagggtcctctgattaacgaagctgctgttcagaaggtggagaagttcataaatgacgcgacttcaaagggagcaaatatcatgctaggtggtaaaagacacagcctggggatgacattttatgagccaactgtagtagggaatgtcagcaatgatatgcttcttttcagagaagaagtttttggtccagttgcaccccttataccattcaaaactgaggaagaagcagtccatatggccaacgatacaaacgcaggcttagctgcatacatatttaccaagagcatacctcgttcatggcgtgtatctgaatctcttgaatacggcttagttggggtaaacgagggaattatttcaacagaggtggcaccatttggtggagtaaagcagtctggtctagggagggaaggttcgaagtacggcatcgacgaatacttggagctcaagtacatctgcatgggaaacttgggttga

SEQ ID NO: 11296 - protein, 520 aa, Sorghum bicolor
  misc_feature: Ceres ANNOT ID no. 6007432
  misc_feature (62)..(514): Pfam Id: Aldedh Pfam Desc: Aldehyde dehydrogenase family
  misc_feature (107)..(519): NCBI GI: 4835765 NCBI Desc: is a member of the pf00171 aldehyde dehydrogenase family. ests gbt21534, gbn65241 and gbaa395614 come from this gene. [arabidopsis thaliana]
  misc_feature (45)..(519): NCBI GI: 119898211 NCBI Desc: probable succinate-semialdehyde dehydrogenase [nad(p)+] [azoarcus sp. bh72]
  misc_feature (46)..(519): NCBI GI: 23014760 NCBI Desc: cog1012: nad-dependent aldehyde dehydrogenases [magnetospirillum magnetotacticum ms-1]
  misc_feature (51)..(517): NCBI GI: 67153969 NCBI Desc: aldehyde dehydrogenase [azotobacter vinelandii avop]
  misc_feature (51)..(519): NCBI GI: 34105233 NCBI Desc: succinate-semialdehyde dehydrogenase [nad(p)] [chromobacterium violaceum atcc 12472]
  misc_feature (33)..(519): SWISSPROT Homolog: EC 1.2.1.24 Succinate semialdehyde dehydrogenase, mitochondrial precursor
  misc_feature (45)..(517): SWISSPROT Homolog: EC 1.2.1.16 Succinate-semialdehyde dehydrogenase [NADP+]
  misc_feature: Up-regulated in shoot tissues in response to salicylic acid treatment
  misc_feature: The sequence is a functional homolog of SEQ ID NO. 537 in the 11/188,298 US application
  misc_feature: The sequence is a functional homolog of SEQ ID NO. 442 in the 11/188,298 US application
  misc_feature: The sequence is a functional homolog of SEQ ID NO. 475 in the 11/188,298 US application
  misc_feature: The sequence is a functional homolog of SEQ ID NO. 428 in the 11/188,298 US application
  misc_feature: The sequence is a functional homolog of SEQ ID NO. 437 in the 11/188,298 US application
  misc_feature: The sequence is a functional homolog of SEQ ID NO. 304 in the 11/188,298 US application
  misc_feature: The sequence is a functional homolog of SEQ ID NO. 477 in the 11/188,298 US application
  misc_feature: The sequence is a functional homolog of SEQ ID NO. 435 in the 11/188,298 US application
MAMAMMTLRRAVALGARHIPAVAAASSRIVPLRHMSAGAGAAVEKIRAAGLLRTQGLIAGKWVDAYDGKTIEVQNPATGEVLANVPCMGSRETSDAIASAHSTFYCERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAPEIGDALLQSTQVRKITFTGSTAVGKKLMAGSANTVKKVSLELGGNAPCIVFDDADIDVAVKGSLAAKFRNSGQTCVCANRILVQEGIYEKFATAFIKAVQSLKVGNGLEESTSQGPLINEAAVQKVEKFINDATSKGANIMLGGKRHSLGMTFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 11297 - DNA, 1782 bp, Sorghum bicolor
  misc_feature: Ceres ANNOT ID no. 6007468
  misc_feature: Encodes the peptide sequence at SEQ ID NO 11298
atgctaagtgttgaggctcatacatattactggattgcaaggccgagatggaaattatgtgcctgcagaaacgtcttgcaagaaacagccttacatgacgcagaagtaaattcctaccgccatagtgagaggaagaacaggaaaagggacggcgcttacattgacaaagatggcgtagcaagaaccttcgaccgaaagaaaatatctagaaagagggggggtgctatcaaaggccgtggttggaagtacggctctgggtttgttgatggagtgttcccagtgttgagtccaatggcgcaggatatcctagaatttgtgcagaaggggaccgacgtcaccaatatctgggaatcactggacaaaattcctcaagcacacgatctttgggatgacattgtcaatgttgcagtccagctccgcctgaaccgacaatgggagccgatcatcacagtctgtgagtggatcctgtaccggagttcgttccgtcctgacataatctgctacaacctgctcatagatgcatatggtcagaagcgtcagctgaacaaggcagaatcgatttacatggctcttctggaggctcactgtgtgcccacagaggacacttatgctcttctactgcgtgcttactgcaattctggacagttgcaccgagccgagggcgtgatttcagaaatgcagaagaatgggctccctccaactgcaactgtgtataacgcatacctggatggtctactgaaggcaagatgttccgaaaaggcggttgaagtgtatcaaaggatgaagaaggagcgctgcagaacaaacaccgagacctacaccctgatgatcaacgtgtatgggaaggcaaagcaaccgatgtcatcgctgaaagtgttcaacgagatgaaaacgattgggtgcaagcccaacatctgcacctacactgccctggtgaacgcgttcgcgcgggaaggcctttgcgagaaggcagaggaggtgtttgaggagatgcagcaagctgggcatgaacctgacgtgtatgcctacaatgccctgatggaagcttacagccgcgctgggttgccgcaaggggcatcggagatcttctctctgatggaacacatggggtgtgagcctgacagagcctcttacaacatattggtggatgcttatggaagagctggtctccatcaagaggcagaggcggcgttccaagagctgaagcagcagggcatgcggccgaccatgaagtcgcacatgctgctcctgtccgcgcacgccaagtccggcaacgtggcgaggtgcgaggaggtgatggcgcagctccacaagtcggggctgcgcccggacaccttcgcgctcaacgccatgctcaacgcgtacggcagggccgggcggctcgacgacatggagcgcctcctcggggccatggagcgcggcggcgacgacgacgccggcggtggtgccgcgccggacaccagcacgtacaacgtgctggtgaacgtgtacgggcgcgcggggtacctggaccggatggaggcggcgttccgcgcgctggcggcccgggggctcgccgccgacgtggtgacgtggacatcccgcatcggcgcgtacgcgaggaagaaggagtacgggcggtgcctggagatcttcgaggagatggtggacgccgggtgctacccggacgccggcacggccaaggtgctgctcgccgcgtgctccgacgagcgccaggtggagcaggtcacggccatcgtcaggtccatgcacaaggacgccaagacgctcttcgcattatga

SEQ ID NO: 11298 - protein, 593 aa, Sorghum bicolor
  misc_feature: Ceres ANNOT ID no. 6007468
  misc_feature (166)..(200): Pfam Id: PPR Pfam Desc: PPR repeat
  misc_feature (201)..(235): Pfam Id: PPR Pfam Desc: PPR repeat
  misc_feature (236)..(270): Pfam Id: PPR Pfam Desc: PPR repeat
  misc_feature (271)..(305): Pfam Id: PPR Pfam Desc: PPR repeat
  misc_feature (306)..(340): Pfam Id: PPR Pfam Desc: PPR repeat
  misc_feature (341)..(375): Pfam Id: PPR Pfam Desc: PPR repeat
  misc_feature (376)..(410): Pfam Id: PPR Pfam Desc: PPR repeat
  misc_feature (488)..(522): Pfam Id: PPR Pfam Desc: PPR repeat
  misc_feature (523)..(557): Pfam Id: PPR Pfam Desc: PPR repeat
  misc_feature (154)..(568): NCBI GI: 115471163 NCBI Desc: os07g0213300 [oryza sativa (japonica cultivar-group)]
  misc_feature (121)..(583): NCBI GI: 42570403 NCBI Desc: pentatricopeptide (ppr) repeat-containing protein [arabidopsis thaliana]
  misc_feature (163)..(586): NCBI GI: 119638441 NCBI Desc: auxin efflux carrier [brachypodium sylvaticum]
  misc_feature (200)..(593): NCBI GI: 111154024 NCBI Desc: pentatricopeptide repeat protein [physcomitrella patens]
  misc_feature (171)..(566): NCBI GI: 10177016 NCBI Desc: maize crp1 protein-like [arabidopsis thaliana]
MLSVEAHTYYWIARPRWKLCACRNVLQETALHDAEVNSYRHSERKNRKRDGAYIDKDGVARTFDRKKISRKRGGAIKGRGWKYGSGFVDGVFPVLSPMAQDILEFVQKGTDVTNIWESLDKIPQAHDLWDDIVNVAVQLRLNRQWEPIITVCEWILYRSSFRPDIICYNLLIDAYGQKRQLNKAESIYMALLEAHCVPTEDTYALLLRAYCNSGQLHRAEGVISEMQKNGLPPTATVYNAYLDGLLKARCSEKAVEVYQRMKKERCRTNTETYTLMINVYGKAKQPMSSLKVFNEMKTIGCKPNICTYTALVNAFAREGLCEKAEEVFEEMQQAGHEPDVYAYNALMEAYSRAGLPQGASEIFSLMEHMGCEPDRASYNILVDAYGRAGLHQEAEAAFQELKQQGMRPTMKSHMLLLSAHAKSGNVARCEEVMAQLHKSGLRPDTFALNAMLNAYGRAGRLDDMERLLGAMERGGDDDAGGGAAPDTSTYNVLVNVYGRAGYLDRMEAAFRALAARGLAADVVTWTSRIGAYARKKEYGRCLEIFEEMVDAGCYPDAGTAKVLLAACSDERQVEQVTAIVRSMHKDAKTLFAL

SEQ ID NO: 11299 - DNA, 924 bp, Sorghum bicolor
  misc_feature: Ceres ANNOT ID no. 6007499
  misc_feature: Encodes the peptide sequence at SEQ ID NO 11300
atggcgcaggatgatccggttgtttctcctcagtggctgcacgagcacctaggaatgcctgatgtcaaggttttggatgcttcctggtacatgccggtagagaacagggatccatgggaagaatatcaggtggcacacatccctggtgcgctattcttcgacttagatggcatagttgatccgacaactgatttaccacacatgttgccatcagaagaggcttttgcagcagcaatctctgagctggatataaaaaaccaggataaagttattatttatgatggaaagggattcttcagtgcacctcgtgtttggtggatgtttagagtgtttggacacacaaaagtctgggtattagacggaggtttacctctgtggcgagcttctgggttcaatgtggaaaacgtcagctctggtgatgcagttctgaaatcaaatgccgcaaataaggctgtcgaaagggtttataatggtgaacagacaaatacaatcacatttcacactgaatttcagcctaatctattctggtcactggaaaaggttgcccataatgtgactgctaagacttaccaacaaatagatgccagagcaaagggcagatttgatggtgtagcaccagaaccacggaaaggagtaagaagtggacatataccaggaagcatatgtgttccattccctgagatgttcgatggtgcaccaagccttctctctgcagatgagctgcggcaaaagtttcagcaagcaggaatttccctagatcaacccatcgtcgtcacttgcggatctggcgtgactgcctgcatacttgctctggggctctacaggattggaagacatgatgttccagtttatgatggatcttggacagaatgggaggcacaatcagattccgattacccaaaaatcactgctcctgcttgttaa

SEQ ID NO: 11300 - protein, 307 aa, Sorghum bicolor
  misc_feature: Ceres ANNOT ID no. 6007499
  misc_feature (9)..(129): Pfam Id: Rhodanese Pfam Desc: Rhodanese-like domain
  misc_feature (177)..(294): Pfam Id: Rhodanese Pfam Desc: Rhodanese-like domain
  misc_feature (1)..(304): NCBI GI: 115444449 NCBI Desc: os02g0167100 [oryza sativa (japonica cultivar-group)]
  misc_feature (1)..(304): NCBI GI: 14571545 NCBI Desc: thiosulfate transferase [triticum aestivum]
  misc_feature (4)..(297): NCBI GI: 4406372 NCBI Desc: thiosulfate sulfurtransferase [datisca glomerata]
  misc_feature (1)..(296): NCBI GI: 145327745 NCBI Desc: st1 (mercaptopyruvate sulfurtransferase 1) [arabidopsis thaliana]
  misc_feature (1)..(304): NCBI GI: 115489500 NCBI Desc: os12g0608600 [oryza sativa (japonica cultivar-group)]
MAQDDPVVSPQWLHEHLGMPDVKVLDASWYMPVENRDPWEEYQVAHIPGALFFDLDGIVDPTTDLPHMLPSEEAFAAAISELDIKNQDKVIIYDGKGFFSAPRVWWMFRVFGHTKVWVLDGGLPLWRASGFNVENVSSGDAVLKSNAANKAVERVYNGEQTNTITFHTEFQPNLFWSLEKVAHNVTAKTYQQIDARAKGRFDGVAPEPRKGVRSGHIPGSICVPFPEMFDGAPSLLSADELRQKFQQAGISLDQPIVVTCGSGVTACILALGLYRIGRHDVPVYDGSWTEWEAQSDSDYPKITAPAC

SEQ ID NO: 11301 - DNA, 1107 bp, Sorghum bicolor
  misc_feature: Ceres ANNOT ID no. 6007596
  misc_feature: Encodes the peptide sequence at SEQ ID NO 11302
atggagagcaagcagggtgacgagtccccggcagtgaccgacgacgacgtcttcccggcgaacttcgccgagatcgtggcgtctcttccaagagggccaccgtgctcgatttttccttccgtccgtctgtaccgcgggttctgggtccccaccggcttcctgctgaacctcccgagagcccacgccttgttcgtggagcgccggcccgccgacatcctcctggcgagcttccccaagagcggcaccacctggctcaaggccctcgccttcgccacggcgcgcaggtccgtccactcgccgctcaacggcgccgccggacacccgctcctctccagcagctcccacaactgcgtcgcgttgctcgacatcctagggttattagaaagcaacgacgatgacggcaacgacgacacgatggcgccaccgccgcgtctccttagcacgcacttgccctactccctgctcccgagacgcgccacggcggacggcggcggcggcaacagctccgggtgccggttcgtgtacatcgccagggaccccaaggacacgctggtctccgcgtggcatttcgatgcaggtctgcggaggtcggcggccgcagaaggccgcgaaggaggaggaggagctggcttggagttcgaggaggcgttcgagctctactgccaaggtcatggcgggatggccccgcagtgggagcacgtccgcgagtactgggaggcgagcaagaggacgccagggagcgtgctgttcctcaggtacgaggagatgctgcaggacccggagggcaacctgaagaagatggcggagttcatggggtgcccgttctccgcggcggaggacgacgccggcgtggtgcgcgccatcgttgagctttgcagcctggagaagcagcggagcctggcggtgaacattaccggagcttacgccaacgttctggaggatgtggtggtgacgaccgccgtcgagaacaagtatttcttcaggaaggggatcgtgggggactggaggaaccatatgacaccggagatggcagcaaggttggatggcattgttgaggaggcactcaaggcatcaggatttacctttggggtgcatcaatacaagtaa

SEQ ID NO: 11302 - protein, 368 aa, Sorghum bicolor
  misc_feature: Ceres ANNOT ID no. 6007596
  misc_feature (69)..(359): Pfam Id: Sulfotransfer_1 Pfam Desc: Sulfotransferase domain
  misc_feature (27)..(361): NCBI GI: 115480589 NCBI Desc: os09g0555100 [oryza sativa (japonica cultivar-group)]
  misc_feature (169)..(359): NCBI GI: 115485385 NCBI Desc: os11g0450400 [oryza sativa (japonica cultivar-group)]
  misc_feature (171)..(346): NCBI GI: 115470589 NCBI Desc: os07g0148600 [oryza sativa (japonica cultivar-group)]
  misc_feature (214)..(361): NCBI GI: 115475467 NCBI Desc: os08g0239900 [oryza sativa (japonica cultivar-group)]
  misc_feature (169)..(359): NCBI GI: 15222843 NCBI Desc: sulfotransferase family protein [arabidopsis thaliana]
MESKQGDESPAVTDDDVFPANFAEIVASLPRGPPCSIFPSVRLYRGFWVPTGFLLNLPRAHALFVERRPADILLASFPKSGTTWLKALAFATARRSVHSPLNGAAGHPLLSSSSHNCVALLDILGLLESNDDDGNDDTMAPPPRLLSTHLPYSLLPRRATADGGGGNSSGCRFVYIARDPKDTLVSAWHFDAGLRRSAAAEGREGGGGAGLEFEEAFELYCQGHGGMAPQWEHVREYWEASKRTPGSVLFLRYEEMLQDPEGNLKKMAEFMGCPFSAAEDDAGVVRAIVELCSLEKQRSLAVNITGAYANVLEDVVVTTAVENKYFFRKGIVGDWRNHMTPEMAARLDGIVEEALKASGFTFGVHQYK

SEQ ID NO: 11303 - DNA, 1185 bp, Sorghum bicolor
  misc_feature: Ceres ANNOT ID no. 6007643
  misc_feature: Encodes the peptide sequence at SEQ ID NO 11304
atggattcaagctaccagcgtagatcaaataatgaagaggaattttttttcttcgtactccctaccttacaagaagctagttcatcccaatcatcgcaaaggcaagccatacatacatcagtctggaatggagccatatttattgatgaaacactaaatgggcatgaagtcgtatgccgaaggcgatttcatatggagagagagattttagttcgaagattgcgtgaaaaaggacttgttgattcaaggtatgtctcggtggaagagcaattagctatattcctttatgcagtatcaaaaaatgcaagcaatcgagtattacaagatcaattccaacatagtggggaaacaattagccgtcactttgcagcagtgctcaatgcacttacacaactgacatgccactatatatgcttgccttctccacacccgcatcgtatattaaggcagcctaaattttctccatactttcagaactgtgttggagctatcgatggcactcatattccaatgattattcctgttgcacaacaagaaccatacagaaatagaaaacaaggtctatcacaaaacatgatggttgcatgtgacttcgatctaaaatttgtgcatgtccatgccggttgggaggggtctgcttctgatgcaagagttctacaggatgcacttaaccatggatttagtgtcccccccggtaaattctatcttgtagatgcaggctacgcaaatacaccacaatttcttgctccataccgtggaacaagatatcacttacaagaagaaggaagagcaggtcaaaaaccacaaaatccgaaggaattattcaaccttcgacatgcacaactacggaatcatatagagagagctattggtgtattaaaaatgaggtaccctatactaaaggctgcttcagcatatgacatagagacacaagttgatatctctgtagcttgttgtttaacacacaatttcattcggttacacaatggagatgacagtttggtacatggtgctaccacagatatcaatgacagcaacatgatagatgtaccagaaggagatcaccaatacaataatgatgtgccatcatttaacaacttgcgacaagcaggaaatgagatgcgagatgacatagcaaacaagatgtgggaagattacattgccagacgtacaattcagcgataa

SEQ ID NO: 11304 - protein, 394 aa, Sorghum bicolor
  misc_feature: Ceres ANNOT ID no. 6007643
  misc_feature (63)..(387): NCBI GI: 115468106 NCBI Desc: os06g0481800 [oryza sativa (japonica cultivar-group)]
  misc_feature (10)..(390): NCBI GI: 115445177 NCBI Desc: os02g0231600 [oryza sativa (japonica cultivar-group)]
  misc_feature (2)..(352): NCBI GI: 115449507 NCBI Desc: os02g0813200 [oryza sativa (japonica cultivar-group)]
  misc_feature (2)..(352): NCBI GI: 115468766 NCBI Desc: os06g0595700 [oryza sativa (japonica cultivar-group)]
  misc_feature (47)..(386): NCBI GI: 92871232 NCBI Desc: transposase, is4 [medicago truncatula]
MDSSYQRRSNNEEEFFFFVLPTLQEASSSQSSQRQAIHTSVWNGAIFIDETLNGHEVVCRRRFHMEREILVRRLREKGLVDSRYVSVEEQLAIFLYAVSKNASNRVLQDQFQHSGETISRHFAAVLNALTQLTCHYICLPSPHPHRILRQPKFSPYFQNCVGAIDGTHIPMIIPVAQQEPYRNRKQGLSQNMMVACDFDLKFVHVHAGWEGSASDARVLQDALNHGFSVPPGKFYLVDAGYANTPQFLAPYRGTRYHLQEEGRAGQKPQNPKELFNLRHAQLRNHIERAIGVLKMRYPILKAASAYDIETQVDISVACCLTHNFIRLHNGDDSLVHGATTDINDSNMIDVPEGDHQYNNDVPSFNNLRQAGNEMRDDIANKMWEDYIARRTIQR

SEQ ID NO: 11305 - DNA, 1236 bp, Sorghum bicolor
  misc_feature: Ceres ANNOT ID no. 6007679
  misc_feature: Encodes the peptide sequence at SEQ ID NO 11306
atgaaccagtcgatctccaaacgacaccgtccagtggcaccggaggtcggtggtggcagcatgattccagatgaggtgctgctgttcgagatcctggtgcgccttcctgtgaagtcccttgtgcgcttcaaatctgtttgcaaggcgtggtgcgccaccatagccagcgctcatttcgtccgcctgcacttggaacttgcaagagctagaagctcatcatccatggtcatagtccctcggaaggagcagccgagaccgacaaagctggcctctgtttgcgtccacatcttcagcttccagccagcacggcaaagcaatgtcgccaagctcattatgaagagcaagcctcgtcctggtggcatcccacatttcaccatccccctgcactgcgatggactgattctgatccccagcgttacagggcacatatttgtgtgcaacccggccaccaaggagtttgttgagttgccacggggcacccggaatgtggcattggaccaaagggtcgccttcggctttgatccttccagtggtacgtataaggtggctaggcacttcttgcgctcatacagtgaagggcaaaaacgtacagaatacgatgttggacatgaggtcttgacgcttggcgatggcatagagacgttggaatggaaagcaaccattgatccaccttaccctatcaagggcaggactcctatttgcttgccaggattcttctattggagtgcagtccagtctgtggctgacgacgctgaccacagcaagctcgacacagatgttatcctccgattcagcatgcgcgatgatacgttcactgtgcaccccaatcctccatgcaggagctacctaagtacaaatgaccttctgtgtgagctaagtggcaatctgtgctatgtccactccccctcctctcgcgaagtctccatttggttagcacaagatggacaaaacataataacatggtcactacgttgtcgtgtcaatctgcccgtaccaaggcttcttcgtgtttatgcttgtgcttcagctgatcaaggcacaatattcctctctgtggatgctcttcaccttttgaagtgcaacctccatgatggatctcttgaaacagtggtcagtatgccatttaacttggtgtatgttcacgggaaaggggtaaattttatctatcagggacaccctttttcgcattacatggtgccatatgtggaatctttgctacggattggaccatgctaa

SEQ ID NO: 11306 - protein, 411 aa, Sorghum bicolor
  misc_feature: Ceres ANNOT ID no. 6007679
  misc_feature (17)..(65): Pfam Id: F-box Pfam Desc: F-box domain
  misc_feature (2)..(246): NCBI GI: 115477310 NCBI Desc: os08g0518300 [oryza sativa (japonica cultivar-group)]
  misc_feature (22)..(368): NCBI GI: 115476200 NCBI Desc: os08g0382800 [oryza sativa (japonica cultivar-group)]
  misc_feature (22)..(313): NCBI GI: 38347475 NCBI Desc: osjnba0084n21.13 [oryza sativa (japonica cultivar-group)]
  misc_feature (59)..(408): NCBI GI: 115483534 NCBI Desc: os10g0567900 [oryza sativa (japonica cultivar-group)]
  misc_feature (193)..(329): NCBI GI: 38347473 NCBI Desc: osjnba0084n21.11 [oryza sativa (japonica cultivar-group)]
  misc_feature: The sequence is a functional homolog of SEQ ID NO. 456 in the 11/188,298 US application
MNQSISKRHRPVAPEVGGGSMIPDEVLLFEILVRLPVKSLVRFKSVCKAWCATIASAHFVRLHLELARARSSSSMVIVPRKEQPRPTKLASVCVHIFSFQPARQSNVAKLIMKSKPRPGGIPHFTIPLHCDGLILIPSVTGHIFVCNPATKEFVELPRGTRNVALDQRVAFGFDPSSGTYKVARHFLRSYSEGQKRTEYDVGHEVLTLGDGIETLEWKATIDPPYPIKGRTPICLPGFFYWSAVQSVADDADHSKLDTDVILRFSMRDDTFTVHPNPPCRSYLSTNDLLCELSGNLCYVHSPSSREVSIWLAQDGQNIITWSLRCRVNLPVPRLLRVYACASADQGTIFLSVDALHLLKCNLHDGSLETVVSMPFNLVYVHGKGVNFIYQGHPFSHYMVPYVESLLRIGPC

SEQ ID NO: 11307 - DNA, 1236 bp, Sorghum bicolor
  misc_feature: Ceres ANNOT ID no. 6007691
  misc_feature: Encodes the peptide sequence at SEQ ID NO 11308
atgaaccagccgatctccaaacgacaccgtccagtggcaccggaggtcggtggtggcagcatgattccagatgaggtgctgctgttcgagatcctggtgcgccttcctgtgaagtcccttgtgcgcttcaaatctgtttgcaaggcgtggtgcgccaccatagccagcgctcatttcgtccgcctgcacttggaacttgcaagagctagaagctcatcatccatggtcatagtccctcggaaggagcagccgagaccgacaaagctggcctctggtttcgtccacatcttcagcttccggccagcacggcaaagcaatgtcgccaagctcattatgaagagcaagcctcgtcctggtggcatcccatatttcaccatccccctgcactgcgatggactgattctgatccccagcgttacagggcacatatttgtgtgcaacccggccaccaaggagtttgttgagttgccacggggcacccggaatgtggcattggaccaaagggtcgccttcggctttgatccttccagtggtacgtataaggtggctaggcacttcttgcgctcatacagtgaagggcaaaaacgtacagaatacgatgttggacatgaggtcttgacgcttggcgatggcatagagacgttggaatggaaagcaaccattgatccaccttaccctatcaagggcaggactcctatttgcttgccaggattcttctattggagtgcagtccagtctgtggctgacgacgctgaccacagcaagctcgacacagatgttatcctccgattcagcatgcgcgatgatacgttcactgtgcaccccaatcctccatgcaggagctacctaagtaccaatgaccttctgtgtgagctaagtggcaatctgtgctatgtccactccccctcctctcgtgaagtctccatttggttagcacaagatggacaaaacataataacatggtcactacgttgtcgtgtcaatctgcccgtaccaaggcttcttcgtgtttatgcttgtgcttcagctgatcaaggcacaatattcctctctgtggatgctcttcaccttttgaagtgcaacctccatgatggatctcttgaaacagtggtcagtatgccatttaacttggtgtatgttcacgggaaaggggtaaattttatctatcagggacaccctttttcgcattacatggtgccatatgtggaatctttgctacggattggaccatgctaa

SEQ ID NO: 11308 - protein, 411 aa, Sorghum bicolor
  misc_feature: Ceres ANNOT ID no. 6007691
  misc_feature (17)..(65): Pfam Id: F-box Pfam Desc: F-box domain
  misc_feature (2)..(246): NCBI GI: 115477310 NCBI Desc: os08g0518300 [oryza sativa (japonica cultivar-group)]
  misc_feature (22)..(368): NCBI GI: 115476200 NCBI Desc: os08g0382800 [oryza sativa (japonica cultivar-group)]
  misc_feature (22)..(313): NCBI GI: 38347475 NCBI Desc: osjnba0084n21.13 [oryza sativa (japonica cultivar-group)]
  misc_feature (59)..(408): NCBI GI: 115483534 NCBI Desc: os10g0567900 [oryza sativa (japonica cultivar-group)]
  misc_feature (193)..(329): NCBI GI: 38347473 NCBI Desc: osjnba0084n21.11 [oryza sativa (japonica cultivar-group)]
  misc_feature: The sequence is a functional homolog of SEQ ID NO. 456 in the 11/188,298 US application
MNQPISKRHRPVAPEVGGGSMIPDEVLLFEILVRLPVKSLVRFKSVCKAWCATIASAHFVRLHLELARARSSSSMVIVPRKEQPRPTKLASGFVHIFSFRPARQSNVAKLIMKSKPRPGGIPYFTIPLHCDGLILIPSVTGHIFVCNPATKEFVELPRGTRNVALDQRVAFGFDPSSGTYKVARHFLRSYSEGQKRTEYDVGHEVLTLGDGIETLEWKATIDPPYPIKGRTPICLPGFFYWSAVQSVADDADHSKLDTDVILRFSMRDDTFTVHPNPPCRSYLSTNDLLCELSGNLCYVHSPSSREVSIWLAQDGQNIITWSLRCRVNLPVPRLLRVYACASADQGTIFLSVDALHLLKCNLHDGSLETVVSMPFNLVYVHGKGVNFIYQGHPFSHYMVPYVESLLRIGPC

SEQ ID NO: 11309 - DNA, 615 bp, Sorghum bicolor
  misc_feature: Ceres ANNOT ID no. 6007729
  misc_feature: Encodes the peptide sequence at SEQ ID NO 11310
atggaggagacggcggcggcggcggcggcggcgacggcgacgtctgagaaggcgtcgtcgtacaggtactgggtgcgggaggccaccggcgacgccgcgccgctccccgtcccgcgcaagctcgaccccaccgccaacgggaacgggaacgggaacccgccgcccctcggctccgtctggaatcaggctggaacctgggaggaaaagaacctcaactcatgggccaatggtaggataaaggatttgctgggctctttaggttcattggacttccctacagggaaggcatccattgatgaagtgtccaagtgctcaggcgatgcatttcaggtcactgtccgcaacaagaagagagtaggatataattatgaactaagcttgagatttaaaggtgaatggttaattaaagaagaaaacaagaagatcaaaggacatttagacattcctgagttttcatttggtgagattgatgacttggaggtacaagtaaggttcagtgatgacaagggcctcgcatctgaagacaaaacacggatttgcaaggatctcaagacctttctggcgtcgattcaagagaaaatgcgcgtgtttgaagaagagctcaaaggtagatag

SEQ ID NO: 11310 - protein, 204 aa, Sorghum bicolor
  misc_feature: Ceres ANNOT ID no. 6007729
  misc_feature (68)..(204): Pfam Id: Aha1_N Pfam Desc: Activator of Hsp90 ATPase, N-terminal
  misc_feature (66)..(189): NCBI GI: 47086829 NCBI Desc: aha1, activator of heat shock 90kda protein atpase homolog 1, like [danio rerio]
  misc_feature (66)..(202): NCBI GI: 123122607 NCBI Desc: novel protein [mus musculus]
  misc_feature (66)..(166): NCBI GI: 51703993 NCBI Desc: mgc89589 protein [xenopus tropicalis]
  misc_feature (57)..(201): NCBI GI: 51968319 NCBI Desc: pfc0270w [plasmodium falciparum 3d7]
  misc_feature (66)..(202): NCBI GI: 54645599 NCBI Desc: ga12794-pa [drosophila pseudoobscura]
MEETAAAAAAATATSEKASSYRYWVREATGDAAPLPVPRKLDPTANGNGNGNPPPLGSVWNQAGTWEEKNLNSWANGRIKDLLGSLGSLDFPTGKASIDEVSKCSGDAFQVTVRNKKRVGYNYELSLRFKGEWLIKEENKKIKGHLDIPEFSFGEIDDLEVQVRFSDDKGLASEDKTRICKDLKTFLASIQEKMRVFEEELKGR

SEQ ID NO: 11311 - DNA, 1230 bp, Sorghum bicolor
  misc_feature: Ceres ANNOT ID no. 6007730
  misc_feature: Encodes the peptide sequence at SEQ ID NO 11312
atggctcacacacgcactgctccccagccttcagctcaccagctgctcagtgcaccacatgatctactgccatcatcatcatgtgctgcttcccaatcctcaaagatccttccatttgaccttcagaaatgcagtcctgactccaccaacggaaccccagtctctcgcgtatctcaagctggattactatccaaggatctggtatcgccatccagttcttccacattctgcacaagtatgtactcgtcgtcgtcgacgaattccaagtcatgccggcaagcagacgctctgcctttcctgccccatcctcctaaaagtgagcatcagcaaacatcaggtggtcagtcatccagctcttcatcgctgctctttggtactgacctcaacaatggtggtcaaagtgaggctgaacctgcagctgatctcaaggattttcttaacctttctggagatgcttcaggaggcagtttccatggagaaagcaacggcatggctttcagagagcagatggagtttcagttcttgtctgaacagctcggaatcgccatcaccgacaacgaagagagccctcgattagatgatatatatgacagaccgccacaaacctcttcttgtccggtgttgtcttgctctgaccaagacgacctccagaggacaggatctcctgttaaagttcagctgagttcatctcgagctgcatcatgtaacaagccaagactgagatggacactggagctccatgagctttttgtaaagtctgtcaacaagcttggagggccagaaaaggcaactcctaagggtgtgttgaagcttgtgaaggtagaaggcttgaccatctatcatgtgaagagccatttgcagaaataccgttttgcgaagcatcttccagagacaaaagaagacatgaagttctcttcagaagacaagatatctaaatcagaaataccaggaaacaatgctggcagaaagaagagtttacaactagcagaagctcttcggatgcaaatggaggttcagaaacaacttcatgaacaattagaggtgcaaaggcagctacaggtacgcatagaagaacatgcaaagtatttgcagaagatattagaacaacagaaggcaagtaattcattaccagctatgacaagttcaatagaaagagagctttctgaatctaaagaggaaaagaaacccaagacgcaagcggacactttttcagctccattgccaaattaa

SEQ ID NO: 11312 - protein, 409 aa, Sorghum bicolor
  misc_feature: Ceres ANNOT ID no. 6007730
  misc_feature (239)..(290): Pfam Id: Myb_DNA-binding Pfam Desc: Myb-like DNA-binding domain
  misc_feature (13)..(408): NCBI GI: 15795136 NCBI Desc: transfactor-like protein [arabidopsis thaliana]
  misc_feature (13)..(408): NCBI GI: 21536970 NCBI Desc: transfactor-like protein [arabidopsis thaliana]
  misc_feature (240)..(408): NCBI GI: 119655909 NCBI Desc: mybogu [brassica rapa subsp. chinensis]
  misc_feature (179)..(400): NCBI GI: 4519671 NCBI Desc: transfactor [nicotiana tabacum]
  misc_feature (220)..(404): NCBI GI: 124359545 NCBI Desc: peptidase m22, glycoprotease; homeodomain-related [medicago truncatula]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: Useful for making plants with modulated growth and phenotype characteristics
  misc_feature: Useful for making plants with modulated oxidative stress sensitivity
  misc_feature: Functional homolog of the protein sequence given in SEQ ID NO 12904
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1857 in the 10/374,780 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MAHTRTAPQPSAHQLLSAPHDLLPSSSCAASQSSKILPFDLQKCSPDSTNGTPVSRVSQAGLLSKDLVSPSSSSTFCTSMYSSSSTNSKSCRQADALPFLPHPPKSEHQQTSGGQSSSSSSLLFGTDLNNGGQSEAEPAADLKDFLNLSGDASGGSFHGESNGMAFREQMEFQFLSEQLGIAITDNEESPRLDDIYDRPPQTSSCPVLSCSDQDDLQRTGSPVKVQLSSSRAASCNKPRLRWTLELHELFVKSVNKLGGPEKATPKGVLKLVKVEGLTIYHVKSHLQKYRFAKHLPETKEDMKFSSEDKISKSEIPGNNAGRKKSLQLAEALRMQMEVQKQLHEQLEVQRQLQVRIEEHAKYLQKILEQQKASNSLPAMTSSIERELSESKEEKKPKTQADTFSAPLPN

SEQ ID NO: 11313 - DNA, 1299 bp, Sorghum bicolor
  misc_feature: Ceres ANNOT ID no. 6007731
  misc_feature: Encodes the peptide sequence at SEQ ID NO 11314
atggcgacggacagtgccgattcccagaggctcttgcttgggcgtcaaactcaggctgatggagcagatgagttcgaggacaacaatcttgctgcaccagaacctttatcccacaatactggagcaagtttccaaaggaatccaagatctacaaattcgggtgtattcggaagcctgaagattgtgctgctgaaatctaagctcaatttgcttataccatgtggattcttggcaatcctgatggattatcttagccaaaataaggcctgggtatttcctctgagcctgttgggtatcattcctttggctgagcgactgggttttgcaaccgagcagctaggactcttcactggccgaacagctgggggcctcctaaatgctacatttggcaatgccaccgagctggtcatatcaattcatgcactccggagcggaaagctacgggtggttcagcaatctctgctcggatcaatcctgtcaaacacgctgctggttcttggatgtgcgttctttggtgggggactcacctgcggtaaatccgagcagattttcagaaaggaagatgcagtgctgaactctgggctgctcttgatggctgtgatggggctggtctctcctgctatgctgtactatactcacaccgaggttaacttgggcaagtcagcactggcattgtcaaggttcagcagctgcataatgctttttgcttatgccgctttcattttcttcgagctgtcgaacagtcgccgccgagacgaatctagtgagggaggaggtggggatcaaggggacgacgattgcgaatacgcgtttcctgaaatttccaagtgggaagccattgcttggcttgcaatttttactgcttggatctcagttttctctgactttttagttgaagcaatcgagggggcttccaaggcttggaaaataccagttgcgttcatcagtactgttttgcttccgattgtagggaatgctgcagaacatgctagtgctgttatgtttgcaatgaaagacaaattagacctttcccttggagtcgccatcgggtcttcgacgcagatatccatgtttgtggtgggatggatgatgggccagccaatggacttgaatttccatctgtttgaaaccgccagcctcttgataaccgtactggttgtagcacttctgttgcaggatgggacttcgaattgtttcaaagggctgatgctaattctctgctacctgatagtagctgccagtttttatgtatatgctgatccaaatattgatggtagctttctctcctatctaaattga

SEQ ID NO: 11314 - protein, 432 aa, Sorghum bicolor
  misc_feature: Ceres ANNOT ID no. 6007731
  misc_feature (97)..(244): Pfam Id: Na_Ca_ex Pfam Desc: Sodium/calcium exchanger protein
  misc_feature (288)..(415): Pfam Id: Na_Ca_ex Pfam Desc: Sodium/calcium exchanger protein
  misc_feature (18)..(425): NCBI GI: 20453241 NCBI Desc: at3g13320/mdc11_10 [arabidopsis thaliana]
  misc_feature (43)..(425): NCBI GI: 40782189 NCBI Desc: low affinity calcium transporter cax2 [arabidopsis halleri subsp. halleri]
  misc_feature (18)..(422): NCBI GI: 9294538 NCBI Desc: calcium/proton exchanger [arabidopsis thaliana]
  misc_feature (24)..(424): NCBI GI: 4512263 NCBI Desc: h+/ca2+ exchanger 2 [ipomoea nil]
  misc_feature (43)..(425): NCBI GI: 1488267 NCBI Desc: low affinity calcium antiporter cax2
MATDSADSQRLLLGRQTQADGADEFEDNNLAAPEPLSHNTGASFQRNPRSTNSGVFGSLKIVLLKSKLNLLIPCGFLAILMDYLSQNKAWVFPLSLLGIIPLAERLGFATEQLGLFTGRTAGGLLNATFGNATELVISIHALRSGKLRVVQQSLLGSILSNTLLVLGCAFFGGGLTCGKSEQIFRKEDAVLNSGLLLMAVMGLVSPAMLYYTHTEVNLGKSALALSRFSSCIMLFAYAAFIFFELSNSRRRDESSEGGGGDQGDDDCEYAFPEISKWEAIAWLAIFTAWISVFSDFLVEAIEGASKAWKIPVAFISTVLLPIVGNAAEHASAVMFAMKDKLDLSLGVAIGSSTQISMFVVGWMMGQPMDLNFHLFETASLLITVLVVALLLQDGTSNCFKGLMLILCYLIVAASFYVYADPNIDGSFLSYLN

SEQ ID NO: 11315 - DNA, 1482 bp, Sorghum bicolor
  misc_feature: Ceres ANNOT ID no. 6007760
  misc_feature: Encodes the peptide sequence at SEQ ID NO 11316
atggaggtggtctcttgcagccactcctgctcggcattacatcaaacaccagcgagtgcatggaggcttcggggcggcactgctcttggtcttggtcttgggcatgccaagccttcccggcccagaagatacacggttatgtgtgtcggaaccacaagaggatcagcttcgagtccgggtggttccggcaaggtccatgcagcccagggattccatgtgagcgacgtggatgcagctctgcagggcattccttccatgaaggtgggggaggttaagaaggtgatgattcaaggcctcccggaaggccctgatggctcaccgatcagtactgggttctgggagtggaagccgaagctgactgtgtactatgagaggtccggggtggagaacagcaaggcgccggcggtgctcttcctgccagggttcggagtcgggacgttccatttcgagaagcagctgagggatcttggtcgtgatcatagggtgtggacgatggattttctcgggcaggggatgtcgctgccgggtgaagaccctgctcctagtagcatctcgagtgaagaggtgttttgggggtttggacaagattcgcagccttgggcagaggagctggtgtattctgtagatttgtggcaaaaccaagttcagcgtttcatcgaggaggttatccgtgaaccagtttatatcgtggggaactctcttggaggttttgttgctctgtattttgcctcatccaatccacaccttgtaaaaggtgtcacattgcttaatgcaacaccattttggggattctttcctaaccctgctacatctccccgattgtcaaagattttcccatgggctgggacatttcctcttccatcatttgtgaggaaacttactgaagcagtttggcaaaagataagtgacccaaaaagtattcaagatatactcaaacaagtatatgctgaccattcaacaaatgtggacaaagtattctctcgtattgtggagataacacaacacccagcagctgcagcatcatttgcctccattatgtttgctccaaggggtcagatatccttccaagaggcaatctctaggtgccaaagccaaggtgtccctctatctctcatgtatggaagagaagacccttggattagacctttttggggcattaaagtcaaacagcaagtacccgaagcaccttattatgaaattagtcctgccggtcattgtcctcatgatgaggtccctgaggttgtaaactacttgctccgagggtggttgaagaacctcgagtctgagggttcaatcgacctgccatttctagaagaacccagctatgctgagcatggtgtatccagggaactggactttgtcagagaaggatcaaggaaatcagttagtgtgcggctctatggtaccaaaatttccttatggagccaactaagctcattcttgaacacacgtgttcccaactctcgggtagtcttgagataa

SEQ ID NO: 11316 - protein, 493 aa, Sorghum bicolor
  misc_feature: Ceres ANNOT ID no. 6007760
  misc_feature (160)..(421): Pfam Id: Abhydrolase_1 Pfam Desc: alpha/beta hydrolase fold
  misc_feature (1)..(493): NCBI GI: 51090866 NCBI Desc: hydrolase-like [oryza sativa (japonica cultivar-group)]
  misc_feature (1)..(423): NCBI GI: 51090867 NCBI Desc: hydrolase-like [oryza sativa (japonica cultivar-group)]
  misc_feature (192)..(422): NCBI GI: 67925245 NCBI Desc: alpha/beta hydrolase fold [crocosphaera watsonii wh 8501]
  misc_feature (192)..(423): NCBI GI: 113475883 NCBI Desc: alpha/beta hydrolase fold [trichodesmium erythraeum ims101]
  misc_feature (192)..(423): NCBI GI: 119492673 NCBI Desc: alpha/beta hydrolase fold protein [lyngbya sp. pcc 8106]
MEVVSCSHSCSALHQTPASAWRLRGGTALGLGLGHAKPSRPRRYTVMCVGTTRGSASSPGGSGKVHAAQGFHVSDVDAALQGIPSMKVGEVKKVMIQGLPEGPDGSPISTGFWEWKPKLTVYYERSGVENSKAPAVLFLPGFGVGTFHFEKQLRDLGRDHRVWTMDFLGQGMSLPGEDPAPSSISSEEVFWGFGQDSQPWAEELVYSVDLWQNQVQRFIEEVIREPVYIVGNSLGGFVALYFASSNPHLVKGVTLLNATPFWGFFPNPATSPRLSKIFPWAGTFPLPSFVRKLTEAVWQKISDPKSIQDILKQVYADHSTNVDKVFSRIVEITQHPAAAASFASIMFAPRGQISFQEAISRCQSQGVPLSLMYGREDPWIRPFWGIKVKQQVPEAPYYEISPAGHCPHDEVPEVVNYLLRGWLKNLESEGSIDLPFLEEPSYAEHGVSRELDFVREGSRKSVSVRLYGTKISLWSQLSSFLNTRVPNSRVVLR

SEQ ID NO: 11317 - DNA, 1617 bp, Sorghum bicolor
  misc_feature: Ceres ANNOT ID no. 6007794
  misc_feature: Encodes the peptide sequence at SEQ ID NO 11318
atgctgaggaccaagaccccgcggtcgcgcggcggcaaggcgcgacgcgcacccgggggcgcctcggcggtcaagcccgccaaggccgaagggaggtcgccgtccggggagctctcgctgcagctggagcacgtctccctcatctccttcctctccgaccgccgccccgccgcctccgccgctggcctcacgcccttcgaggcgctcctagaggaggaggatggggatggagaggggctgggttgctaccgcgccgatctaaccccggcgccgccgcttccccagccgcagtctatgcccccgccgccaccgccgacggcggcacaggtcccgcaggcatcgccgatggacgcggacgagaccatggaggagaaggattgctgcatcctcagtcaggattttttctgcaccccagactacatcacgccggagatgccgcaggtggctaacgagttcgacgatgacaaggagaacatcccttgccccaaatctccggagaagtcagccaaccctcggagcaagcggtacagaaccgattgttcccctaaaggtctggaatccacggacttttctttcgaccatcagattactccggttccgtttgacagtctcactcgagatgattcggaagaagagcagccgatgcagcctgcgctggaaaagaggggtggttatgtctcccagtcagcagtggctctgcgctgccgggtgatgcctccaccatgcgtcaagaatccatacctcaatactgatccatgcatagatgatgcagtttacggtgggaggcaatgcaactcagcaggtttttctccttcaattggtggtaatggtctttcacgctaccgaactgatttccatgaaatagagaaaattggctatggcaacttcagtgtcgtgttcaaagttctgaacaggatagatgggtgcttgtatgctgttaaacggagtatcaagcaattgcataatgatatggaaaggaggcaagcagtgaaagaagtccaagctatggcagccttaggttctcatgagaacatagttcgatatttcacctcttggtttgagaatgagcaactttatattcagatggaactctgtgatcactgtctatctatgaatcggaaccagccagtgaagcatggggaagccatggaactgttgtaccagatctgcaaaggcttggatttcatgcatgaacgcggcatagcacaccttgatgtgaagcctgataacatatatgtcagaaatggtatttacaagctcggggattttggctgtgctacacttattaaccgaagtttggcaattgaagatggagattcacgatatatgcctccagaaatgctgaatgataagtatgagcatcttgacaaggttgatatcttttctcttggggcagccctctatgagcttataagaggcaccccgcttcctgagtctgggcctcactttacaagcatcagagagggtaagatcgcattactaccagggtgcccaatgcagtttcaaagtttaattaagtctatgatggatcctaatcccgtgaggcggccttcagcaaaggagatcctgagacacccctcctttgagaagctccacaaggccccagcgaagaagtag

SEQ ID NO: 11318 - protein, 538 aa, Sorghum bicolor
  misc_feature: Ceres ANNOT ID no. 6007794
  misc_feature (285)..(528): Pfam Id: Pkinase Pfam Desc: Protein kinase domain
  misc_feature (285)..(528): Pfam Id: Pkinase_Tyr Pfam Desc: Protein tyrosine kinase
  misc_feature (136)..(537): NCBI GI: 5821717 NCBI Desc: wee1-like protein [zea mays]
  misc_feature (178)..(538): NCBI GI: 115444073 NCBI Desc: os02g0135300 [oryza sativa (japonica cultivar-group)]
  misc_feature (104)..(530): NCBI GI: 84574987 NCBI Desc: protein kinase wee1 [lycopersicon esculentum]
  misc_feature (104)..(530): NCBI GI: 55859438 NCBI Desc: protein kinase wee1 [lycopersicon esculentum var. cerasiforme]
  misc_feature (123)..(533): NCBI GI: 42362341 NCBI Desc: wee1 [glycine max]
  misc_feature: The sequence is a functional homolog of SEQ ID NO. 340 in the 11/188,298 US application
  misc_feature: The sequence is a functional homolog of SEQ ID NO. 311 in the 11/188,298 US application
  misc_feature: The sequence is a functional homolog of SEQ ID NO. 464 in the 11/188,298 US application
  misc_feature: The sequence is a functional homolog of SEQ ID NO. 310 in the 11/188,298 US application
  misc_feature: The sequence is a functional homolog of SEQ ID NO. 358 in the 11/188,298 US application
  misc_feature: The sequence is a functional homolog of SEQ ID NO. 498 in the 11/188,298 US application
  misc_feature: The sequence is a functional homolog of SEQ ID NO. 399 in the 11/188,298 US application
  misc_feature: The sequence is a functional homolog of SEQ ID NO. 312 in the 11/188,298 US application
  misc_feature: The sequence is a functional homolog of SEQ ID NO. 495 in the 11/188,298 US application
  misc_feature: The sequence is a functional homolog of SEQ ID NO. 441 in the 11/188,298 US application
  misc_feature: The sequence is a functional homolog of SEQ ID NO. 332 in the 11/188,298 US application
  misc_feature: The sequence is a functional homolog of SEQ ID NO. 446 in the 11/188,298 US application
  misc_feature: The sequence is a functional homolog of SEQ ID NO. 366 in the 11/188,298 US application
  misc_feature: The sequence is a functional homolog of SEQ ID NO. 520 in the 11/188,298 US application
  misc_feature: The sequence is a functional homolog of SEQ ID NO. 391 in the 11/188,298 US application
MLRTKTPRSRGGKARRAPGGASAVKPAKAEGRSPSGELSLQLEHVSLISFLSDRRPAASAAGLTPFEALLEEEDGDGEGLGCYRADLTPAPPLPQPQSMPPPPPPTAAQVPQASPMDADETMEEKDCCILSQDFFCTPDYITPEMPQVANEFDDDKENIPCPKSPEKSANPRSKRYRTDCSPKGLESTDFSFDHQITPVPFDSLTRDDSEEEQPMQPALEKRGGYVSQSAVALRCRVMPPPCVKNPYLNTDPCIDDAVYGGRQCNSAGFSPSIGGNGLSRYRTDFHEIEKIGYGNFSVVFKVLNRIDGCLYAVKRSIKQLHNDMERRQAVKEVQAMAALGSHENIVRYFTSWFENEQLYIQMELCDHCLSMNRNQPVKHGEAMELLYQICKGLDFMHERGIAHLDVKPDNIYVRNGIYKLGDFGCATLINRSLAIEDGDSRYMPPEMLNDKYEHLDKVDIFSLGAALYELIRGTPLPESGPHFTSIREGKIALLPGCPMQFQSLIKSMMDPNPVRRPSAKEILRHPSFEKLHKAPAKK

SEQ ID NO: 11319 - DNA, 747 bp, Sorghum bicolor
  misc_feature: Ceres ANNOT ID no. 6007904
  misc_feature: Encodes the peptide sequence at SEQ ID NO 11320
atggtgtcgtcgtcgtcgtcggatgcggccgctgccgcgctggagctgcaggagtccgggtgggaggagctgcggcgggaggcgcgcaagctggagggcgacctcgacgtgaagctctcctcctacgcgcgcctcgcagcgcgctcctcctcctccgccgcatccgcctcgggcgccgcctcccccaccgccgaccgctcctcttggaagtccatggagttcgagatccagtcgctgctaggcaagctgcaggacgtcaacgacgccatgagccgctgcgccgcctccagcgccaacaccacctccgtctcccagaagctcgcgcgccaccgcgacatcctccacgagttcacgcaggagttcaggaggaccagggggaacctgagctccatgagggagcacgccgatttactcagctccgtcagagacgacatcactgagtccaaggccaccggtggcatgtcgccaagagtgcatttgctcagggagcgagcttccattcatggcagcatcaaccagattgatgaggtaattggccaagctcaaagcacaagagtagctctttccaatcagagggccttgtttggagatattcaaggaaaagtcaagcagttgggtgaaaagtttccgataatcagaggtcttcttggcgccattaagcggaagaaatcaaaggacactataattctttcagcagtgatcgcggcctgcaccatctttttgattatttactggctttcaaaatga

SEQ ID NO: 11320 - protein, 248 aa, Sorghum bicolor
  misc_feature: Ceres ANNOT ID no. 6007904
  misc_feature (76)..(226): Pfam Id: V-SNARE Pfam Desc: Vesicle transport v-SNARE protein
  misc_feature (21)..(244): NCBI GI: 28280046 NCBI Desc: gosr1 protein [xenopus laevis]
  misc_feature (21)..(244): NCBI GI: 62859931 NCBI Desc: gosr1 [xenopus tropicalis]
  misc_feature (21)..(244): NCBI GI: 57525319 NCBI Desc: similar to v-snare [gallus gallus]
  misc_feature (21)..(244): NCBI GI: 1912453 NCBI Desc: v-snare
  misc_feature (21)..(244): NCBI GI: 117558481 NCBI Desc: golgi snap receptor complex member 1 [rattus norvegicus]
MVSSSSSDAAAAALELQESGWEELRREARKLEGDLDVKLSSYARLAARSSSSAASASGAASPTADRSSWKSMEFEIQSLLGKLQDVNDAMSRCAASSANTTSVSQKLARHRDILHEFTQEFRRTRGNLSSMREHADLLSSVRDDITESKATGGMSPRVHLLRERASIHGSINQIDEVIGQAQSTRVALSNQRALFGDIQGKVKQLGEKFPIIRGLLGAIKRKKSKDTIILSAVIAACTIFLIIYWLSK

SEQ ID NO: 11321 - DNA, 957 bp, Sorghum bicolor
  misc_feature: Ceres ANNOT ID no. 6007975
  misc_feature: Encodes the peptide sequence at SEQ ID NO 11322
atggcggcggcggcggcggcgaaggacgcggcggtgacgctgagcagcgggtaccggatgccggcggtggggctgggcgtgtggcggatggacaagccggacgtccgcggcctcatccacgccgcgctccgactcggctaccgccacctcgactgcgccgctgactaccaaaatgaagcagaagttggtgatgcactcgcagaggcatttcagactggacttgtcaagagggaggatctgttcatcacaaccaagctttggaactcagatcacggccatgtgcttgaagcctgcaaggatagcttgaagaagctacagctagattatctcgatctctatcttattcacttcccagtagctaccaggcatacaggagttggcacaacttctagcgctctcggtgatgatggcgtactagacattgataccactatctcattggaaacaacatggcatgcaatggaagaacttgtttccatgggactagtgcgcagcatcggaatcagcaactacgacatcttcctcactagagactgcttggcctatgccaagataaagcctgcagtgaaccaaatcgaggtgcacccctacttccagcgcgattctcttgtcaagttctgccagaagcatgggatctgcgtcaccgcgcatacccccttgggtggctccactgccaacaccgagtggttcgggtcggtctcgtgccttgacgaccctgtcatcaagagcttggctgagaagtacggcaagacaccagcacagcttgtcctccggtggggtctgcagcggaacacggtggtgatccccaagacctccaagttggagaggctgcaggagaactttgaggtcttcgatttcgacatctccggcgaggacatggagaagatgaaggccgtcgacaggaagtaccggactaaccagcctgccaaattctggggcatcgacctgtttgcttag

SEQ ID NO: 11322 - protein, 318 aa, Sorghum bicolor
  misc_feature: Ceres ANNOT ID no. 6007975
  misc_feature (14)..(301): Pfam Id: Aldo_ket_red Pfam Desc: Aldo/keto reductase family
  misc_feature (1)..(318): NCBI GI: 115443911 NCBI Desc: os02g0123500 [oryza sativa (japonica cultivar-group)]
  misc_feature (11)..(318): NCBI GI: 92870669 NCBI Desc: aldo/keto reductase [medicago truncatula]
  misc_feature (12)..(318): NCBI GI: 10334991 NCBI Desc: nadph-dependent mannose 6-phosphate reductase [orobanche ramosa]
  misc_feature (11)..(318): NCBI GI: 1835701 NCBI Desc: nadph-dependent mannose 6-phosphate reductase [apium graveolens]
  misc_feature (10)..(318): NCBI GI: 217951 NCBI Desc: nadp-dependent d-sorbitol-6-phosphate dehydrogenase [malus x domestica]
  misc_feature (10)..(318): SWISSPROT Homolog: EC 1.1.1.200 NADP-dependent D-sorbitol-6-phosphate dehydrogenase
MAAAAAAKDAAVTLSSGYRMPAVGLGVWRMDKPDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIEVHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 11323 - DNA, 1248 bp, Sorghum bicolor
  misc_feature: Ceres ANNOT ID no. 6008101
  misc_feature: Encodes the peptide sequence at SEQ ID NO 11324
atggccggcgaactgcgccaccgccgcgtaccgtcgtcggacggggacggggacggggacgaggacgagggcgtcgtcgcctcctctcaaagactccattccgcctcttcctccgccgccgatggcaacggtaagggaaaggccggcacttcgtccggcggcggcgagggggcggagccgcggagggagaaacgggacgcgctggggtggctggagtggggccgcggctggatggccgtcgtgggggagttcctcttccagcgcatcgccgccagccacctcgccaacccgctcgagctgcccccgctcgacggcgtctccatcgtcgtcaccggcgccaccagcggcatcgggctccagatcgcaaggcaactcgctcttgctggggcacatgttgtgatggctgttaggagacccaaggtggcacaagacttgattcagaagtggcagaatgaaaattcagaaacaggaagaccattaaatgccgaggtgatggaacttgacctgctctccctcgactcagtcgtaaagtttgctgatgcttggaatgctcgtatggcacccctacacgtgttgatcaacaatgctggcatcttcgctataggagaaccccagcgtttttcaaaggatggacatgaagaacacatgcaagtgaaccacctagcacccgcgttactggcgatgctgcttataccttcccttctccgaggttctcccagcagaattgttaacgttaattcaattatgcacactataggttttgttgatgctgaagatatgaacttgagaaaacataaatatagaagttggttgggatattcaaatagcaagttggcacaggtaaaattcagtagcatgcttcataagaaaattcctgcagaagctgggatcaatgtagtttgtgcttctcctggaattgtcgacacgaatgttgcaagagaccttcctaagattgttgtagctgcatatcatttgattccctacttcatatttgatgctcaagaagcatctgatccccaagttccagaatactgcgagatgctgaagtcggaagactggccagtctgtgcttgcattaactatgactgtaatccgatgaatgcatctgaagaagcgcacaatcttgaaacctcacagctggtctgggagaagacgctcgagatgattggccttccgccagatgccctggagaagctcatcgccggagaaacagttcagtgccgttatggacaacaggaggcagaatag

SEQ ID NO: 11324 - protein, 415 aa, Sorghum bicolor
  misc_feature: Ceres ANNOT ID no. 6008101
  misc_feature (106)..(267): Pfam Id: adh_short Pfam Desc: short chain dehydrogenase
  misc_feature (91)..(415): NCBI GI: 3885880 NCBI Desc: protochlorophyllide reductase homolog [oryza sativa]
  misc_feature (40)..(413): NCBI GI: 18138083 NCBI Desc: forever young oxidoreductase [lycopersicon esculentum]
  misc_feature (40)..(413): NCBI GI: 18138085 NCBI Desc: forever young oxidoreductase [solanum bulbocastanum]
  misc_feature (60)..(412): NCBI GI: 12004621 NCBI Desc: forever young oxidoreductase [arabidopsis thaliana]
  misc_feature (60)..(412): NCBI GI: 79487049 NCBI Desc: fey (forever young); oxidoreductase [arabidopsis thaliana]
  misc_feature: The sequence is a functional homolog of SEQ ID NO. 453 in the 11/188,298 US application
  misc_feature: The sequence is a functional homolog of SEQ ID NO. 389 in the 11/188,298 US application
MAGELRHRRVPSSDGDGDGDEDEGVVASSQRLHSASSSAADGNGKGKAGTSSGGGEGAEPRREKRDALGWLEWGRGWMAVVGEFLFQRIAASHLANPLELPPLDGVSIVVTGATSGIGLQIARQLALAGAHVVMAVRRPKVAQDLIQKWQNENSETGRPLNAEVMELDLLSLDSVVKFADAWNARMAPLHVLINNAGIFAIGEPQRFSKDGHEEHMQVNHLAPALLAMLLIPSLLRGSPSRIVNVNSIMHTIGFVDAEDMNLRKHKYRSWLGYSNSKLAQVKFSSMLHKKIPAEAGINVVCASPGIVDTNVARDLPKIVVAAYHLIPYFIFDAQEASDPQVPEYCEMLKSEDWPVCACINYDCNPMNASEEAHNLETSQLVWEKTLEMIGLPPDALEKLIAGETVQCRYGQQEAE

SEQ ID NO: 11325 - DNA, 1968 bp, Sorghum bicolor
  misc_feature: Ceres ANNOT ID no. 6008156
  misc_feature: Encodes the peptide sequence at SEQ ID NO 11326
atggatctctacatgaaacttctcctggcctccctcagctgtattctcctgatgcaagcagcatcatgtgatggcaccacaggcgaaactgaaacggcaaactggacatgtgtatgcgcagctcatccactagatgaaccaaactctaacagcagcctgttgtccaattgctcttcatcctgccattgccaacaagatgataatggtggcacagggtcatggaactgcacatgtgccgctgataagggccttcagaaagaagaacatgctgtgctacgtgccaggagttgcttcacttcctgtaactgcacatctggtattggaagttcagaggaagggaaaaggcatgtctccagcaaaacagtcataattacgctcctagtttgtgtgattctcaccactactgctttccttgtcaccaccgtatactacttccgccgcaaggatgctctctctccacgatcgcagatatactccttcgataaatacactagctggagcagcagatcgaaccttgtcagcaatcgatcgtctccacttccccaattgaaatcaaaaccaaggcttggtgttttaaaagagtttctgtgtagctgcaacctcatctgcgggggcgaaagcggcacgttccctggtgtcattatccggttttcatacgcggagttggagcaagcaaccgggaaattctcagacgagcatcttatcggagttggtgggtcgagcaaggtgtaccgaggccagctcggcgatggcaaagttgttgccgtgaagaagcttaggcccctaggaggtgcagatgaagacttcgaattcctatcagagatcgagctgctgtcgaggctgaaccactgccacgtagtgccattgctggggtactgctcggagagccagggccggcagctggagaggctgctggtgttcgagtgcatgtccaacggcaacctgagggactgcctggacctgaagcaagggaggaggcccatggactggcagacccgggtgagcatcgctctcggcgccgctaggggggtggagtacctccatgaggcagccgccccgcgtatcctccaccgtgacatcaagtccaccaacatcctgctggatgacaagttcagagccaagatcactgaccttggcatggccaagtgcctgatgaacgacggcgtgacgagctgctcgagctccccggcgcggatgctgggcacgttcgggtacttcgcgccggagtacgccatcgtgggcaaggcgtcgctcaagtcggacgtgttcagcttcggcgtcgtcgtgctggagctcatcaccgggcggccgcccatccacaagtcgtcgtcgacgagggccgacgagagcctcgtcatctgggcgacgtcgcggctgcgggacagcaggctggtggtgacggagctgccggacccgacgctgcagggcaagttcccggcggaggagatgcagatcatggcgcacctggcgcgggagtgcctgcaatgggaccccgaggcgaggcccaccatgacggaggtcgtccagatcctcgccaccatcgcgccactccagcagggcgccaagcgccggaacctccccatcgccgccgccttcaacctcacggcgtcgccgcacgttgggaggtgcgacccggagcctaaggacgacgacgacgacatcgagaggcaacagctgcagcagcaggagtgctcgccgacgacgcccgtccagtggaaacagcaagcgcggcgcgcgccgtcgccgccaccgggccgcgcgtcgtggcccggcgacagggggaacgttgtgagcagaggcgcggtggtgtcgggcgagctggtgaacgggacgctgctgatgagcccccacgggcggggaagctggcggcggccgccaccgccgcctggcgacgacgaggaggcggtggacgtggacctgacggagcctcggatggaggcgttcacgcagccggcggcattcagatga

SEQ ID NO: 11326 - protein, 655 aa, Sorghum bicolor
  misc_feature: Ceres ANNOT ID no. 6008156
  misc_feature (229)..(511): Pfam Id: Pkinase Pfam Desc: Protein kinase domain
  misc_feature (229)..(511): Pfam Id: Pkinase_Tyr Pfam Desc: Protein tyrosine kinase
  misc_feature (217)..(539): NCBI GI: 7630064 NCBI Desc: serine/threonine-specific protein kinase-like protein [arabidopsis thaliana]
  misc_feature (184)..(539): NCBI GI: 42566031 NCBI Desc: protein kinase family protein [arabidopsis thaliana]
  misc_feature (105)..(522): NCBI GI: 102139905 NCBI Desc: protein kinase family protein [musa acuminata]
  misc_feature (193)..(514): NCBI GI: 32815839 NCBI Desc: at4g02010/t10m13_2 [arabidopsis thaliana]
  misc_feature (217)..(522): NCBI GI: 102140004 NCBI Desc: protein kinase family protein [musa acuminata]
  misc_feature: The sequence is a functional homolog of SEQ ID NO. 323 in the 11/188,298 US application
  misc_feature: The sequence is a functional homolog of SEQ ID NO. 312 in the 11/188,298 US application
  misc_feature: The sequence is a functional homolog of SEQ ID NO. 495 in the 11/188,298 US application
  misc_feature: The sequence is a functional homolog of SEQ ID NO. 520 in the 11/188,298 US application
  misc_feature: The sequence is a functional homolog of SEQ ID NO. 391 in the 11/188,298 US application
  misc_feature: The sequence is a functional homolog of SEQ ID NO. 446 in the 11/188,298 US application
  misc_feature: The sequence is a functional homolog of SEQ ID NO. 310 in the 11/188,298 US application
  misc_feature: The sequence is a functional homolog of SEQ ID NO. 340 in the 11/188,298 US application
  misc_feature: The sequence is a functional homolog of SEQ ID NO. 399 in the 11/188,298 US application
  misc_feature: The sequence is a functional homolog of SEQ ID NO. 464 in the 11/188,298 US application
  misc_feature: The sequence is a functional homolog of SEQ ID NO. 498 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 441 in the 11/188,298 US application
MDLYMKLLLASLSCILLMQAASCDGTTGETETANWTCVCAAHPLDEPNSNSSLLSNCSSSCHCQQDDNGGTGSWNCTCAADKGLQKEEHAVLRARSCFTSCNCTSGIGSSEEGKRHVSSKTVIITLLVCVILTTTAFLVTTVYYFRRKDALSPRSQIYSFDKYTSWSSRSNLVSNRSSPLPQLKSKPRLGVLKEFLCSCNLICGGESGTFPGVIIRFSYAELEQATGKFSDEHLIGVGGSSKVYRGQLGDGKVVAVKKLRPLGGADEDFEFLSEIELLSRLNHCHVVPLLGYCSESQGRQLERLLVFECMSNGNLRDCLDLKQGRRPMDWQTRVSIALGAARGVEYLHEAAAPRILHRDIKSTNILLDDKFRAKITDLGMAKCLMNDGVTSCSSSPARMLGTFGYFAPEYAIVGKASLKSDVFSFGVVVLELITGRPPIHKSSSTRADESLVIWATSRLRDSRLVVTELPDPTLQGKFPAEEMQIMAHLARECLQWDPEARPTMTEVVQILATIAPLQQGAKRRNLPIAAAFNLTASPHVGRCDPEPKDDDDDIERQQLQQQECSPTTPVQWKQQARRAPSPPPGRASWPGDRGNVVSRGAVVSGELVNGTLLMSPHGRGSWRRPPPPPGDDEEAVDVDLTEPRMEAFTQPAAFR

SEQ ID NO: 11327 - DNA, 720 bp, Sorghum bicolor
  misc_feature: Ceres ANNOT ID no. 6008237
  misc_feature: Encodes the peptide sequence at SEQ ID NO 11328
atggcgatgatgggtgctacgacgattcgtggtggtggtgctagcagcagcgtccggcctgctgtgctggtcctcggcctctgcctgctgctgctgctgctgcttggtgttgcgcaggcggtggagtttgagttggtgcctgatgctggtgccattgatccgatgatgatgcctgccatggacgacgtcgacggtggtggtcgtgagccgccgcgcgagtgcatgacaccggtgagcgtggaggaggcgtgccgcggcgcgtcggagctgcacgccggcgtggactacgaccactgcatggcgtcgctgggtgccgacccgcgcagcaaggaggccggcaacaagaacatgcacgggctggccgtgctcgccaccaagatggccatcgaccacgccgccagcaccgagtccaagatcgacgacctcgccgagctggatgcggataaccagtcgtcgtcgccgcaggcccgccgcgcccgcttcaaccactgcctcgagcagtacggcggcgccgccgacctccttcgcgacgcgctcgacaacctcaaggccaagatctacggcaaggccatggagcagctcaccgccgcgatgggcgcctccgagagctgcgaggacgcctggaagggcgaggaggaaatccccgtcgccgcgcacgacagggagtacggacggatggcgcacatcgccttcggattcacacacgcagccgccgcatga

SEQ ID NO: 11328 - protein, 239 aa, Sorghum bicolor
  misc_feature: Ceres ANNOT ID no. 6008237
  misc_feature (74)..(233): Pfam Id: PMEI Pfam Desc: Plant invertase/pectin methylesterase inhibitor
  misc_feature (67)..(238): NCBI GI: 115443647 NCBI Desc: os02g0103300 [oryza sativa (japonica cultivar-group)]
  misc_feature (80)..(236): NCBI GI: 38605751 NCBI Desc: osjnbb0016d16.4 [oryza sativa (japonica cultivar-group)]
  misc_feature (80)..(236): NCBI GI: 115460178 NCBI Desc: os04g0587200 [oryza sativa (japonica cultivar-group)]
  misc_feature (80)..(235): NCBI GI: 32395573 NCBI Desc: seed specific protein bn15d12a [brassica napus]
  misc_feature (99)..(222): NCBI GI: 20455196 NCBI Desc: pectinesterase inhibitor (pectin methylesterase inhibitor) (pmei)
MAMMGATTIRGGGASSSVRPAVLVLGLCLLLLLLLGVAQAVEFELVPDAGAIDPMMMPAMDDVDGGGREPPRECMTPVSVEEACRGASELHAGVDYDHCMASLGADPRSKEAGNKNMHGLAVLATKMAIDHAASTESKIDDLAELDADNQSSSPQARRARFNHCLEQYGGAADLLRDALDNLKAKIYGKAMEQLTAAMGASESCEDAWKGEEEIPVAAHDREYGRMAHIAFGFTHAAAA

SEQ ID NO: 11329 - DNA, 1263 bp, Sorghum bicolor
  misc_feature: Ceres ANNOT ID no. 6008818
  misc_feature: Encodes the peptide sequence at SEQ ID NO 11330
atggcccccggtggcgagggcaagccaaacacgggcggcggcggcgccaagggtggtgggaggaagcgcaagttccttccccacggcaagccggtgcggaagggggcctacccgctgcgccccggcgtgcagggcttcttcatcacctgcgacggcggccgcgagcgccaggccacccgcgaggcgctctccctccttgactccttctacgaagacttagtggatgggaaaggatcggatgacaagcctaaaaacattccagacaagccactgaacaaaaagataaagtttgaggactctgattcctcagatgatgaggatgaagaccactctggcgaggaagctgacaatgggaatgggaatgatgtggagaaagatgaaaccgctccatctgagaagcaacaggaggtacttgatacctctgataccattagcaaggacaataccactccatctgagaagcaacaggaggtacttgagacctctgataccacgagcaaggacaataccactcaatctgagaagcaacaggaggtacttgatacctctgataccacgagcaaggacaatgaggaacaaacagtcactgctgatgaaccaaaagaaaagaagcaacgtgtggaagaccctccagtttctgagcaaactgtgcaaaaagtgactgctgatcaaccaaagaggtccattgataaaccaaaagaacccagtgaaaaaaatattgatgatttaattgatgaggacctgaaagaaataggggacaggaaaaagaggctcttttcaagccttgagtctggctgcaatggatgcatattcattcaaatgcataaaagagcaggagaccctggtccagttgagattgtacaaaacatgatgtcatctgctgtttcgactcgtaaacatatgtcaagatttattctgcgagttttgcctgctgaggtgacatgctatgcatccgaagaggaaataacaaaggcaattagtccccttgttgaaaaatacttcccaaaagaatgcccttcaggccataagtttgcggtgttatatgaagcaaggtcaaacacaggaattgatagaatgaaaatcataaatgcagtagcgaaatctgtaccacaacctcataaagttgacctgagcaacccagacaagactattgttgtccagattgcaaagaccatatgcatgattggagttgtggagaggtacagagagctctcaaagttcaacctaaggcagctgacctcaccagagtcggagaagaagtag

SEQ ID NO: 11330 - protein, 420 aa, Sorghum bicolor
  misc_feature: Ceres ANNOT ID no. 6008818
  misc_feature (307)..(399): Pfam Id: THUMP Pfam Desc: THUMP domain
  misc_feature (225)..(416): NCBI GI: 119587234 NCBI Desc: thump domain containing 1, isoform cra_a [homo sapiens]
  misc_feature (224)..(420): NCBI GI: 125979711 NCBI Desc: ga13433-pa [drosophila pseudoobscura]
  misc_feature (237)..(414): NCBI GI: 55245195 NCBI Desc: ensangp00000021551 [anopheles gambiae str. pest]
  misc_feature (208)..(416): NCBI GI: 119587236 NCBI Desc: thump domain containing 1, isoform cra_b [homo sapiens]
  misc_feature (205)..(420): NCBI GI: 24657540 NCBI Desc: cg15014-pa [drosophila melanogaster]
MAPGGEGKPNTGGGGAKGGGRKRKFLPHGKPVRKGAYPLRPGVQGFFITCDGGRERQATREALSLLDSFYEDLVDGKGSDDKPKNIPDKPLNKKIKFEDSDSSDDEDEDHSGEEADNGNGNDVEKDETAPSEKQQEVLDTSDTISKDNTTPSEKQQEVLETSDTTSKDNTTQSEKQQEVLDTSDTTSKDNEEQTVTADEPKEKKQRVEDPPVSEQTVQKVTADQPKRSIDKPKEPSEKNIDDLIDEDLKEIGDRKKRLFSSLESGCNGCIFIQMHKRAGDPGPVEIVQNMMSSAVSTRKHMSRFILRVLPAEVTCYASEEEITKAISPLVEKYFPKECPSGHKFAVLYEARSNTGIDRMKIINAVAKSVPQPHKVDLSNPDKTIVVQIAKTICMIGVVERYRELSKFNLRQLTSPESEKK

SEQ ID NO: 11331 - DNA, 1488 bp, Sorghum bicolor
  misc_feature: Ceres ANNOT ID no. 6008970
  misc_feature: Encodes the peptide sequence at SEQ ID NO 11332
atggcccagcgctcgcgctcgcgctcgagggcgcggcgggacccagacctggacgaagatggttccccgccttcccggcagccgcgccccggcgccggcgacgaggacgacgaggacgacgagctggggaacgaggacctcagcctggagatcgtcgcgcgcgcgcagcggaagcagcgcggggcgtccggcgccggggtgcccgggttcgccgacctgctatcggtgtcctcgggcgacgaggaggtcgacgaggacgccgtggtggagctcgctgaggcggatgagccccggaggaaacagaagaagaagaaggagcgccggaagcagaggaagaagcatcggaaggaggcgaccgaggttgctgctgcggcggtggccgtagaggaggaagagaaggaggtttgtagcacccaggaggggccaattgggacagccgactcggtgcttactgaagatggggctgatgtccctgcatctgacaatatggttctgcggaagctccttcgcataccaagatactttgatcctggggaaacattgttggatacttgctttaattgtagtgaggaaggacatgttgctgcaaactgcccaatggaaaagcggaagaagccttgctttgtttgtgggttgttcgggcacaatgcaaagcagtgcacgcagggtcaagactgtttcatctgcaaaaaaggaggccatatggcgaaagactgccctgataagcacaagaggaatgatcatcaatccacattatgtttaagatgtggagaaacaggtcatgatatgtttggatgtaccaatgattacccacaagatgatattgagcaaataagatgctacgtgtgtaatcagaagggccatctatgttgttccgacttctctgacaattgtccaaaacaaattagctgttataattgtgctcaatctggtcattctggtctgggatgtgccaagcaacgcagggaaactagtgctgccacaagtccaaccttatgctacaaatgtggtgaggaaggtcacttcgcacgtggctgcacaaagaatgccaagtccaatcggtcgaaaggcaagtcatcatcacacagtcagaggaaggaaaaatggaaaaaggatgccagtgctagatcagctcctcatgatgcccgtaaaacaagcaaaaggaaaagtccccattttgaggaaagaatggacacacctcgtcataaatccaaatcaagaggtgggtggactggtggtgatgatgatgatctaccattgaagaagtacaaatccaatgggtggggttctccatctactcccaagaagtcttacacaaatcaccaattcttgtctggtggcgactacttcactccccagtcttcacgaaggcacaaccatggcaccacgtcaccgagctcaaattattcacccagtgctaggaaacatgggttctcgtcatcaagattcgccaccagcaacacccatgtccggtttggaaaaatttag

SEQ ID NO: 11332 - protein, 495 aa, Sorghum bicolor
  misc_feature: Ceres ANNOT ID no. 6008970
  misc_feature (183)..(200): Pfam Id: zf-CCHC Pfam Desc: Zinc knuckle
  misc_feature (224)..(241): Pfam Id: zf-CCHC Pfam Desc: Zinc knuckle
  misc_feature (331)..(348): Pfam Id: zf-CCHC Pfam Desc: Zinc knuckle
  misc_feature (132)..(222): NCBI GI: 115485975 NCBI Desc: os11g0573200 [oryza sativa (japonica cultivar-group)]
  misc_feature (185)..(472): NCBI GI: 161752 NCBI Desc: cnjb [tetrahymena thermophila]
  misc_feature (185)..(472): NCBI GI: 146182859 NCBI Desc: zinc knuckle family protein [tetrahymena thermophila sb210]
  misc_feature (185)..(346): NCBI GI: 57648428 NCBI Desc: zinc finger protein 8 [trypanosoma cruzi]
  misc_feature (185)..(346): NCBI GI: 16797820 NCBI Desc: poly-zinc finger protein 2 [trypanosoma cruzi]
MAQRSRSRSRARRDPDLDEDGSPPSRQPRPGAGDEDDEDDELGNEDLSLEIVARAQRKQRGASGAGVPGFADLLSVSSGDEEVDEDAVVELAEADEPRRKQKKKKERRKQRKKHRKEATEVAAAAVAVEEEEKEVCSTQEGPIGTADSVLTEDGADVPASDNMVLRKLLRIPRYFDPGETLLDTCFNCSEEGHVAANCPMEKRKKPCFVCGLFGHNAKQCTQGQDCFICKKGGHMAKDCPDKHKRNDHQSTLCLRCGETGHDMFGCTNDYPQDDIEQIRCYVCNQKGHLCCSDFSDNCPKQISCYNCAQSGHSGLGCAKQRRETSAATSPTLCYKCGEEGHFARGCTKNAKSNRSKGKSSSHSQRKEKWKKDASARSAPHDARKTSKRKSPHFEERMDTPRHKSKSRGGWTGGDDDDLPLKKYKSNGWGSPSTPKKSYTNHQFLSGGDYFTPQSSRRHNHGTTSPSSNYSPSARKHGFSSSRFATSNTHVRFGKI

SEQ ID NO: 11333 - DNA, 1041 bp, Sorghum bicolor
  misc_feature: Ceres ANNOT ID no. 6009147
  misc_feature: Encodes the peptide sequence at SEQ ID NO 11334
atggatgtgtcttatgagaagtttgctgatccatcaaactcggacctgcctagcgctgttgatgttgagcaatctgaaaatggcagctctgaacatttgggatctgcagttgtcaagggagctactggaaatgaaggttattcaggcatcgaaagttctgagcagaccgatgatgagttggctggagatgaaggctctcttgttaatgttgaaaatagtgctgataaacaagagaaccaggaaacggttccaatggaagaaacagcaatgagtgatggcacttcgatcacatcgatggaagatgcactggaaccgaataatgatctcccatcagagcctgaagatatgagcaaccacactcctgatccatcaaatggtaaatctgtcaatggaaatcgtaatgtattccaaagtgcaaagagggtgttgacttcaacgaagacgaaaactccatctgcaactacacggaagccactacaatctactaacagaggtaatcaggatgatgcgaaatcatcagttggaaaggccacagttccatcaggcccagttttccgttgtactgaacgtgccgagaaacgcagagaattttatatgaagttggaggagaagcatcaagctatggaggaagagaagattcagttggaggctaagttgaagaaagagcaggaggaggctctgaagcagctgagaaagagcctgaccttcaaagccaacccgatgccaagcttctaccacgaggcgacgccgtcccccaaggccgaattcaagaagctgcccacgacccggcccaagtcgccgaagctgggtaggaggaagacgacgacgacgacctccatggagacgtccaactcctcgtcggagagcgagggcgccacgaggccgtgctgccgcgccagccgcgacggcctcgacagcaactgcaaatgcagcggcgctagcagaagcaaggccgggcccaagaaacagcagcagcagccgaagcaccgcgcccacaagatcgccgccggcgagggcgccatcaacatcgccgtgcactag

SEQ ID NO: 11334 - protein, 346 aa, Sorghum bicolor
  misc_feature: Ceres ANNOT ID no. 6009147
  misc_feature (185)..(241): Pfam Id: TPX2 Pfam Desc: Targeting protein for Xklp2 (TPX2)
  misc_feature (127)..(311): NCBI GI: 92874845 NCBI Desc: targeting for xklp2 [medicago truncatula]
  misc_feature (79)..(274): NCBI GI: 32395575 NCBI Desc: seed specific protein bn15d14a [brassica napus]
  misc_feature (105)..(331): NCBI GI: 42733498 NCBI Desc: bri1-kd interacting protein 118 [oryza sativa (japonica cultivar-group)]
  misc_feature (65)..(259): NCBI GI: 140057127 NCBI Desc: targeting for xklp2 [medicago truncatula]
  misc_feature (51)..(318): NCBI GI: 42733494 NCBI Desc: bri1-kd interacting protein 116 [oryza sativa (japonica cultivar-group)]
MDVSYEKFADPSNSDLPSAVDVEQSENGSSEHLGSAVVKGATGNEGYSGIESSEQTDDELAGDEGSLVNVENSADKQENQETVPMEETAMSDGTSITSMEDALEPNNDLPSEPEDMSNHTPDPSNGKSVNGNRNVFQSAKRVLTSTKTKTPSATTRKPLQSTNRGNQDDAKSSVGKATVPSGPVFRCTERAEKRREFYMKLEEKHQAMEEEKIQLEAKLKKEQEEALKQLRKSLTFKANPMPSFYHEATPSPKAEFKKLPTTRPKSPKLGRRKTTTTTSMETSNSSSESEGATRPCCRASRDGLDSNCKCSGASRSKAGPKKQQQQPKHRAHKIAAGEGAINIAVH

SEQ ID NO: 11335 - DNA, 1041 bp, Sorghum bicolor; identical to SEQ ID NO: 11333
  misc_feature: Ceres ANNOT ID no. 6009151
  misc_feature: Encodes the peptide sequence at SEQ ID NO 11336

SEQ ID NO: 11336 - protein, 346 aa, Sorghum bicolor; identical to SEQ ID NO: 11334
  misc_feature: Ceres ANNOT ID no. 6009151
  misc_feature (185)..(241): Pfam Id: TPX2 Pfam Desc: Targeting protein for Xklp2 (TPX2)
  misc_feature (127)..(311): NCBI GI: 92874845 NCBI Desc: targeting for xklp2 [medicago truncatula]
  misc_feature (79)..(274): NCBI GI: 32395575 NCBI Desc: seed specific protein bn15d14a [brassica napus]
  misc_feature (105)..(331): NCBI GI: 42733498 NCBI Desc: bri1-kd interacting protein 118 [oryza sativa (japonica cultivar-group)]
  misc_feature (65)..(259): NCBI GI: 140057127 NCBI Desc: targeting for xklp2 [medicago truncatula]
  misc_feature (51)..(318): NCBI GI: 42733494 NCBI Desc: bri1-kd interacting protein 116 [oryza sativa (japonica cultivar-group)]

SEQ ID NO: 11337 - DNA, 1098 bp, Sorghum bicolor
  misc_feature: Ceres ANNOT ID no. 6009568
  misc_feature: Encodes the peptide sequence at SEQ ID NO 11338
atgtcaagcacggcagagtctgccgtcggcagcggccacggcgaggcggtgaccacgtcggctatcgtggccgaggctgtgactgggtcacacgtgctccagatcaaagggtactccttgaccaaggggcttggcattggcaaattcatcaaatccagcacgttctgcgtgtgtggccatcgctggtatattaggtactaccctgatggcgattgtttggacagtgccgattggatatctatctatcttcagcatgatcatacagatgctgtagacgtcaaagctcgattcaaattcagtgttctcgacgacattggtgaacctgtgccgacgttcagccagaaatcctgtatgcgtaccttctcgtcgtccaaaggtggatcctggggtttcaacaaattcgttgcaagaaaggccctggaggaatcatcgtcttatctgaaagatgattgcctcaaggtaaggtgcgatgtcaccgtctcaaaggagatcagcacagaggccacaaccacaacacagtgtgtcatggtgccgccgtccaacatgcacctgcactttggctgcctcctctcaggcgcagtgggggccgatgtcacatttgatgttgccggagagatgtttgctgcacacaggtgtgtgctggctgcaaggtcgtcggtgttcaaggctgagctctttggccccatgaaggagaaggccatgaactctatacggatccaagaaatggaagcaagggtgttcaaggctatgctccacttcatctacactgacgccttgcctttcattgaaaagggagatgtgtttctgattacccagcatttacttgtagcagcagacagatatgatctagagaggctcaaactgatttgcgaggtcaagctctgcaagtgcatcgacacaagcaccgtggccgctacactggtgctcgctgagcggcatggttgccaggggctcaagaaggcatgttttgagttgctgaagtcgcctgtccatctgaagacagtcatggcaacagagggctttgatcatctgttgactacttgcccatctcttatcaaggagctgctgctagccaaggatgctgctacctgtccttga

SEQ ID NO: 11338 - protein, 365 aa, Sorghum bicolor
  misc_feature: Ceres ANNOT ID no. 6009568
  misc_feature (186)..(298): Pfam Id: BTB Pfam Desc: BTB/POZ domain
  misc_feature (124)..(356): NCBI GI: 115482086 NCBI Desc: os10g0423600 [oryza sativa (japonica cultivar-group)]
  misc_feature (1)..(356): NCBI GI: 115482084 NCBI Desc: os10g0423300 [oryza sativa (japonica cultivar-group)]
  misc_feature (5)..(356): NCBI GI: 115482128 NCBI Desc: os10g0429400 [oryza sativa (japonica cultivar-group)]
  misc_feature (16)..(260): NCBI GI: 115482088 NCBI Desc: os10g0423800 [oryza sativa (japonica cultivar-group)]
  misc_feature (2)..(313): NCBI GI: 115486317 NCBI Desc: os11g0622600 [oryza sativa (japonica cultivar-group)]
  misc_feature: The plant is abnormally small.
  misc_feature: The sequence is a functional homolog of SEQ ID NO 1918 in the 10/374,780US patent application
  misc_feature: Useful for making plants with modulated biomass
  misc_feature: Useful for making plants with modulated growth and phenotype characteristics
  misc_feature: Functional homolog of the protein sequence given in SEQ ID NO 12898
  misc_feature: The sequence is a functional homolog of SEQ ID NO 1918 in the 20060162006 US patent application
MSSTAESAVGSGHGEAVTTSAIVAEAVTGSHVLQIKGYSLTKGLGIGKFIKSSTFCVCGHRWYIRYYPDGDCLDSADWISIYLQHDHTDAVDVKARFKFSVLDDIGEPVPTFSQKSCMRTFSSSKGGSWGFNKFVARKALEESSSYLKDDCLKVRCDVTVSKEISTEATTTTQCVMVPPSNMHLHFGCLLSGAVGADVTFDVAGEMFAAHRCVLAARSSVFKAELFGPMKEKAMNSIRIQEMEARVFKAMLHFIYTDALPFIEKGDVFLITQHLLVAADRYDLERLKLICEVKLCKCIDTSTVAATLVLAERHGCQGLKKACFELLKSPVHLKTVMATEGFDHLLTTCPSLIKELLLAKDAATCP

SEQ ID NO: 11339 - DNA, 1326 bp, Sorghum bicolor
  misc_feature: Ceres ANNOT ID no. 6009595
  misc_feature: Encodes the peptide sequence at SEQ ID NO 11340
  misc_feature: Up-regulated in shoot tissues in response to methyl jasmonate treatment
atgcacccgcagcggatgaagcaggccgcggcgcagcagcagctgatgcagcaggccctgctcctgcagcagcagcaggcgcagcagccgcccttgttcccggggcaccaccacccgcaccccggcctcctcgccgcgccacagatggagccaatagttagtggaaacctgcctcctgggtttgattcgagtacatgccgcagcgtgtatgttggcaatatcagtcttcaagtgacggacacagtactgcaggaagtcttccaaagtattggtccagtagaagggtgcaaactcatcaggaaagaaaagtcatcctttggtttcattgactactatgaccgcagatatgctgcactagcaattttatctctcaatggcagaccactgtatggtcagccaataaaagttaattgggcatatacaagtactcagagggaggatacatcaggtcattttaatatttttgttggggatctttgcccagaagtcactgatgctactttgtttgcatttttctctggatactctacctgctcagatgctagggttatgtgggaccagaaaacaggacgatccagagggtttggttttgtttctttcaggaaccagcaggatgctcaaagtgcgataaatgacttgaatgggaagtggcttggcaaccgtcaaattcgttgcaattgggcaacgaaaggtgccaatgctggtgaagagaaacagattgtggactccaaggttgacctgacaaatggcacatcagaatctggaaaagagaatccaaatgaagatggtcctgaaagtaaccctcagtttactactgtctatgttggcaatcttcctcacgaggctaccaacaatgatgtgcacctgtttttccattcacttggggctggctcaattgaggaagtccgtgtaactcgtgataaaggctttggttttgtaaggtacagcacccatgaggaggctgcgcaggcaattcagatggctaatggccaacttattggcgggaggcagataaagtgttcctggggaagcaaaccgactccaccagggacagcatcctcgcctctgcctcctccagcaccggcactgttctccactggagtgtcgccgacagacttcctggcataccagcgcatggccctgaacaagatggccacgaacccatccctaatgggtcagcacgccttgaatcaggtcgcactggggatgggtggccgagccagccagtccatctatgatggcggcttccagggcatcagtactgccgccgccacaacctccgcccagcaacaacagcagcagcagcagcagctcatgtactactag

SEQ ID NO: 11340 - protein, 441 aa, Sorghum bicolor
  misc_feature: Ceres ANNOT ID no. 6009595
  misc_feature (69)..(136): Pfam Id: RRM_1 Pfam Desc: RNA recognition motif. (a.k.a. RRM, RBD, or RNP domain)
  misc_feature (154)..(225): Pfam Id: RRM_1 Pfam Desc: RNA recognition motif. (a.k.a. RRM, RBD, or RNP domain)
  misc_feature (273)..(340): Pfam Id: RRM_1 Pfam Desc: RNA recognition motif. (a.k.a. RRM, RBD, or RNP domain)
  misc_feature (1)..(420): NCBI GI: 82400162 NCBI Desc: oligouridylate binding protein-like protein [solanum tuberosum]
  misc_feature (15)..(421): NCBI GI: 6996560 NCBI Desc: oligouridylate binding protein [nicotiana plumbaginifolia]
  misc_feature (180)..(417): NCBI GI: 4680498 NCBI Desc: tia-1 related protein [oryza sativa]
  misc_feature (48)..(216): NCBI GI: 8778484 NCBI Desc: f1l3.2 [arabidopsis thaliana]
  misc_feature (25)..(421): NCBI GI: 92891800 NCBI Desc: rna-binding region rnp-1 (rna recognition motif) [medicago truncatula]
  misc_feature: Useful for making plants with altered Lignin content
  misc_feature: GREAT-hit functional homolog of the protein sequence given in SEQ ID NO 12901
  misc_feature: Useful for making plants with altered lignin content
  misc_feature: Functional homolog of the protein sequence given in SEQ ID NO 12901
  misc_feature: Up-regulated in shoot tissues in response to methyl jasmonate treatment
  misc_feature: The sequence is a functional homolog of SEQ ID NO. 339 in the 11/188,298 US application
  misc_feature: The sequence is a functional homolog of SEQ ID NO. 458 in the 11/188,298 US application
MHPQRMKQAAAQQQLMQQALLLQQQQAQQPPLFPGHHHPHPGLLAAPQMEPIVSGNLPPGFDSSTCRSVYVGNISLQVTDTVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGANAGEEKQIVDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKCSWGSKPTPPGTASSPLPPPAPALFSTGVSPTDFLAYQRMALNKMATNPSLMGQHALNQVALGMGGRASQSIYDGGFQGISTAAATTSAQQQQQQQQQLMYY

SEQ ID NO: 11341 - DNA, 879 bp, Sorghum bicolor; identical to SEQ ID NO: 11253
  misc_feature: Ceres ANNOT ID no. 6009664
  misc_feature: Encodes the peptide sequence at SEQ ID NO 11342

SEQ ID NO: 11342 - protein, 292 aa, Sorghum bicolor; identical to SEQ ID NO: 11254
  misc_feature: Ceres ANNOT ID no. 6009664
  misc_feature (80)..(266): Pfam Id: Hydrolase Pfam Desc: haloacid dehalogenase-like hydrolase
  misc_feature (66)..(291): NCBI GI: 3759179 NCBI Desc: 3-phosphoserin phosphatase [arabidopsis thaliana]
  misc_feature (69)..(291): NCBI GI: 117970179 NCBI Desc: pxphosphoserine phosphatase [plutella xylostella]
  misc_feature (75)..(291): NCBI GI: 114107987 NCBI Desc: psph protein [xenopus tropicalis]
  misc_feature (75)..(291): NCBI GI: 49898873 NCBI Desc: psph-prov protein [xenopus laevis]
  misc_feature (79)..(291): NCBI GI: 31615697 NCBI Desc: chain b, crystal structure of human phosphoserine phosphatase
  misc_feature (66)..(291): SWISSPROT Homolog: EC 3.1.3.3 Phosphoserine phosphatase, chloroplast precursor

SEQ ID NO: 11343 - DNA, 1539 bp, Sorghum bicolor
  misc_feature: Ceres ANNOT ID no. 6009694
  misc_feature: Encodes the peptide sequence at SEQ ID NO 11344
atggcacacgctgcctgtggcactgaggcgccgctcctgccctcctcggcggcagggacgccgccgccgccggcagccggtgcaccgcgccggaactggttcgccttcgtctgcgccacgctcgcctccatgaccaccatgctacatgcctacaagaagcttgttgcagacctgacactgatgagcggcgcggagctgttcatgcgtgaggacgtggggctcaccgacgccgaggtcgaggtgctgtccgggtcgatgaacgtcttcatgctcgcgtccatcctcgccgccggctgggtggccgaccaccttggccgccgccgcaccctcgtgctcgccaacgccttcctcatggccggcgcgctcgccatgtcgctgggcgccagcttcgccgcgctcatggcggcgcgcttcgtcaccagcgtcggctccgggttcgcccgcgtcgtcgcccccgtctacaacgccgagatctcgccggcgtccacccgcggcgtcctctcatccatgcttgacatatttatcaacgtcggcatcctgctcagctacgtgtccaactacgcgttcgccggcctgccggtgcacctcgggtggcgagtcatgtatgggatcggcgtgatcccaccggtgttcatcgccgccggggtgctcttcatcatgccggagtcaccgcggtggcttgtcatgcagggccgccacggcgacgcgcgcggggtgctgctgcgcacgtcggacgccccggccgaggccgacctccgtctcggggagatgaagcgagccgtcgtcactgacgccgccgaggcgccgccgtccgctgctgctgctgctgcacgccacggcggcggcggcggcgtctggaaggagcttttcttgcggccgtccacgagcgtgcggcggatcctcgcgtgcgtcctcgggctgcagttcttcgtgcaggcgtccggcgtcgacgccatcctcctctacagcccgctggttttcaaggcggtcggcatggcgtcgaactccgccgtcctcggcgccaccgtggccatcggagcggtgaagacgtgcttcatcctcgtgggcatgctcttcaccgaccgcctcggccggcgcccgctcctcctcgccagcaccgcgggcgtcgccgtgacctccaccgtcctcgccgtgacgctgtacgtagccacgagcacgacgtcgtcttcgtcgtcgtcaacgacgacggcgacggccgcggcgtgcctggcgtcggtgctggccgtcgtggccacgtactccatcgggtacgggtcagtggtgtcggcgtacacggcggaggtcttgcccctgcggctgcgcgcgcagggctccagcctgggcgtggcggtgaacaggctcacgtgcggggtggtgagcatgacgttcatctcgctcgccgacgggatcgtcaccatgcctgggtgcttcttcctctacgcggcggtgacggcggctgcgtttgtgtttgtgtacacgcggctgccggagaccaagggtcggagcttggaggacatggaagtgctcttccacaagtga

SEQ ID NO: 11344 - protein, 512 aa, Sorghum bicolor
  misc_feature: Ceres ANNOT ID no. 6009694
  misc_feature (38)..(510): Pfam Id: Sugar_tr Pfam Desc: Sugar (and other) transporter
  misc_feature (35)..(460): Pfam Id: MFS_1 Pfam Desc: Major Facilitator Superfamily
  misc_feature (10)..(412): NCBI GI: 77552119 NCBI Desc: sorbitol transporter [oryza sativa (japonica cultivar-group)]
  misc_feature (27)..(428): NCBI GI: 77552122 NCBI Desc: sorbitol transporter [oryza sativa (japonica cultivar-group)]
  misc_feature (27)..(428): NCBI GI: 115486381 NCBI Desc: os11g0637400 [oryza sativa (japonica cultivar-group)]
  misc_feature (23)..(512): NCBI GI: 51849627 NCBI Desc: sorbitol transporter [malus x domestica]
  misc_feature (9)..(510): NCBI GI: 77556301 NCBI Desc: sugar transporter [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MAHAACGTEAPLLPSSAAGTPPPPAAGAPRRNWFAFVCATLASMTTMLHAYKKLVADLTLMSGAELFMREDVGLTDAEVEVLSGSMNVFMLASILAAGWVADHLGRRRTLVLANAFLMAGALAMSLGASFAALMAARFVTSVGSGFARVVAPVYNAEISPASTRGVLSSMLDIFINVGILLSYVSNYAFAGLPVHLGWRVMYGIGVIPPVFIAAGVLFIMPESPRWLVMQGRHGDARGVLLRTSDAPAEADLRLGEMKRAVVTDAAEAPPSAAAAAARHGGGGGVWKELFLRPSTSVRRILACVLGLQFFVQASGVDAILLYSPLVFKAVGMASNSAVLGATVAIGAVKTCFILVGMLFTDRLGRRPLLLASTAGVAVTSTVLAVTLYVATSTTSSSSSSTTTATAAACLASVLAVVATYSIGYGSVVSAYTAEVLPLRLRAQGSSLGVAVNRLTCGVVSMTFISLADGIVTMPGCFFLYAAVTAAAFVFVYTRLPETKGRSLEDMEVLFHK

SEQ ID NO: 11345 - DNA, 1968 bp, Sorghum bicolor
  misc_feature: Ceres ANNOT ID no. 6009723
  misc_feature: Encodes the peptide sequence at SEQ ID NO 11346
atggccgccacggcgcccttctcctccgcctcctcctcgcacccacctcgcctaccctccaaaactctgacgtctcgtcactcccgcccgctccaccacaggtcaccgcccgcagcctccgccccgcgctcgcgcccgctgctcctctccttccccgcgcccgcacgccgctccggcgctggactccgcgcttcagccgcgcagaaaatctctgtcgattaccagttcgatgaagaagacgatgacgaggaggagtacgaatacgacggcgaggaggaggaggaggagtgggaggaggatgaagatgaggaggcgatggacgtggaggcgttggaggaggaggcccgcggcgccgccgccgacctcgccaaacgcctcgcacgggagctccacatcgatgatgatgtgagggagaaacgaagaaacatcagggataagacatctgtgtctaaacatattccagataatcttcttccgaaggtggcaattattgggaggccaaatgtcggtaaatctgcgctgttcaaccgtcttgtcggaggaaatagggctatagttgttgatgaacctggtgtgacaagggatcggttatatggacgatcctactggggtgatcaggagtttatggttattgatactggtggggtaattactttgtcaaagtctcaagcaggggtgatggaagaacttgccgtcaccactactgttggtatggatgggattcctctcgccactagagaagctgctattgcaaggatgccatcaatgattgaaaaacaagcagttgcagctgttgatgaggcatccgtcatactattcgtcgtggatggtcaggcagctgatatagagatttctgattggttgcgacgcaactactctgacaagtgtgttatacttgctgtcaataagtgtgaatctccacggaaagggcaaatgcaagcattagacttttggtcactagggttttctcctctgccaatttctgctattactggcacaggaactggagatctccttgacctggtgtgttcagagctgagaaaatttgagggattggatacagttgaagaagagaaaaataaggttcctgctattgccattgtgggaagaccaaatgtgggcaaaagtagcattctaaatgctttggttggagaagatagaactattgtgagcccagttagtgggacaacacgtgatgccattgatactgagtttactacagcagatggggagaagtacaaactcattgatactgctgggatccggcgcagggcagcagttatttctgctggcagcacaacggaatcgctttcagtaaagcgtgcatttcgagcaattcggcgctctgatgtggttgcccttgttatcgaggcaatggcctgtgttaccgagcaggattataaaattgcagagaggattgagaaagaaggaaaagcttgtgtcattgttgtgaacaaatgggatacaatcccaaacaagaaccatgagagtacaacacattatgaacaagatgtaagagaaaagcttcgcatacttgattgggcacctattgtctactgttctgcgactaatggcaccagtgtcgaaaagataatttctgctgctgctttggttgagaaggaaaggtctagaagactcggcacctccattcttaatcaagttattagagaagctatagcattcaaaccaccaccaagaacaagaggtggcaaaagaggtcgtgtctattatacaacacaggctgccattggtccaccaacattcgttttatttgtaaatgatgcgaagctcttccctgatacataccgccgttacatggaaaagaaactccggtcagatgctgggtttccaggcactcctattcgtttattgtggcgtagcagaaggcgtccagacaaacgaggtaaatctgctgatagtagaacgcagagcccaggaacccctagcaaaatggttctagctgcctaa

SEQ ID NO: 11346 - protein, 655 aa, Sorghum bicolor
  misc_feature: Ceres ANNOT ID no. 6009723
  misc_feature (159)..(305): Pfam Id: MMR_HSR1 Pfam Desc: GTPase of unknown function
  misc_feature (363)..(488): Pfam Id: MMR_HSR1 Pfam Desc: GTPase of unknown function
  misc_feature (364)..(488): Pfam Id: Miro Pfam Desc: Miro-like protein
  misc_feature (365)..(487): Pfam Id: Dynamin_N Pfam Desc: Dynamin family
  misc_feature (360)..(540): Pfam Id: GTP_EFTU Pfam Desc: Elongation factor Tu GTP binding domain
  misc_feature (71)..(635): NCBI GI: 30682040 NCBI Desc: gtp-binding family protein [arabidopsis thaliana]
  misc_feature (137)..(635): NCBI GI: 9294105 NCBI Desc: gtp-binding protein-like [arabidopsis thaliana]
  misc_feature (71)..(580): NCBI GI: 145332365 NCBI Desc: emb2738 (embryo defective 2738) [arabidopsis thaliana]
  misc_feature (341)..(654): NCBI GI: 115486387 NCBI Desc: os11g0638000 [oryza sativa (japonica cultivar-group)]
  misc_feature (256)..(629): NCBI GI: 119513020 NCBI Desc: small gtp-binding protein domain [nodularia spumigena ccy9414]
MAATAPFSSASSSHPPRLPSKTLTSRHSRPLHHRSPPAASAPRSRPLLLSFPAPARRSGAGLRASAAQKISVDYQFDEEDDDEEEYEYDGEEEEEEWEEDEDEEAMDVEALEEEARGAAADLAKRLARELHIDDDVREKRRNIRDKTSVSKHIPDNLLPKVAIIGRPNVGKSALFNRLVGGNRAIVVDEPGVTRDRLYGRSYWGDQEFMVIDTGGVITLSKSQAGVMEELAVTTTVGMDGIPLATREAAIARMPSMIEKQAVAAVDEASVILFVVDGQAADIEISDWLRRNYSDKCVILAVNKCESPRKGQMQALDFWSLGFSPLPISAITGTGTGDLLDLVCSELRKFEGLDTVEEEKNKVPAIAIVGRPNVGKSSILNALVGEDRTIVSPVSGTTRDAIDTEFTTADGEKYKLIDTAGIRRRAAVISAGSTTESLSVKRAFRAIRRSDVVALVIEAMACVTEQDYKIAERIEKEGKACVIVVNKWDTIPNKNHESTTHYEQDVREKLRILDWAPIVYCSATNGTSVEKIISAAALVEKERSRRLGTSILNQVIREAIAFKPPPRTRGGKRGRVYYTTQAAIGPPTFVLFVNDAKLFPDTYRRYMEKKLRSDAGFPGTPIRLLWRSRRRPDKRGKSADSRTQSPGTPSKMVLAA

SEQ ID NO: 11347 - DNA, 2094 bp, Sorghum bicolor
  misc_feature: Ceres ANNOT ID no. 6009739
  misc_feature: Encodes the peptide sequence at SEQ ID NO 11348
atgccggccacggcgagcgtcggcggcgcgcggccggagccggaggaggcgtcgcccgcgccggcacccgcgtcgacgtccgcgtcgagctgcatggggacgaggccggaggagctgacggcgaggctggcggccgcggggccggggcccgccgagggctgcggcggcgccggcgccggcggagaggaggtggagcacgagcgcgtccgcgcgctgcgcgagatcaagaaccagatcatcgggaaccggaccaagaagctcctgtacctccgcctgggcgccgtgccgtcggtcgtggcggcgctggcggagcccggagcctcgccggcggcgctcgtgcaggcggccgccgcggcggggagcttcgcgtgcggcgtggaggatggcgcgcgcgccgtgctggccgccggcgctgtggagcacctcactcgcctcctcgctcatcccgatgagaaggttgtggacgcaagtgcacgtgctctcagaatgatatatcaatcaagattagctccaaagtttgatgttaatagtggggaaaacatggattttgttctttcgcttttggacagtgagaacgagaatgtcacagagctggctgctgctattatatctcactcttgtgagagtagtgcagaacaattatcactatgcagtgctggagttccacagaaacttgttagcctttttggaggatctatgaatctacgggatgcttgtttaggttctgtcactgcagtcattcgaaataacagagacgttgcttcaagatttgcatcaacggaccatggaaaaggttttcgttcagtagttggtttaatacatgatcggagtccacacacaagactacttgcttgcctctgcttaattgcacttgggcatgcttctccctgtcattttcaggacaaacagattaagacgaagttgattatggttttgcttgagctaattgaagaacctggtcacgtaggagatgaagctcccttggcattaaccaccctgattaaagacagcttcgaactgcagaaacaagctcttacaacgaatgcagttgagaagctcagcaaccatctgctagcaaatccattggagacaaggcgagcagtgaccataatgcttgcattatctgaactttgctcaaaacttgaagagtcaagatctcaactaatgtcggttgaggtatcagccttactccttgaggcattgaagcatgattgggctgatatccgcattgcagcatgttcatgtctgaagaatatctccaggtcaccaaaggtactcagtggaggtcgattatcctgcgatacagttattggtcccctagtccagcttttaaatgactcatcaacatcggtccaggttgccgcccttggtgccatttgcaatattgctgttaatttgacacccaggaaatcagttcttcttcactctggggtcgtctcacaacttgttcatttgtcaaagtccatggatccaatgttgaggctaaaatctgtatgggctctcaggaatattatgttccttcttagtcctaaggataaagacttcattgttaaggagttgaccttatctactctttcaagcctcatttgtgattctgaacattttgttcaagaacagaccttggcacttgtgcacaatcttgttgatggatatgtggactctgctaattatgtcattggtgaagatggaatggttatggatgctattgcaagacaactgatcaatgcatctgccccgggagtgtgcattcagggtatgtacgtgcttgcaaacattgcggctggaaacgaattgaacaaggaagctgtaatgaatgttcttcttcctcacagagcagatcgcatcaaaccattatttgtagtgaactttctgcaaagcaaggataaacagttgcgggttgccaccctgtggtgccttctgaacttgatttaccccaaatgtgaagcctcatctggtagagttgtcagattacaaaatgctggagtgatccaacaagtgaaaagcatgataaatgacccctgcttggattgcaagcttagagtacgtatggtgcttgaacactgcgtggacaatgccgatgattgtttcatgtga

SEQ ID NO: 11348 - protein, 697 aa, Sorghum bicolor
  misc_feature: Ceres ANNOT ID no. 6009739
  misc_feature (466)..(506): Pfam Id: Arm Pfam Desc: Armadillo/beta-catenin-like repeat
  misc_feature (518)..(697): NCBI GI: 115486393 NCBI Desc: os11g0638900 [oryza sativa (japonica cultivar-group)]
  misc_feature (75)..(686): NCBI GI: 119599488 NCBI Desc: armadillo repeat containing 8, isoform cra_g [homo sapiens]
  misc_feature (330)..(686): NCBI GI: 119599481 NCBI Desc: armadillo repeat containing 8, isoform cra_a [homo sapiens]
  misc_feature (330)..(686): NCBI GI: 45710107 NCBI Desc: armadillo repeat containing 8 [homo sapiens]
  misc_feature (330)..(686): NCBI GI: 32526896 NCBI Desc: armadillo repeat containing 8 [homo sapiens]
MPATASVGGARPEPEEASPAPAPASTSASSCMGTRPEELTARLAAAGPGPAEGCGGAGAGGEEVEHERVRALREIKNQIIGNRTKKLLYLRLGAVPSVVAALAEPGASPAALVQAAAAAGSFACGVEDGARAVLAAGAVEHLTRLLAHPDEKVVDASARALRMIYQSRLAPKFDVNSGENMDFVLSLLDSENENVTELAAAIISHSCESSAEQLSLCSAGVPQKLVSLFGGSMNLRDACLGSVTAVIRNNRDVASRFASTDHGKGFRSVVGLIHDRSPHTRLLACLCLIALGHASPCHFQDKQIKTKLIMVLLELIEEPGHVGDEAPLALTTLIKDSFELQKQALTTNAVEKLSNHLLANPLETRRAVTIMLALSELCSKLEESRSQLMSVEVSALLLEALKHDWADIRIAACSCLKNISRSPKVLSGGRLSCDTVIGPLVQLLNDSSTSVQVAALGAICNIAVNLTPRKSVLLHSGVVSQLVHLSKSMDPMLRLKSVWALRNIMFLLSPKDKDFIVKELTLSTLSSLICDSEHFVQEQTLALVHNLVDGYVDSANYVIGEDGMVMDAIARQLINASAPGVCIQGMYVLANIAAGNELNKEAVMNVLLPHRADRIKPLFVVNFLQSKDKQLRVATLWCLLNLIYPKCEASSGRVVRLQNAGVIQQVKSMINDPCLDCKLRVRMVLEHCVDNADDCFM

SEQ ID NO: 11349 - DNA, 2727 bp, Sorghum bicolor
  misc_feature: Ceres ANNOT ID no. 6009788
  misc_feature: Encodes the peptide sequence at SEQ ID NO 11350
atggtgtctgctgttgaagagcttagtgggttaacctctaaagaacttggggagatgctgaaggagtcagacaattttgttttgcagtccaagacagaagatggagttccaaagcaggtggacatggaaaaacttgtgtcctcgcttcctcttcatctccttgctgtatgtttggagcttgggcaaggcctggacttgacttatgtgcttcgtggcatgcgctttttgcatagtttgtctgatctagcatcccgccatactagactggagcaggttcttcttgatgatgtcaaattatccgaacaagtcatggacctgatattcttcctactttctattcttgctgaacagaagaaggagaataatgacggtgcttctccgcttgtgcatgcgtcacttgtagcagctagtcttcatctgttgacaagttacttctcttcccagtggcatgaacttgtccatattctgcttgcacatccaaaggttgatatctttatggatgtggcctttgatagtttgcatgaagatgtgaggctgctaaatatcagattgtcatccatgggctctggttcctttcatgttggttctttggaatctcgtcgtgctcacttcatctgccaacagtgtgaagcatcactgcaatttctcttgttgttgtgccagcaaaagctgtttcgagatcggattttaaaaaataaggaactctctagaaatggaggcatactgtcactttcgcacactatactgaagttagttgtccctgaatgtttgaagcaatcaaccgatcttgttgcttctatttccaggctcaaggcaaagatactttctattctgttgcaactttgtgaggctgaaagtgtctcttaccttgatgaagttgccactaacccaaacagcaggcggctagggcaaaccttggctctagaggttcttaatttgctgaagattgcatttggaagaaaacaaaacaatacttctgattctcatgataagggtaagttttaccccatgggatctgtgcttatcagtgcattgcgtcttgttgatgtcttctctgatgattcaaacttcagatcttccttcatgactaacactgtcccgtttttaacccagattttagcaactgctcatgaggaatttgtttcgagttggtgctctgccaacgtaccagcaattgaggaagatgcaagtctagattatgatccttttggtgcatcagaggtggcactgttagcttctgataatgtgttgactgaagctaaagctaactattcatgcccttttcgccctagcctgccttcaatgcaatatgcacagacaagaacatcatgtgtagtgaaaataatagcaaatttgcatatttttgttccaaacatttgtgaagagcaagaaagagatctttttcttcagagctttcaaaagtacttggtgtctgggagtcctaaactatcatcagaccagccagcttctagtgattttaaggccactaaagtctgtacaaacttaggatctttgtctgattatgctaaaacattggttcctaatttcttaaatgtggaagacgtggtgttattaagtgatttttctgataagctacaatcttggtgtaaatcagaagttgggcaagttgcagtgaagcagcccttgctaacacggacaagccctccggactccaaaatgaataaccttccaaaggatgtgcagaacatggaagtgtctacgccaatacccccaataaatccacagggaaatggtaaggacgagactccaaagaacactgtctctagaaatggtggtttcctgcagaatgcagttggtcaagacctagtccatcttggcgttgcaagaacagccagtggtggctcttcggctgtcgcttctggtgttagcactggacaccagcgcagcaaaatggatcttgatccagcatccagcagcgtggataatttcaaaacaccagaactgacaaaagaaaatggtctccaggaggatgagaaaggggagagtagtatgtatgatgagaggcaacctaagagaaggaagcggacccttatgaataatgagcaaatagatgaattagagaaggctctagtagatgagcctgagatgcacaagaacgctgttctattgcagagttggtcagagaagttaagtctgcagggctcagagatcacagcatcacaacttaaaaactggttgaacaaccggaaagctaagcttgctcgcattgcaaaagaaagaggaccatttgagggggagaatgctgataagccatctacaccatccactatccatcttggcgagtcttccgaaagtgccggggaggacaactatctaccccctgcgagagtgatgaacgctctatccaaaggcagactggtgagcccagacagcaatgagcaaatgtcgcaggcagagttatccccgaacacgatgctgatccgtccattcacgaggtccttctcactggagccaggccgcctcgtttcattagttgacagcgacgggaaggaggttggcaggggcaagatcttccaaacgccagggaagagcccagcggagagccgtgtctgcatggttgatgttaccgagctcaggaccgagaagtggagggagctcccgcacccttctgaggcatctgggaggacgttccaggaggctgaggcgaggaatggtggcatcatgagggtctcttgggacgtcgtcaggctgtcgcctgcagtgtag

SEQ ID NO: 11350 - protein, 908 aa, Sorghum bicolor
  misc_feature: Ceres ANNOT ID no. 6009788
  misc_feature (267)..(592): NCBI GI: 54287456 NCBI Desc: unknow protein [oryza sativa (japonica cultivar-group)]
  misc_feature (1)..(534): NCBI GI: 4138131 NCBI Desc: ndx1 homeobox protein [lotus corniculatus var. japonicus]
  misc_feature (92)..(774): NCBI GI: 4138133 NCBI Desc: ndx2 homeobox protein [lotus corniculatus var. japonicus]
  misc_feature (166)..(675): NCBI GI: 140052499 NCBI Desc: homeodomain-related [medicago truncatula]
  misc_feature (86)..(234): NCBI GI: 115462485 NCBI Desc: os05g0188600 [oryza sativa (japonica cultivar-group)]
MVSAVEELSGLTSKELGEMLKESDNFVLQSKTEDGVPKQVDMEKLVSSLPLHLLAVCLELGQGLDLTYVLRGMRFLHSLSDLASRHTRLEQVLLDDVKLSEQVMDLIFFLLSILAEQKKENNDGASPLVHASLVAASLHLLTSYFSSQWHELVHILLAHPKVDIFMDVAFDSLHEDVRLLNIRLSSMGSGSFHVGSLESRRAHFICQQCEASLQFLLLLCQQKLFRDRILKNKELSRNGGILSLSHTILKLVVPECLKQSTDLVASISRLKAKILSILLQLCEAESVSYLDEVATNPNSRRLGQTLALEVLNLLKIAFGRKQNNTSDSHDKGKFYPMGSVLISALRLVDVFSDDSNFRSSFMTNTVPFLTQILATAHEEFVSSWCSANVPAIEEDASLDYDPFGASEVALLASDNVLTEAKANYSCPFRPSLPSMQYAQTRTSCVVKIIANLHIFVPNICEEQERDLFLQSFQKYLVSGSPKLSSDQPASSDFKATKVCTNLGSLSDYAKTLVPNFLNVEDVVLLSDFSDKLQSWCKSEVGQVAVKQPLLTRTSPPDSKMNNLPKDVQNMEVSTPIPPINPQGNGKDETPKNTVSRNGGFLQNAVGQDLVHLGVARTASGGSSAVASGVSTGHQRSKMDLDPASSSVDNFKTPELTKENGLQEDEKGESSMYDERQPKRRKRTLMNNEQIDELEKALVDEPEMHKNAVLLQSWSEKLSLQGSEITASQLKNWLNNRKAKLARIAKERGPFEGENADKPSTPSTIHLGESSESAGEDNYLPPARVMNALSKGRLVSPDSNEQMSQAELSPNTMLIRPFTRSFSLEPGRLVSLVDSDGKEVGRGKIFQTPGKSPAESRVCMVDVTELRTEKWRELPHPSEASGRTFQEAEARNGGIMRVSWDVVRLSPAV

SEQ ID NO: 11351 - DNA, 453 bp, Sorghum bicolor
  misc_feature: Ceres ANNOT ID no. 6009845
  misc_feature: Encodes the peptide sequence at SEQ ID NO 11352
atggctgcggccaagcccctcctcgtcgtcatcgccttcctcctcgccgccgctgccggcgtccctttgcctgacagcggtggggaggtccctccgttcacgctcctcccggctgaagctgaaccccctgccgtctccttccctgacggtggcgggagacccccgttcccgctcctcccagctgaccccgctgccgccgccggttgccgcgggcccgtgggcatgtgcccggcgagcgacgaggtgcgtggccttggcgcgcgtaaaggggcagcggcttccaccatgtccatgtcggccgatcctgagctggtccggcggcgggtgcaccaccagcagcgcgacagcgtgccgtgctcgcgccgcggcgccagctactacaactgccggcccggcgcccttgccaacccctaccgccgcgcctgctcccgcatcaagaactgccacggctga

SEQ ID NO: 11352 - protein, 150 aa, Sorghum bicolor
  misc_feature: Ceres ANNOT ID no. 6009845
  misc_feature (94)..(150): Pfam Id: RALF Pfam Desc: Rapid ALkalinization Factor (RALF)
  misc_feature (63)..(148): NCBI GI: 16566316 NCBI Desc: ralf precursor [nicotiana tabacum]
  misc_feature (63)..(148): NCBI GI: 42374767 NCBI Desc: rapid alkalinization factor preproprotein [nicotiana attenuata]
  misc_feature (63)..(148): NCBI GI: 37695573 NCBI Desc: rapid alkalinization factor 2 [solanum chacoense]
  misc_feature (113)..(150): NCBI GI: 124360011 NCBI Desc: rapid alkalinization factor [medicago truncatula]
  misc_feature (113)..(150): NCBI GI: 28628205 NCBI Desc: rapid alkalinization factor 2 precursor [populus balsamifera subsp. trichocarpa x populus deltoides]
MAAAKPLLVVIAFLLAAAAGVPLPDSGGEVPPFTLLPAEAEPPAVSFPDGGGRPPFPLLPADPAAAAGCRGPVGMCPASDEVRGLGARKGAAASTMSMSADPELVRRRVHHQQRDSVPCSRRGASYYNCRPGALANPYRRACSRIKNCHG

SEQ ID NO: 11353 - DNA, 1698 bp, Sorghum bicolor
  misc_feature: Ceres ANNOT ID no. 6009967
  misc_feature: Encodes the peptide sequence at SEQ ID NO 11354
atgacagaggagctgcagccagagtccgccggcgccgagcttgtcgtgaccgaggcggcgctggtagaggcggaggtgcctgcggcggcgaaagccgaagccgaggccgaggcggagaagacagctgatgaggccgcagtcaccgccgatgactcgggggaggagaccggatcgttcaaggaggagagcaacctggtggacgacctgcccgacccgcagaagcagcaggcgctcgacgagttcaagcagctgatcgctgccgccctcgccgccggtgagttcaacctgcctcccccgctgccgccgccgaaggccaaggaggaacctaacgccgaggagacgaagacggaggaacccaagaacgaggagccagccaaagaagagcccaaggccgaggccgaggctgcggatgccccggttgatgaggtcaagacggaggtgccgccggccgaggaggccaaggctgagacggtggccgaggaagccaagccttccgagcccgaggcgcaggagaagaccgtcgtgttcgctgtggaggagatcgaggaaaccgtcgtgtccgccgccgccgccgccacctcggaggaggcagcggcgccggaggtggtggccgagactcaggcggccgcgcctgagcccgtgctgatctggggcgtgccgctggtgggcgacgatgagcgcacggacacggttctgctcaagttcctgcgagcgcgggagttcaaggtgaaggaggccatggcgatgctcaagtccacagtgctgtggcgcgagcgctttggtatcacctcgctcctcgacgacgacctcggcctgccggagctggagaacgtggtgttctaccgcggcacggaccgcgagggccaccctgtctgctacaacgtctacggcgaattccaggacaaggatctctacgagaggaccttcggcgacgatgagaagcgggagcgcttcctcaagtggcgcatccagctgctggagcgcggcatcctgtcgaagctggatttctcgcccggcggcatctgctccatggttcaggttaccgacctcaagaactcgccgcccatgctccgcaagcaccggtccgtcacccgccaggccgtcgcgctgctccaagacaactatcccgagttcattgccaagaaggtgttcatcaatgtgccgtggtggtatttcgctgccaacaagatgatgagcccgttcctcacacagcgcaccaagagcaagtttgtctttgctaccccagccaagtcagcagagactctattaagatacatcgcaccggaacaagttcctgtccaatttggaggcctcttcaaggagaacgatcctgagttcaccacctccgacactgtcactgagctcactgtcgaaccctcatcgaaagaaaccattgagatccctgtcaccgagaactccacaattacatgggaactccaggtgctcggttgggaggtgagctatggcgccgagttcacccctgacactgtgggtgggtatgctgtcattgtccaaaaaacaaggaaggcaggcgagcccgggaaactcgtgctaactgtgaataaccctgcatccaagaagaagaagctcctttacagatcaaagacgaagcgcgctccaccgcgcccgcccctgctatgctctcctgctatacgctctactgggttagcttctttttacttctggtgccctgaataa

SEQ ID NO: 11354 - protein, 565 aa, Sorghum bicolor
  misc_feature: Ceres ANNOT ID no. 6009967
  misc_feature (278)..(464): Pfam Id: CRAL_TRIO Pfam Desc: CRAL/TRIO domain
  misc_feature (197)..(265): Pfam Id: CRAL_TRIO_N Pfam Desc: CRAL/TRIO, N-terminus
  misc_feature (24)..(537): NCBI GI: 82469976 NCBI Desc: patellin 1 [cucurbita pepo]
  misc_feature (211)..(531): NCBI GI: 22137076 NCBI Desc: at1g72160/t9n14_8 [arabidopsis thaliana]
  misc_feature (1)..(209): NCBI GI: 56784842 NCBI Desc: cytosolic factor-like protein [oryza sativa (japonica cultivar-group)]
  misc_feature (98)..(468): NCBI GI: 119404362 NCBI Desc: cral/trio domain protein [aspergillus clavatus nrrl 1]
  misc_feature (113)..(437): NCBI GI: 119498817 NCBI Desc: cral/trio domain protein [neosartorya fischeri nrrl 181]
  misc_feature: Useful for making plants with modulated nitrogen use efficiency
  misc_feature: GREAT-hit functional homolog of the protein sequence given in SEQ ID NO 13346
  misc_feature: Useful for making plants with modulated nitrogen use efficiency
  misc_feature: Functional homolog of the protein sequence given in SEQ ID NO 13346
MTEELQPESAGAELVVTEAALVEAEVPAAAKAEAEAEAEKTADEAAVTADDSGEETGSFKEESNLVDDLPDPQKQQALDEFKQLIAAALAAGEFNLPPPLPPPKAKEEPNAEETKTEEPKNEEPAKEEPKAEAEAADAPVDEVKTEVPPAEEAKAETVAEEAKPSEPEAQEKTVVFAVEEIEETVVSAAAAATSEEAAAPEVVAETQAAAPEPVLIWGVPLVGDDERTDTVLLKFLRAREFKVKEAMAMLKSTVLWRERFGITSLLDDDLGLPELENVVFYRGTDREGHPVCYNVYGEFQDKDLYERTFGDDEKRERFLKWRIQLLERGILSKLDFSPGGICSMVQVTDLKNSPPMLRKHRSVTRQAVALLQDNYPEFIAKKVFINVPWWYFAANKMMSPFLTQRTKSKFVFATPAKSAETLLRYIAPEQVPVQFGGLFKENDPEFTTSDTVTELTVEPSSKETIEIPVTENSTITWELQVLGWEVSYGAEFTPDTVGGYAVIVQKTRKAGEPGKLVLTVNNPASKKKKLLYRSKTKRAPPRPPLLCSPAIRSTGLASFYFWCPE

SEQ ID NO: 11355 - DNA, 1902 bp, Sorghum bicolor
  misc_feature: Ceres ANNOT ID no. 6010067
  misc_feature: Encodes the peptide sequence at SEQ ID NO 11356
atggatccagaaaaacaaaatgggatgagcctgatggacaagagacaactagtgtacgaagttgcaagatggccgcaaggtgccgtggagattcttcagtgctggacccgcagggaacttcttgagcttatttgtgctgagctgggcaaggagaggaagtataccaatgtcccaaaagctaagatgattgcttatctattgaagttagtttcacgaaacagtggaaagaatggacaactcaaggatgataatgcaaatgttatgttatcagggcgggataacaaagatgaaacacaaatgaaggaatctgaggaacaatcacgaccactcaaaactgcaaactctgatccatcaatacgcagagaggctcgtcctggtagttcagtagtgtgcagcaatgttgcatgccaagccacacggaatgcaggagataaatattgcaaacgttgctcttgctgcatttgcaataagtatgatgataacaaagaccctagcttgtggttggtttgcagctctgataatccatacagtggttgttcatgtggtgtctcttgtcacctcaactgtgctctaaaggataaaaaggctggcattgtcaagaatgggtgcaacaagttagactgtagtttctgctgtgttagttgtgggaaaatcaactggctaatgaggagtttgcagaaacaacttgcaattgctcgggaggcaagaagagttgatgtgctttgtgagcggctgtcactgagctataaaatggtaaaaggctctgaacgttacaaggaaatagtgagcctgatcagctcagctgtgaaaatacttgaaaaagaagttggtggtgcgttggatcaggtttctgtgatcacggggcgtgggattgtgaaccggcttacttgtggtgctgaagttcagaagctttgttcaagtgcattagaaattgtagactctacagtggataacatcttggagttcaagtcgaataatagttcaaaatccctaggttcccagccccaaatcgttgagatcactccattttctgtggctattgtgctgaagtatcagggtaacattggtatccctcagattgatggttccaaagtttggcaccgaagtgccaaggtttgcaactattcatcagagcccacatgccacatactgaggccaaatactaggtgcctggtttctgggctgagcccttcaactgaatacttcttcaaggttttgccttttagcagcatacaaaggtttactgagtgggaggcaaaatgcagtacacgcagcctggaccatggtagcagccaatgctcaactcagaactctgagagtatgtgcctcaaagaggattcaatgcagcatcagaaaaaggatttgaatgtgcagaatcatcagagaaccattcaatatgattcacctaagggttctacaaattcaagtgagaacaatttatcatgtgagcggtattccaagcgggctaaggttgcaaggttagatggtgcaagtgacaatgatgaaaaccagttgccgccaacttctgaagttttaccatttgcaagctccaactcctctccttccgaagctccaagtaaacctgacttgcttattggcaccccagattcagcctccaagaactatgtggagcagcagtatgagtactgtgtgaaggtggtcaggtggctggagcataaagggcacatggacaatgacttccgtgtaaagttcctcacttggttcagcctgaaggcaacagcacaggacaggcgaattgtgggcgcctttgtagatgctcttatcggtgatcctgcaagcttggttgcccaactggttgatgcatttatggatgtcatctgcatcaaggaaaagccctctcaagcacaacagaaggatgcatactgcaaggtttggcactag

SEQ ID NO: 11356 - protein, 633 aa, Sorghum bicolor
  misc_feature: Ceres ANNOT ID no. 6010067
  misc_feature (1)..(481): NCBI GI: 92882107 NCBI Desc: fibronectin, type iii-like fold [medicago truncatula]
  misc_feature (1)..(483): NCBI GI: 116562951 NCBI Desc: vil2 protein [triticum monococcum subsp. aegilopoides]
  misc_feature (1)..(483): NCBI GI: 116563031 NCBI Desc: vil2 protein [triticum monococcum subsp. monococcum]
  misc_feature (107)..(633): NCBI GI: 116267178 NCBI Desc: vernalization insensitive 3 [arabidopsis thaliana]
  misc_feature (46)..(435): NCBI GI: 116563005 NCBI Desc: vil1 protein [triticum monococcum subsp. aegilopoides]
MDPEKQNGMSLMDKRQLVYEVARWPQGAVEILQCWTRRELLELICAELGKERKYTNVPKAKMIAYLLKLVSRNSGKNGQLKDDNANVMLSGRDNKDETQMKESEEQSRPLKTANSDPSIRREARPGSSVVCSNVACQATRNAGDKYCKRCSCCICNKYDDNKDPSLWLVCSSDNPYSGCSCGVSCHLNCALKDKKAGIVKNGCNKLDCSFCCVSCGKINWLMRSLQKQLAIAREARRVDVLCERLSLSYKMVKGSERYKEIVSLISSAVKILEKEVGGALDQVSVITGRGIVNRLTCGAEVQKLCSSALEIVDSTVDNILEFKSNNSSKSLGSQPQIVEITPFSVAIVLKYQGNIGIPQIDGSKVWHRSAKVCNYSSEPTCHILRPNTRCLVSGLSPSTEYFFKVLPFSSIQRFTEWEAKCSTRSLDHGSSQCSTQNSESMCLKEDSMQHQKKDLNVQNHQRTIQYDSPKGSTNSSENNLSCERYSKRAKVARLDGASDNDENQLPPTSEVLPFASSNSSPSEAPSKPDLLIGTPDSASKNYVEQQYEYCVKVVRWLEHKGHMDNDFRVKFLTWFSLKATAQDRRIVGAFVDALIGDPASLVAQLVDAFMDVICIKEKPSQAQQKDAYCKVWH

SEQ ID NO: 11357 - DNA, 1113 bp, Sorghum bicolor
  misc_feature: Ceres ANNOT ID no. 6010088
  misc_feature: Encodes the peptide sequence at SEQ ID NO 11358
atggcgccgcagtctcggttgctgccgccggcgttgcagatgcttcgccgctgccggtgccgtgcctcgcgctcccacttctctaccgcgcccactctcgtctcgccaccatccaaggccgtggtctacgacgagcacggcccacctgagcaggtgctgaggacggtggacgtgccaccggtggaggtcggcgaccgcgacgtctgcgtcaggatgctggctgcccccatcaacccctcggacatcaaccgcgtcgagggcgtctaccccgtcaggcccccgctccccgccgccatcggaggctacgagggcgtcggccaggtccacgccgtcggccccgccgtcaccgccccgctctcccccggcgactgggtcataccgtccccgccatcgttcgggacctggcagacgtacattgtcaaggatgagaacgtctggcacaaggtccgcagcgatgtacccatggagtatgctgccaccatcaccgtcaacccctcgaccgcgtttaggatgctccaagactttgtaaaactcaatcctggtgattccattgtccagaatggtgctaccagcatcgttggccagtgtgttattcagcttgctaaagtacatggaatccacactatcaacattataagggacaggcctgggtcagaggaagcaaaaaacaaactcaaacaacttggtgcagatgaggtgttcacagaatctcagctagacatgaagaatgtcaagagcttgctgggtgccatgccggagcctgcattaggatttaactgtgttggaggaaatgctgcttctctaatactcaagcttttgaagcaaggaggcaccatggtgacttatggtggaatgtccaagagacctgtcactgtccctacttcatatttcatttttaaggatctttcgctacgagggttctggctccagaagtggctgaactcagataaaacagaagactgcagaagaatgatagactacctcttgggccttgtgcatgaaggcaaactcaaatacgagatggagtcgatttctttcggtgagttcagcttggctctggagaaggccctgggcaaacatggaagccatccaaagcaagttatcaggttctga

SEQ ID NO: 11358 - protein, 370 aa, Sorghum bicolor
  misc_feature: Ceres ANNOT ID no. 6010088
  misc_feature (180)..(330): Pfam Id: ADH_zinc_N Pfam Desc: Zinc-binding dehydrogenase
  misc_feature (65)..(149): Pfam Id: ADH_N Pfam Desc: Alcohol dehydrogenase GroES-like domain
  misc_feature (1)..(370): NCBI GI: 77552778 NCBI Desc: nuclear receptor binding factor-like protein [oryza sativa (japonica cultivar-group)]
  misc_feature (9)..(370): NCBI GI: 92874626 NCBI Desc: alcohol dehydrogenase superfamily, zinc-containing [medicago truncatula]
  misc_feature (32)..(370): NCBI GI: 62900587 NCBI Desc: probable trans-2-enoyl-coa reductase, mitochondrial precursor
  misc_feature (32)..(370): NCBI GI: 21387141 NCBI Desc: oxidoreductase of zinc-binding dehydrogenase family [arabidopsis thaliana]
  misc_feature (32)..(370): NCBI GI: 7019643 NCBI Desc: nuclear receptor binding factor-like protein [arabidopsis thaliana]
MAPQSRLLPPALQMLRRCRCRASRSHFSTAPTLVSPPSKAVVYDEHGPPEQVLRTVDVPPVEVGDRDVCVRMLAAPINPSDINRVEGVYPVRPPLPAAIGGYEGVGQVHAVGPAVTAPLSPGDWVIPSPPSFGTWQTYIVKDENVWHKVRSDVPMEYAATITVNPSTAFRMLQDFVKLNPGDSIVQNGATSIVGQCVIQLAKVHGIHTINIIRDRPGSEEAKNKLKQLGADEVFTESQLDMKNVKSLLGAMPEPALGFNCVGGNAASLILKLLKQGGTMVTYGGMSKRPVTVPTSYFIFKDLSLRGFWLQKWLNSDKTEDCRRMIDYLLGLVHEGKLKYEMESISFGEFSLALEKALGKHGSHPKQVIRF

SEQ ID NO: 11359 - DNA, 1233 bp, Sorghum bicolor
  misc_feature: Ceres ANNOT ID no. 6010154
  misc_feature: Encodes the peptide sequence at SEQ ID NO 11360
atggatgggcaaggcacaaagcacaggattttgatggtgtctgactttttctttccaaactttggtggggtggaaagccatatctactacctgtcacaatgtctacttaagcttggccataaggtggttgtcatgacgcatgcatacggaaacagatctggagtacgatatgttacaaatggtttaaaggtttattatgtaccatggaggccattcctgatgcagaatacacttcctacattattcttgacgttcccaattgtaaggacaattattattcgagagaagatttctgtcgtgcatggacatcaagctttttcaacactgtgtcatgaagcattaatgcatgctaggacgatggggtacaaagttgtcttcacagatcactcactttatggttttgctgatgctggaagcattcacatgaataaggtgctgcagtttactcttgcagatattgatcaggcaatatgtgtctctcatacaagcaaagagaatactgtcttgagtagattagtataccgaaaaggtgctgaccttcttgttgaagtcattccagaagtgtgtcgtctatttccaaaggttcgctttattgttggtggtgatggtccaaaacgtgtgcgccttgaagaaatgagggagaagttctcccttcaggatagagttgagatgttaggagctgtacctcatgctcaggtgcgatctgttctgatatctggacatatatttttgaacagttcacttacagaggcattttgcatagctattctagaagcagcaagctgtggactgttgacagtgagtactagagtcggtggtgtccctgaggttcttccagatgacatgatagtacttgcagaaccagctcctggagatatggtaagagctgtcaagaaagccatcgacatgctacctggcatagacccccaaatcatgcatcttcggatgaaaaaactttatagttgggatgatgtggccaaaagaactgagattgtttatgaccgtgcaatgcagttcccaacaacaaatttactagatcgccttccccgatatcttacttgtggatcttgggctggaaaactgttttgcctagttatgatcatcaattacctactatggcgccttttagagttcctacagcctgctgaaggtattgaagaagtcccagatatagggccactacatgctcatttaggttcaaagaatgatttttgtgaggctcaagagaagtga

SEQ ID NO: 11360 - protein, 410 aa, Sorghum bicolor
  misc_feature: Ceres ANNOT ID no. 6010154
  misc_feature (47)..(136): Pfam Id: PIGA Pfam Desc: PIGA (GPI anchor biosynthesis)
  misc_feature (154)..(319): Pfam Id: Glycos_transf_1 Pfam Desc: Glycosyl transferases group 1
  misc_feature (168)..(399): NCBI GI: 6911848 NCBI Desc: n-acetylglucosaminyl-phosphatidylinositol-like protein [arabidopsis thaliana]
  misc_feature (168)..(402): NCBI GI: 84043442 NCBI Desc: n-acetylglucosaminyl-phosphatidylinositol biosynthetic protein [trypanosoma brucei treu927]
  misc_feature (168)..(390): NCBI GI: 19112311 NCBI Desc: n-acetylglucosaminyl-phosphatidylinositol [schizosaccharomyces pombe]
  misc_feature (8)..(186): NCBI GI: 119494335 NCBI Desc: phosphatidylinositol:udp-glcnac transferase subunit pig-a [neosartorya fischeri nrrl 181]
  misc_feature (12)..(186): NCBI GI: 119396721 NCBI Desc: phosphatidylinositol:udp-glcnac transferase subunit pig-a [aspergillus clavatus nrrl 1]
  misc_feature: Useful for making plants with modulated salt sensitivity
  misc_feature: GREAT-hit functional homolog of the protein sequence given in SEQ ID NO 13293
  misc_feature: Useful for making plants with modulated salt sensitivity
  misc_feature: Functional homolog of the protein sequence given in SEQ ID NO 13293
MDGQGTKHRILMVSDFFFPNFGGVESHIYYLSQCLLKLGHKVVVMTHAYGNRSGVRYVTNGLKVYYVPWRPFLMQNTLPTLFLTFPIVRTIIIREKISVVHGHQAFSTLCHEALMHARTMGYKVVFTDHSLYGFADAGSIHMNKVLQFTLADIDQAICVSHTSKENTVLSRLVYRKGADLLVEVIPEVCRLFPKVRFIVGGDGPKRVRLEEMREKFSLQDRVEMLGAVPHAQVRSVLISGHIFLNSSLTEAFCIAILEAASCGLLTVSTRVGGVPEVLPDDMIVLAEPAPGDMVRAVKKAIDMLPGIDPQIMHLRMKKLYSWDDVAKRTEIVYDRAMQFPTTNLLDRLPRYLTCGSWAGKLFCLVMIINYLLWRLLEFLQPAEGIEEVPDIGPLHAHLGSKNDFCEAQEK

SEQ ID NO: 11361 - DNA, 516 bp, Sorghum bicolor
  misc_feature: Ceres ANNOT ID no. 6010569
  misc_feature: Encodes the peptide sequence at SEQ ID NO 11362
atggcgccaccgctgccacgccgtctccaccagttccttgccgtgctgctcttcctgtcggcggtcgtgctcctcctggccgtcgtcgtctccggtggtgttcacgcaactcctcatcaccccgcagatgtcgtcgtccgtggtggctgccgccaacaccgccgcgtaggtacgacgtcgtacatacgcgccgcagcagggatcggcggcgagatgcagcaccacgcggcggtggtggctcgacgacggtggtctaggaccgtcgtcgtcagaagaggcggcggcggccatggtggtggtcacggcggcagcggccatggccacgggcatggccgagggcacggcacaggcaacggccacggcaccggggggacgccgttctaccctcgcacggtcaccggccacggtcaccaccggagcggcgccgccgctgcgacggcggggcggccgtccgatcgcgccctgctgctcgtcgtggcggccgtcgtcgtacttctgccgctgctgcgcccttga

SEQ ID NO: 11362 - protein, 171 aa, Sorghum bicolor
  misc_feature: Ceres ANNOT ID no. 6010569
  misc_feature (94)..(138): NCBI GI: 2833324 NCBI Desc: holotricin 3 precursor
  misc_feature (27)..(149): NCBI GI: 115481762 NCBI Desc: os10g0377000 [oryza sativa (japonica cultivar-group)]
  misc_feature (94)..(155): NCBI GI: 88941133 NCBI Desc: dead/deah box helicase-like [acidiphilium cryptum jf-5]
  misc_feature (35)..(150): NCBI GI: 38564769 NCBI Desc: dsxf [musca domestica]
  misc_feature (35)..(150): NCBI GI: 38564771 NCBI Desc: dsxm [musca domestica]
MAPPLPRRLHQFLAVLLFLSAVVLLLAVVVSGGVHATPHHPADVVVRGGCRQHRRVGTTSYIRAAAGIGGEMQHHAAVVARRRWSRTVVVRRGGGGHGGGHGGSGHGHGHGRGHGTGNGHGTGGTPFYPRTVTGHGHHRSGAAAATAGRPSDRALLLVVAAVVVLLPLLRP

SEQ ID NO: 11363 - DNA, 615 bp, Sorghum bicolor
  misc_feature: Ceres ANNOT ID no. 6010605
  misc_feature: Encodes the peptide sequence at SEQ ID NO 11364
atggggaataagctgagcgagtgctgggacgactgctgctacaagtgggacgagtggaagtactgcctgctctgcgtggccatcgtggccggcgtcgtcctcctcgccgtgctcctcgccgcctacggcttcgtccgccacctcgacatctccgtcgacgacgcctccctgacgcggttcgagctctcgacctcgccggtgacgtcgctgtcgtacaacctccctctccctcaccctggtgatccgcaacccgaactgggcgatggcgctcaagaacaccaagcgttcgaccggttccagctcgccgacaagggcggcaagcaccccgccgggaagacccgcgtgtaccacctgtcccccgccggcaccaccagggccgtcatgctcgggaacgccggcgaggccgagttccgcaaggagaacgccacggggacgttccaggtcgaggtggccgtcgccggggaggtccggtacacggcgcgatacaccaagtgcaaggtcgaggcgtcgtgcccgctcaagctgcagctcgcgccgccgccggggacggcggcggccgccgtcgtgttccagaaggtcaagtgcaagctcgccgagccggagaagaactgctag

SEQ ID NO: 11364 - protein, 204 aa, Sorghum bicolor
  misc_feature: Ceres ANNOT ID no. 6010605
  misc_feature (43)..(171): Pfam Id: Hin1 Pfam Desc: Harpin-induced protein 1 (Hin1)
  misc_feature (11)..(204): NCBI GI: 115471401 NCBI Desc: os07g0251200 [oryza sativa (japonica cultivar-group)]
  misc_feature (21)..(197): NCBI GI: 90399146 NCBI Desc: h0913c04.11 [oryza sativa (indica cultivar-group)]
  misc_feature (21)..(197): NCBI GI: 32488714 NCBI Desc: osjnba0088h09.15 [oryza sativa (japonica cultivar-group)]
  misc_feature (21)..(197): NCBI GI: 115461434 NCBI Desc: os04g0685300 [oryza sativa (japonica cultivar-group)]
  misc_feature (21)..(197): NCBI GI: 2801538 NCBI Desc: harpin induced gene 1 homolog [oryza sativa]
MGNKLSECWDDCCYKWDEWKYCLLCVAIVAGVVLLAVLLAAYGFVRHLDISVDDASLTRFELSTSPVTSLSYNLPLPHPGDPQPELGDGAQEHQAFDRFQLADKGGKHPAGKTRVYHLSPAGTTRAVMLGNAGEAEFRKENATGTFQVEVAVAGEVRYTARYTKCKVEASCPLKLQLAPPPGTAAAAVVFQKVKCKLAEPEKNC

SEQ ID NO: 11365 - DNA, 1500 bp, Sorghum bicolor
  misc_feature: Ceres ANNOT ID no. 6010640
  misc_feature: Encodes the peptide sequence at SEQ ID NO 11366
atgatttttcaggttcttttggttttcacaaccattgttgctcagacccaatgggctagtgtatggggcatgtactgcgaggacttgacagcaagtgtagagaggccacacagtgcctcaataacggattttggtgctgttggagatggtgcgactcttaacacgaaagcatttcagaatgcactcttctacctcaattcatttgcgaagaagggcggagcgcagctgtttgtgcctgctggaaggtggctgaccgggagttttagtctaatcagccatctcacactctcactggacaaggacgcagtaattcttggatcaacagactcctctgactggccagttattgatgctcttccatcctatgggcgtggtagagaactacccggtaaaagacatcaaagtttaatatttggatccaatcttactgatgtaataataactggttccaatggcaccattgatggccaaggtgcagtttggtgggactggtttcacaaccacacattgaattatactagaccaccgcttgttgaactgatgtactctaccagagtagttatttccaacctaaccttcataaattcaccattttggaatatccatccagtatactgcaggttcccttttgagcattcctctctgtcatttattactgaaactgttttttcccggatgaacagccaagtcctggcccagcatctcacgatcctagcacctatcagttcaccaaacaccgatggcattgatccagactcatctacaaacgtttgcattgaagattgttacatcagaaatggcgatgacattgttgtcatcaagagtgggtgggatgagtatggcatctcttttgctcatcctagctccaacattagcatccgcaacatcacaggacagacaaggaacagcgctgggctcgcctttggaagcgagatgtcaggtggtatatcagacgttcgagcagagggcatccggatcgtcaactcagtgcatgggatcagaatcaagacagccccagggcgcggaggatacgtgaagaacgtgtatgtagccgatgtgagctttgacaacgtttccatagccatcaggatcactggaaactacggtgaacaccctgatgataggtacaacaagagtgcacttcccaccataagcaacataactatcaaggatgttgtgggtgtcaacattggtgttgcaggaatgttgcagggcatcccaggggataacttcagcaatatttgcttatcaaatgtgtctctcagtgtcagatctacagatccatggaattgttcactcgtcgaagggtattcgaactctgtgtcaccagaggtatgcgagcaactaagaaccagtccagggcccggacaaatttgctacggcagtaattatccagccgctgcagcacagccacagccacagccacagccgctgcagaaatcaagtgctagccggctggtaaatcctttcctttcgataagttggtttctatgtaggtaa

SEQ ID NO: 11366 - protein, 499 aa, Sorghum bicolor
  misc_feature: Ceres ANNOT ID no. 6010640
  misc_feature (70)..(446): Pfam Id: Glyco_hydro_28 Pfam Desc: Glycosyl hydrolases family 28
  misc_feature (35)..(206): NCBI GI: 115489012 NCBI Desc: os12g0554800 [oryza sativa (japonica cultivar-group)]
  misc_feature (35)..(205): NCBI GI: 30692538 NCBI Desc: polygalacturonase-like protein [fragaria x ananassa]
  misc_feature (2)..(205): NCBI GI: 92878953 NCBI Desc: glycoside hydrolase, family 28 [medicago truncatula]
  misc_feature (35)..(205): NCBI GI: 87241007 NCBI Desc: glycoside hydrolase, family 28 [medicago truncatula]
  misc_feature (35)..(205): NCBI GI: 92878952 NCBI Desc: peptidase s26a, signal peptidase i; glycoside hydrolase, family 28 [medicago truncatula]
  misc_feature: Useful for making plants with altered cell wall content and/or composition
  misc_feature: Functional homolog of the protein sequence encoded by LOCUS at3g62110
  misc_feature: Useful for making plants with altered carbohydrate content
  misc_feature: Functional homolog of the protein sequence given in SEQ ID NO 13672
  misc_feature: Useful for making plants with altered cell wall content and/or composition
  misc_feature: Functional homolog of the protein sequence given in SEQ ID NO 13673
  misc_feature: The sequence is a functional homolog of SEQ ID NO. 450 in the 11/188,298 US application
MIFQVLLVFTTIVAQTQWASVWGMYCEDLTASVERPHSASITDFGAVGDGATLNTKAFQNALFYLNSFAKKGGAQLFVPAGRWLTGSFSLISHLTLSLDKDAVILGSTDSSDWPVIDALPSYGRGRELPGKRHQSLIFGSNLTDVIITGSNGTIDGQGAVWWDWFHNHTLNYTRPPLVELMYSTRVVISNLTFINSPFWNIHPVYCRFPFEHSSLSFITETVFSRMNSQVLAQHLTILAPISSPNTDGIDPDSSTNVCIEDCYIRNGDDIVVIKSGWDEYGISFAHPSSNISIRNITGQTRNSAGLAFGSEMSGGISDVRAEGIRIVNSVHGIRIKTAPGRGGYVKNVYVADVSFDNVSIAIRITGNYGEHPDDRYNKSALPTISNITIKDVVGVNIGVAGMLQGIPGDNFSNICLSNVSLSVRSTDPWNCSLVEGYSNSVSPEVCEQLRTSPGPGQICYGSNYPAAAAQPQPQPQPLQKSSASRLVNPFLSISWFLCR

SEQ ID NO: 11367 - DNA, 1908 bp, Sorghum bicolor
  misc_feature: Ceres ANNOT ID no. 6010680
  misc_feature: Encodes the peptide sequence at SEQ ID NO 11368
atggccatctttgttggtatcagaaatatgtacatgagcacctcaacacttcctcaaggagggacgcaaccaatcatcatcctgatggtgagcctgatagcaccatggctctgtctcgcttcttcgtcatctcaagatgtgggtgcagcagcagcagctctgaaagcagagtacataataaaagtgaacttcagcacggcgtcggcgacccccgacaagtacaagagcttcatcgcttccgttcgtgctggcctggtgagcacagccgccgaggcggccggcaccaacaccagcggcgggatccccgtgctggtcagcgaagacgacccgctcgcgctggaagcgtctctaaacatcactctggtgaacaaggccggtcgttccgtgagcttgaagatggacatctccggcgcctacatcgccggctacgaagcagggaacttctcgtgcctcgtcaagagatcaggctcaggccacacgttgtcgtcggtgacctgttaccggagctcgtatccatggggaggtcctccgaccgtcgacgtcgccgtccccgaggtgtccgcatggcgggtggaggatctcgacgaggctatctcgtcgctgttcctgttcccgacggggaacgcgacgaaggaggacctgagccggggcctcgccgcctgcgacgtgatggtcgcgaccgcggccacgttcccgtacgtggagcggcggatgagcgccggcatgtgggacggcaacggcgtgtccaacgacgggagcctgcgcgggcttcaggagagctggccggacctctccgccgccgtccaggagtcctaccagggcgccttcgccgctccggtggctcttcagcggagcaacggcgagtggatgctggtggacaacgtgcgtcgtgccgtgcccctcgtctccttccttgagaacgcaggctgcaagaagaagatgacgacgacgacggaggcggcggcggcggaccagcggcttcccttgctcatgaggtccgtcgtgcaacagccgccgccggatgaggaggacatgcagatgcagctgggcagttcgccggcggcggcggcggcgacgacgtcgtgcggccaggccgagccgacggtgcggctggtcggtccggaagggaggtgcgtggacgtgccctacggcgtctactacaacggcaagcaggtgcagctatggagctgcaagtccaacggcgacgtgaaccagctctggacgctgaagcgagacggcaccatccggtccaacggcaagtgcctggcggccagcaggagcgacacggcgggcgcgcgcgtggtgatcgacgactgcccgccgcgcgtcccgacggggcgcgtcgtctgggaggtgcgcgtggacggcaccatcgcgctcaaggggtcgtcgtcgtccggcggcggcgggctggtgctggccgtgacgtcgtcgacgctcttcgcggggctgacggtgcgacgggacgaccgcgggacggggcagtcgtggacgccgaccaacgacaccgcgccgctggacgccgccatcgtcgggttccgcgacctctgcctgcaggcggacaccgccggggcggtgtcggtcgccgcctgcggcaacggcggcgtgcggtggtcgatctaccccgacggctccatccgcccgcccgcgtggctgctcctccagtggcagtgcctggccgcagacggcgccagcgggcgtgtcagggtgaagtactgcgactgggcggggtcggcttgcgagcgctgggtgttccgcaacgacggcaccatcttcaacaccggcaccgggagggtcttggaggtcgtcggagcatcaaagggtggtgctagcggcgggcaggtcgtcgtgtcgaaggccggcaatgggagtcccactcctacccagaagtgggcgctcatgctgtga

SEQ ID NO: 11368 - protein, 635 aa, Sorghum bicolor
  misc_feature: Ceres ANNOT ID no. 6010680
  misc_feature (365)..(497): Pfam Id: Ricin_B_lectin Pfam Desc: Ricin-type beta-trefoil lectin domain
  misc_feature (507)..(631): Pfam Id: Ricin_B_lectin Pfam Desc: Ricin-type beta-trefoil lectin domain
  misc_feature (59)..(310): Pfam Id: RIP Pfam Desc: Ribosome inactivating protein
  misc_feature (327)..(602): NCBI GI: 21085 NCBI Desc: pre-propolypeptide (aa -35 to 541) [ricinus communis]
  misc_feature (327)..(602): NCBI GI: 251804 NCBI Desc: proricin a chain [ricinus communis]
  misc_feature (327)..(602): NCBI GI: 113504 NCBI Desc: agglutinin precursor (rca) [contains: agglutinin a chain (rrna n-glycosidase); agglutinin b chain]
  misc_feature (327)..(602): NCBI GI: 251808 NCBI Desc: agglutinin i; prorca i [ricinus communis]
  misc_feature (354)..(631): NCBI GI: 38607297 NCBI Desc: lectin precursor [viscum album]
MAIFVGIRNMYMSTSTLPQGGTQPIIILMVSLIAPWLCLASSSSQDVGAAAAALKAEYIIKVNFSTASATPDKYKSFIASVRAGLVSTAAEAAGTNTSGGIPVLVSEDDPLALEASLNITLVNKAGRSVSLKMDISGAYIAGYEAGNFSCLVKRSGSGHTLSSVTCYRSSYPWGGPPTVDVAVPEVSAWRVEDLDEAISSLFLFPTGNATKEDLSRGLAACDVMVATAATFPYVERRMSAGMWDGNGVSNDGSLRGLQESWPDLSAAVQESYQGAFAAPVALQRSNGEWMLVDNVRRAVPLVSFLENAGCKKKMTTTTEAAAADQRLPLLMRSVVQQPPPDEEDMQMQLGSSPAAAAATTSCGQAEPTVRLVGPEGRCVDVPYGVYYNGKQVQLWSCKSNGDVNQLWTLKRDGTIRSNGKCLAASRSDTAGARVVIDDCPPRVPTGRVVWEVRVDGTIALKGSSSSGGGGLVLAVTSSTLFAGLTVRRDDRGTGQSWTPTNDTAPLDAAIVGFRDLCLQADTAGAVSVAACGNGGVRWSIYPDGSIRPPAWLLLQWQCLAADGASGRVRVKYCDWAGSACERWVFRNDGTIFNTGTGRVLEVVGASKGGASGGQVVVSKAGNGSPTPTQKWALML

SEQ ID NO: 11369 - DNA, 1500 bp, Sorghum bicolor
  misc_feature: Ceres ANNOT ID no. 6010826
  misc_feature: Encodes the peptide sequence at SEQ ID NO 11370
atgttgctctccggccgccaccacaaattccccccttcctcaccgccggcctccttccgctccccacacctccgccgtctccggccgcttcggccaccaccaacccttgcatccgcgaaccctccgccgccgccatcgccactaccttcccatttcccgtcgccaaggcgtccatggcggtggcggcacagcagccacggccccggccccggcgccggcgacgttgtccaagaccttcctccggtggaagccgagggaaactccgccgtaggggggaagaagagcttctggggagcggtgagcctcatcatcggcacggcggtcgggccgggcatgctgggcctgccgtccgccaccatccgctccggccaggcgccctccgcggccgccatactgctgtcctgggtctacgtcgtgtcctccatcgtcctcgtcgccgagctcagcttcgctgccatggtgcgtgacggcgtcgacgaggtcagcttcacgggacttgcgtcgagcaccctgggggcgggccttggcgcggtcgtcgctgtcgtgtacgccgcgctcagcttctccctgctcgtcgcctgcgtcgccggcatcggatcgctcgtctcccagctgttccccggggtgaacccggtcctggccaacgccctgttcccctgcttcgccggcgtcctcatcgccttcttccccttcaaggccgttgacggcgccaaccgagccctctgtggcctgatgctagtttcgattacagctctcgtggtgactggcgtgtccgtcggccgcaccagcttgctgagatctctcagctatgctacctggagtccaggagcgatcctgccggctataccggtgaccgtgctcacgctggggtttcatgtcatcacaccgttcatctgcaagattgtgggggactcggtgtatgatgctcggaaggcgatactgattgggggcgctgtgccattggccatggtgctgtcatggaatgccgtcattctagggctggctagtgctggtggcaatgctgggtttgatgaccctatcaagctccttctctcagtgaatccagctgcgctgcctgctgttcgaggctttgcttttgctgcactggcgacgagcctgatagggtatgcagtgagctttccaaagcagttggcggacacagtggaattgattcgtcagaggttttctcagaagcaaggaagtgcgcaccaacctaatgctagcagtgacagaaatggggcgattctgacatggacggtgctgatcattcccatctttattgcatcgttcttctcagcagccttctccaaggcactggattttgctggggtttatgcaaactgcttcctatttgggattctgcctcctgttatggcctggatccatcggtcacagatgaaaaagagatctcctgattcatgtgaagatattttgcccggtggaaatgctgctctgatgatacttttcgttattgctgtgatcctagcaatctggcactag

SEQ ID NO: 11370 - protein, 499 aa, Sorghum bicolor
  misc_feature: Ceres ANNOT ID no. 6010826
  misc_feature (93)..(499): Pfam Id: Trp_Tyr_perm Pfam Desc: Tryptophan/tyrosine permease family
  misc_feature (246)..(499): NCBI GI: 50510264 NCBI Desc: tyrosine-specific transport protein-like protein [oryza sativa (japonica cultivar-group)]
  misc_feature (95)..(386): NCBI GI: 145348459 NCBI Desc: haaap family transporter: tyrosine/tryptophan [ostreococcus lucimarinus cce9901]
  misc_feature (95)..(497): NCBI GI: 119513568 NCBI Desc: tyrosine transport protein [nodularia spumigena ccy9414]
  misc_feature (95)..(390): NCBI GI: 56236058 NCBI Desc: at5g19500 [arabidopsis thaliana]
  misc_feature (95)..(389): NCBI GI: 145355665 NCBI Desc: haaap family transporter: tyrosine [ostreococcus lucimarinus cce9901]
MLLSGRHHKFPPSSPPASFRSPHLRRLRPLRPPPTLASANPPPPPSPLPSHFPSPRRPWRWRHSSHGPGPGAGDVVQDLPPVEAEGNSAVGGKKSFWGAVSLIIGTAVGPGMLGLPSATIRSGQAPSAAAILLSWVYVVSSIVLVAELSFAAMVRDGVDEVSFTGLASSTLGAGLGAVVAVVYAALSFSLLVACVAGIGSLVSQLFPGVNPVLANALFPCFAGVLIAFFPFKAVDGANRALCGLMLVSITALVVTGVSVGRTSLLRSLSYATWSPGAILPAIPVTVLTLGFHVITPFICKIVGDSVYDARKAILIGGAVPLAMVLSWNAVILGLASAGGNAGFDDPIKLLLSVNPAALPAVRGFAFAALATSLIGYAVSFPKQLADTVELIRQRFSQKQGSAHQPNASSDRNGAILTWTVLIIPIFIASFFSAAFSKALDFAGVYANCFLFGILPPVMAWIHRSQMKKRSPDSCEDILPGGNAALMILFVIAVILAIWH

SEQ ID NO: 11371 - DNA, 879 bp, Sorghum bicolor
  misc_feature: Ceres ANNOT ID no. 6010829
  misc_feature: Encodes the peptide sequence at SEQ ID NO 11372
atggcttccgccgcggtgctccggagcgccggctcccgccgccttttctcctaccccaccctccgcgccgccgcgatctcgggacccgcagcgctacccgatgcgcctgctgtggcggcggcgccggcggtggcgccggcccagccgccaccgctggccgggatcctctgggcgaggtccatcgccaccttcacgcgcacgaatccccatgtgaacgtcggctccattgggcacatcggtcacggcaaattcactctcactgctgctattaccaaggggatatcaactacaaggcatttgcttgcagatgatgctatggtgcctatttcgtctcctttgactcctccactcggtggcagtgaagaaactgacaaaaagggggccatggtaaaacgcctaaaggtccaagccataaaaaaggatatcaaacagagtcccaagaaggtgaatcttgtagcaaagctggttcgaggtatgcgtgtggaagatgccttattgcagctgcaagtgactgttaaaagggctgccaaaactgtttaccaggtgatccattctgctcgggccaatgcagctcacaaccatggattggatcctgataagctcattgttgaggaggcctttgtgggaaagggactttacctgaagagactgtcttaccatgccaaagggagatgcggtataatggtgcgaccaaggtgcagattgacagtggtggttagagaagctactgctgaggaagaggcaaagattgccaagctcagggtgagcaactataagaagctgaccagaaaggagcggcagcttatgccgcacaggctcatcgaggttagcccaaggtgggctcgcaagaggaaagcagaggctggtgctgcagtatag

SEQ ID NO: 11372 - protein, 292 aa, Sorghum bicolor
  misc_feature: Ceres ANNOT ID no. 6010829
  misc_feature (137)..(241): Pfam Id: Ribosomal_L22 Pfam Desc: Ribosomal protein L22p/L17e
  misc_feature (93)..(283): NCBI GI: 7269690 NCBI Desc: copper-binding protein-like [arabidopsis thaliana]
  misc_feature (1)..(92): NCBI GI: 11181616 NCBI Desc: translational elongation factor ef-tum [zea mays]
  misc_feature (1)..(92): NCBI GI: 21685576 NCBI Desc: elongation factor tu [oryza sativa]
  misc_feature (126)..(248): NCBI GI: 15074294 NCBI Desc: probable 50s ribosomal protein l22 [sinorhizobium meliloti]
  misc_feature (126)..(248): NCBI GI: 15965114 NCBI Desc: probable 50s ribosomal protein l22 [sinorhizobium meliloti 1021]
MASAAVLRSAGSRRLFSYPTLRAAAISGPAALPDAPAVAAAPAVAPAQPPPLAGILWARSIATFTRTNPHVNVGSIGHIGHGKFTLTAAITKGISTTRHLLADDAMVPISSPLTPPLGGSEETDKKGAMVKRLKVQAIKKDIKQSPKKVNLVAKLVRGMRVEDALLQLQVTVKRAAKTVYQVIHSARANAAHNHGLDPDKLIVEEAFVGKGLYLKRLSYHAKGRCGIMVRPRCRLTVVVREATAEEEAKIAKLRVSNYKKLTRKERQLMPHRLIEVSPRWARKRKAEAGAAV

SEQ ID NO: 11373 - DNA, 372 bp, Sorghum bicolor
  misc_feature: Ceres ANNOT ID no. 6010997
  misc_feature: Encodes the peptide sequence at SEQ ID NO 11374
atgctctccaagctgtcggcgtggttcttgaacccgcgccggaacccgctcgcgcgactccaccggaacgccatcgcttcccgcctccgcaaatacgggctccggtacgacgacctgtacgacccgtaccatgacctggacatcaaggaggcgctggcgcggctgccgcgggaggtggtggacgcacgcaaccagcgactcaagcgcgccatggacctctccatgaagcacaagtacctacccgacgacgtccaggctatacagacgccattcaggagctacctttctgacatgcttgctcttgtgaaaaaggagagcgcagagcgtgaagcattgggagcgcttccactctaccagagaaccatcccataa

SEQ ID NO: 11374 - protein, 123 aa, Sorghum bicolor
  misc_feature: Ceres ANNOT ID no. 6010997
  misc_feature (8)..(111): Pfam Id: UCR_14kD Pfam Desc: Ubiquinol-cytochrome C reductase complex 14kD subunit
  misc_feature (1)..(123): NCBI GI: 115471095 NCBI Desc: os07g0205000 [oryza sativa (japonica cultivar-group)]
  misc_feature (1)..(123): NCBI GI: 633681 NCBI Desc: ubiquinol--cytochrome c reductase [solanum tuberosum]
  misc_feature (1)..(97): NCBI GI: 115475521 NCBI Desc: os08g0246400 [oryza sativa (japonica cultivar-group)]
  misc_feature (27)..(115): NCBI GI: 19075864 NCBI Desc: ubiquinol-cytochrome c reductase complex subunit [schizosaccharomyces pombe]
  misc_feature (27)..(115): NCBI GI: 3581921 NCBI Desc: spcc737.02c [schizosaccharomyces pombe]
  misc_feature (1)..(123): SWISSPROT Homolog: EC 1.10.2.2 Ubiquinol-cytochrome c reductase complex 14 kDa protein
MLSKLSAWFLNPRRNPLARLHRNAIASRLRKYGLRYDDLYDPYHDLDIKEALARLPREVVDARNQRLKRAMDLSMKHKYLPDDVQAIQTPFRSYLSDMLALVKKESAEREALGALPLYQRTIP

SEQ ID NO: 11375 - DNA, 1026 bp, Sorghum bicolor
  misc_feature: Ceres ANNOT ID no. 6011000
  misc_feature: Encodes the peptide sequence at SEQ ID NO 11376
atggactccaccgcggctgctgctgctgctgctaccgcggccgcgccggtgctgctggtgacgaacgacgacgggatcgacgcgccggggctccgcttcctcgtcgaccagctcgtcgccgcggggcggtaccgcgtactcgtctgcgcgcccgacacagacaaatcgggtgtgagccacagcatcacatggcgtgctgcactccgctgtaaacgtgttgatataacgggtgctacagcatttggagtttcaggaagtcctgctgactgtgcctctttaggcatctctggaaaactctttgatggtttggttcctgatctggtacttagtggaatcaacattggaaacaattgtgggtaccatgtcatttattctggaacagttgctggtgctagggaggcattcttatatgggattcctgcgatatctatgtcatatgattgggttgcgggtcggagcagtgttaatgagctcaaggtgtctgcagaggtctgcatgcctctgataaatgctatcgtgactgagatcaagaatgggacttatcctcaaggatcattcttgaatgtagacgtaccaacagatgctgcacaccacaagggctacaaaattacaaaacaaggaacatatatggccagaattagttgggagcaaacggtttacaagaagcctgcggtagaaagttaccagacagcaaacatggatgttgatggcgaaaaggatagcgaactagttacttcagaaaatgacctactgtttaagagagtgattgtagggagaagtgccgatggagtggaaggagacgaaatggactacaagtccctagttgatggatacatcactgttactcctttgggtgctctttcccactcagaaccagatgccataccctatttcaaagcttgcgtatcacgtctggaccaaaaaaatccctctccgaaagatgaatttaaacgttccgcccaaagcgtaagacgttttataggactgttgtgcaacatgctctctgtcctagaaaaaaatatataa

SEQ ID NO: 11376 - protein, 341 aa, Sorghum bicolor
  misc_feature: Ceres ANNOT ID no. 6011000
  misc_feature (16)..(213): Pfam Id: SurE Pfam Desc: Survival protein SurE
  misc_feature (18)..(299): NCBI GI: 92893321 NCBI Desc: survival protein sure [medicago truncatula]
  misc_feature (18)..(279): NCBI GI: 140056998 NCBI Desc: survival protein sure [medicago truncatula]
  misc_feature (16)..(125): NCBI GI: 144923338 NCBI Desc: survival protein sure [medicago truncatula]
  misc_feature (16)..(215): NCBI GI: 92872744 NCBI Desc: survival protein sure [medicago truncatula]
  misc_feature (3)..(223): NCBI GI: 115439507 NCBI Desc: os01g0709400 [oryza sativa (japonica cultivar-group)]
MDSTAAAAAAATAAAPVLLVTNDDGIDAPGLRFLVDQLVAAGRYRVLVCAPDTDKSGVSHSITWRAALRCKRVDITGATAFGVSGSPADCASLGISGKLFDGLVPDLVLSGINIGNNCGYHVIYSGTVAGAREAFLYGIPAISMSYDWVAGRSSVNELKVSAEVCMPLINAIVTEIKNGTYPQGSFLNVDVPTDAAHHKGYKITKQGTYMARISWEQTVYKKPAVESYQTANMDVDGEKDSELVTSENDLLFKRVIVGRSADGVEGDEMDYKSLVDGYITVTPLGALSHSEPDAIPYFKACVSRLDQKNPSPKDEFKRSAQSVRRFIGLLCNMLSVLEKNI

SEQ ID NO: 11377 - DNA, 342 bp, Sorghum bicolor
  misc_feature: Ceres ANNOT ID no. 6011085
  misc_feature: Encodes the peptide sequence at SEQ ID NO 11378
atggcagcgaagtggtggttcatcgcctccctgctgctctgcctcgccgtcgcgtcagcggcggcaagagcaatgccgcgcgactgcgacaccgccatcttcgcggcggccgcgggcgacgacgacgaagacaatgccagcgccggcgccgtggacgaggccaccaagaccgccgacgtgtttggcggccggaccagcggcggcggcctcttcggcggcgttcacggcccgctgggcggtggcgtcgctgggttcggcccgttcggtggcgccgtcgccggcgcgggcccgttcggtgggttcggtggcggtggcggcgccggcgccggcggcgtcccgtaa

SEQ ID NO: 11378 - protein, 113 aa, Sorghum bicolor
  misc_feature: Ceres ANNOT ID no. 6011085
  misc_feature (2)..(111): NCBI GI: 115458522 NCBI Desc: os04g0438100 [oryza sativa (japonica cultivar-group)]
  misc_feature (3)..(111): NCBI GI: 117650697 NCBI Desc: glycine-rich protein [gossypium hirsutum]
  misc_feature (29)..(111): NCBI GI: 92888315 NCBI Desc: glycine rich [medicago truncatula]
  misc_feature (55)..(111): NCBI GI: 7635831 NCBI Desc: probable atp-dependent rna helicase ded1 [neurospora crassa]
  misc_feature (3)..(110): NCBI GI: 21592349 NCBI Desc: glycine-rich protein like [arabidopsis thaliana]
MAAKWWFIASLLLCLAVASAAARAMPRDCDTAIFAAAAGDDDEDNASAGAVDEATKTADVFGGRTSGGGLFGGVHGPLGGGVAGFGPFGGAVAGAGPFGGFGGGGGAGAGGVP

SEQ ID NO: 11379 - DNA, 1215 bp, Sorghum bicolor
  misc_feature: Ceres ANNOT ID no. 6011227
  misc_feature: Encodes the peptide sequence at SEQ ID NO 11380
atggagcgcccgaagaagaccgcggtggctggcctacccgacgacctcctggtggagatcctctcctgcctccccatcaacgagatccaccgatgcaagtgcgtctccaaaggctggcgcgacctcatcgcggatcccctccaccacaagaagctcccccaaaccctccatggttttttcccttcctacgtgggggagttgggatctttcatcaatctgtctgggggatccgcgtcaaccttcgacccttccttcgccttcctcaagaagctgcctggcattcacaacatctggctcagggcgtcctgcaacgggctcctcctctttaggcacagcaccaggcttcgcgagcttggctatattgtgttcaaccccgccactgagcagtgggcggccgtgcccagcgagcatactctggctgataggcctattcgcttcagccacacctgtttcgtgttcaatccggctgtctccccctacttccatttggtcatcatcagcgcgcggggggtgagcctggcaacagtgcaattctactcctcagaaacaggggtgtggaggcacacccagattgactgggctgaagaagtagagctgcgaagacaatggaataagcgggatcctcagatcagggggtgcaccccttgtgctgccattttcaacagcatgctgtatttgatcttgactgataatcagatatttgaggtggatgtggaagggaacacaaaaaggataatccgagcgccatcttctgtgggtgggcgggttcatggctgcgttccgcttttcattggtcaatcccaagggcgcctatattgcatcaatgaagaacattgggcagatggtatcccatctgaactgtccagtcgtgtttttagaagagactccgatgataattctaatctactgtcaatctgggttcttgaggactatgatacacaaaagtgggcccttaagcacagtgtgagctgttcacgtctgtttggaaggacaggttttcttggttacaatgttgttgccattcatccagacaacaacaatttcatgttcattgtatatcggaaacaccagctgatatcatatggcttgaatagcaaggaagtgcggactgtcggcacatttcaggaatccttgcagcttcctccttatgttccttgcttctcggacttcttatcagtggcacggcatgaagagatactaggggttggcgtgtga

SEQ ID NO: 11380 - protein, 404 aa, Sorghum bicolor
  misc_feature: Ceres ANNOT ID no. 6011227
  misc_feature (7)..(54): Pfam Id: F-box Pfam Desc: F-box domain
  misc_feature (39)..(275): NCBI GI: 50508392 NCBI Desc: receptor-like kinase-like [oryza sativa (japonica cultivar-group)]
  misc_feature (12)..(278): NCBI GI: 115462393 NCBI Desc: os05g0177400 [oryza sativa (japonica cultivar-group)]
  misc_feature (12)..(392): NCBI GI: 115462391 NCBI Desc: os05g0177100 [oryza sativa (japonica cultivar-group)]
  misc_feature (8)..(277): NCBI GI: 115462373 NCBI Desc: os05g0175800 [oryza sativa (japonica cultivar-group)]
  misc_feature (12)..(163): NCBI GI: 117670145 NCBI Desc: f-box-like protein [hordeum vulgare]
  misc_feature: The sequence is a functional homolog of SEQ ID NO. 456 in the 11/188,298 US application
MERPKKTAVAGLPDDLLVEILSCLPINEIHRCKCVSKGWRDLIADPLHHKKLPQTLHGFFPSYVGELGSFINLSGGSASTFDPSFAFLKKLPGIHNIWLRASCNGLLLFRHSTRLRELGYIVFNPATEQWAAVPSEHTLADRPIRFSHTCFVFNPAVSPYFHLVIISARGVSLATVQFYSSETGVWRHTQIDWAEEVELRRQWNKRDPQIRGCTPCAAIFNSMLYLILTDNQIFEVDVEGNTKRIIRAPSSVGGRVHGCVPLFIGQSQGRLYCINEEHWADGIPSELSSRVFRRDSDDNSNLLSIWVLEDYDTQKWALKHSVSCSRLFGRTGFLGYNVVAIHPDNNNFMFIVYRKHQLISYGLNSKEVRTVGTFQESLQLPPYVPCFSDFLSVARHEEILGVGV

SEQ ID NO: 11381 - DNA, 1257 bp, Sorghum bicolor
  misc_feature: Ceres ANNOT ID no. 6011260
  misc_feature: Encodes the peptide sequence at SEQ ID NO 11382
atggatggccccaagaggaccaaggccgctgcagctgatggcttccctgatgaccccgtcgtgaagatcctctcctgcctccccgctaagccacttttccggttcaagtgcgtctccaaaggctggtgcgacctcatcgtcgatcgccttggccgccgaaagttcccccaaaccctagagggtttcttcatcgacagcagcgttggcggtggcgtgaatgatttgcgattcatcaacctatcagggaaatctgtgcctctcgtcgatgcctcattctccttcctcacaaagctgcctgagattaagcaaatcaaactcttgagcgcccacaatggactcctcctctttgagaacttcattgattgtgacagatacaagtacatcatttgcaaccctgccactgaacaatggatgtgcgtgcccagccctggcattagttcacatccgcccagaacatgtgattgtgaacaacattttgcaaatgaagtcaacagccttctgattttcaacccggatgtctcctcgcactttcacctgctccaattctggcacagtaatgacgaaactaggttagtcaacactgtgcttgccttctcatctgaaactggggtttggagaaatagtactacagaatggataaaatggagagaatggatggaacttgacgaagtgcgatctaagttgggctatgctgatgttaatggcatgctgcatgttccagtctacccgcagcccatactaacaccgtcacagagacaggatattaagatagttgtggcggacatgcaagggaagaaacttatggcgatccactggccaggcttgaatgaatttactgatgctacttttattggtcaatcccaaggacacctgcattgcatcactgcacataaaaaacaagaccatcccatccacatcactggactatccatttgggttcttgaggactatgatgcagggcattgggtcctgaagaaaagcgtgagttgttcacagctgtttggagaaatgagttgtggagtcaatgacttagatgtgatcaccattcacccagatcgcaatttggttttcttcgttcaccgctgcagctggaaactgatgtcatatgacatggatactgaggaagtgtgtgatctctacactctaggacatggttgtgggctgattatcccttatgttccctatttcgcggatgtgcctgtgctcagcggcagagcttcaactgattttctggaggggcaaccaacaatagtgtaa

SEQ ID NO: 11382 - protein, 418 aa, Sorghum bicolor
  misc_feature: Ceres ANNOT ID no. 6011260
  misc_feature (10)..(57): Pfam Id: F-box Pfam Desc: F-box domain
  misc_feature (42)..(212): NCBI GI: 50508392 NCBI Desc: receptor-like kinase-like [oryza sativa (japonica cultivar-group)]
  misc_feature (11)..(212): NCBI GI: 115462373 NCBI Desc: os05g0175800 [oryza sativa (japonica cultivar-group)]
  misc_feature (16)..(181): NCBI GI: 117670145 NCBI Desc: f-box-like protein [hordeum vulgare]
  misc_feature (2)..(239): NCBI GI: 115462391 NCBI Desc: os05g0177100 [oryza sativa (japonica cultivar-group)]
  misc_feature (2)..(146): NCBI GI: 115462393 NCBI Desc: os05g0177400 [oryza sativa (japonica cultivar-group)]
  misc_feature: The sequence is a functional homolog of SEQ ID NO. 456 in the 11/188,298 US application
MDGPKRTKAAAADGFPDDPVVKILSCLPAKPLFRFKCVSKGWCDLIVDRLGRRKFPQTLEGFFIDSSVGGGVNDLRFINLSGKSVPLVDASFSFLTKLPEIKQIKLLSAHNGLLLFENFIDCDRYKYIICNPATEQWMCVPSPGISSHPPRTCDCEQHFANEVNSLLIFNPDVSSHFHLLQFWHSNDETRLVNTVLAFSSETGVWRNSTTEWIKWREWMELDEVRSKLGYADVNGMLHVPVYPQPILTPSQRQDIKIVVADMQGKKLMAIHWPGLNEFTDATFIGQSQGHLHCITAHKKQDHPIHITGLSIWVLEDYDAGHWVLKKSVSCSQLFGEMSCGVNDLDVITIHPDRNLVFFVHRCSWKLMSYDMDTEEVCDLYTLGHGCGLIIPYVPYFADVPVLSGRASTDFLEGQPTIV

SEQ ID NO: 11383 - DNA, 1170 bp, Sorghum bicolor
  misc_feature: Ceres ANNOT ID no. 6011267
  misc_feature: Encodes the peptide sequence at SEQ ID NO 11384
atggactgcgcaaaggggacggcggtggcgggcctctatgatgacctaatggtggagatcctctcatgtgtgcccgtcaaggatgtccgccgatccaagtgtgtgtcgaaaccctggcgcgacctcattgccgaccccctccaccgcaagaactatgggcacttcaccagcctaccagggagtgaagaagatgctcctccagtcgacccttccttctccttcctcatggcgaagcaacctggggtcgagcgtatcgccctcttggattcctgcaacgggatcttgctctttgggtgcatccaagataacaagtttgggtacattgtgtgcaaccctgcgactgaggaattggtgactgtgcccgccagctctagctcttgtccgtctccacctcaactgaaagagaactatgatggtgatgatggggaaagatatgcacacacctatctgatgtttgaccctgttgtctcctcacgcttccacttggtccaattctggataaatctgaaggggaaggtggagatagaaatggtgcactcttactcatctgaaactagggcatggagtaataggtcaagcaagttggagcgaggtaaagagggcggtggatggggactgtggggtgaagtcataatcggattcatgtgcggcaaggctttggtcaatggtttgttgcattttattgtctaccatgttgagaaaaaggagaatctgatagttgcggtggacggggaagcaaaaatttgcagggtcatccgttggcatgataagcatggagttaacattcctgcttttattgatcaatcccaaggccatctgcactgcattagtacggatctgcaatttaaagacctccagttccaattcacagagctgtcagtttggtttcttgaggactatgatacacaagaatggattctgaagcacaatgtgagttgttcacagttctttggatcactgagttgcccgttcaatgattttgatatcgtggccattcatccagatcacaattcaatattccttgttcagcactggaaccagaaactggtatcatattacatggatagtaaggaactgcatgttctccggagtctaggagaggactatctatatattaccccatacattccccgttacatagagttaccggttcttgccaccaaggactag

SEQ ID NO: 11384 - protein, 389 aa, Sorghum bicolor
  misc_feature: Ceres ANNOT ID no. 6011267
  misc_feature (7)..(54): Pfam Id: F-box Pfam Desc: F-box domain
  misc_feature (12)..(381): NCBI GI: 115462391 NCBI Desc: os05g0177100 [oryza sativa (japonica cultivar-group)]
  misc_feature (203)..(383): NCBI GI: 50508392 NCBI Desc: receptor-like kinase-like [oryza sativa (japonica cultivar-group)]
  misc_feature (12)..(309): NCBI GI: 115462393 NCBI Desc: os05g0177400 [oryza sativa (japonica cultivar-group)]
  misc_feature (8)..(309): NCBI GI: 115462373 NCBI Desc: os05g0175800 [oryza sativa (japonica cultivar-group)]
  misc_feature (12)..(164): NCBI GI: 117670145 NCBI Desc: f-box-like protein [hordeum vulgare]
  misc_feature: The sequence is a functional homolog of SEQ ID NO. 456 in the 11/188,298 US application
MDCAKGTAVAGLYDDLMVEILSCVPVKDVRRSKCVSKPWRDLIADPLHRKNYGHFTSLPGSEEDAPPVDPSFSFLMAKQPGVERIALLDSCNGILLFGCIQDNKFGYIVCNPATEELVTVPASSSSCPSPPQLKENYDGDDGERYAHTYLMFDPVVSSRFHLVQFWINLKGKVEIEMVHSYSSETRAWSNRSSKLERGKEGGGWGLWGEVIIGFMCGKALVNGLLHFIVYHVEKKENLIVAVDGEAKICRVIRWHDKHGVNIPAFIDQSQGHLHCISTDLQFKDLQFQFTELSVWFLEDYDTQEWILKHNVSCSQFFGSLSCPFNDFDIVAIHPDHNSIFLVQHWNQKLVSYYMDSKELHVLRSLGEDYLYITPYIPRYIELPVLATKD

SEQ ID NO: 11385 - DNA, 153 bp, Sorghum bicolor
  misc_feature: Ceres ANNOT ID no. 6011275
  misc_feature: Encodes the peptide sequence at SEQ ID NO 11386
atggcggaggacaaggtggggcggatcttcgtcggcgggctgtcgtgggacaccacggagcgcacgctcgagcgcaccttcggccagtacggcaaggtcatcgaggcacaggtacggcgacggttctgccctgccgtgatggttgtgatttga

SEQ ID NO: 11386 - protein, 50 aa, Sorghum bicolor
  misc_feature: Ceres ANNOT ID no. 6011275
  misc_feature (1)..(38): NCBI GI: 33146923 NCBI Desc: glycine-rich rna-binding protein-like [oryza sativa (japonica cultivar-group)]
  misc_feature (4)..(40): NCBI GI: 116667038 NCBI Desc: chain a, solution structure of the n-terminal rna binding domain in daz-associated protein 1
  misc_feature (1)..(38): NCBI GI: 469072 NCBI Desc: rna-binding gricine-rich protein-1 (rgp-1c) [nicotiana sylvestris]
  misc_feature (1)..(38): NCBI GI: 20975276 NCBI Desc: cold inducible rna-binding protein alpha [hyla japonica]
  misc_feature (7)..(40): NCBI GI: 108875770 NCBI Desc: heterogeneous nuclear ribonucleoprotein 27c [aedes aegypti]
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Useful for making plants with altered lignin content
  misc_feature: Useful for making plants with modulated nitrogen use efficiency
  misc_feature: Functional homolog of the protein sequence given in SEQ ID NO 13674
  misc_feature: Useful for making plants with modulated flowering time
  misc_feature: Functional homolog of the protein sequence given in SEQ ID NO 13675
  misc_feature: Useful for making plants with altered alkaloid content
  misc_feature: Functional homolog of the protein sequence given in SEQ ID NO 13676
  misc_feature: Useful for making plants with modulated biomass
  misc_feature: Functional homolog of the protein sequence given in SEQ ID NO 13677
MAEDKVGRIFVGGLSWDTTERTLERTFGQYGKVIEAQVRRRFCPAVMVVI

SEQ ID NO: 11387 - DNA, 1083 bp, Sorghum bicolor
  misc_feature: Ceres ANNOT ID no. 6011298
  misc_feature: Encodes the peptide sequence at SEQ ID NO 11388
atggggaaagaagttgttgatatgtctactgatgaagaatcagattgtgtagttatatgtccacctaatggaaatgctgatcatgaggaagttgtgagtggcagccatgatgaagattcttcaggaaggcaagagaacccttatgctatgaactcacatatggacagcaacagccaggaatatgtgtctgtaaacccagacctgcccaaggtgattcatcatcaggagtcttctctcagcaatacaccagcaaagcgtgcagtagctagacagcaagggtctagccatactgtccctgagccatgcactgttgcacctgaaagaaggtcatctggagcaggaaattgtgctccaattcctcatccctccagcagtggggaaaaactttcggataaaagtagctcctcaccaagaagcatggcaaagaagagtccatcagtcacacccaggaagcctctccaatcggacaatacttctcatagtcaagaagaggactcatattctgtcacttcttcaactgtaacttcagcaagagctggaaaaactaagaagacaactgttgctattgcacctacattcgtctgtgctaatcgtgctgagaagagaggagagttttacacaaaattagaagagaagcgcaaggctttggaagaggagaaactccaagcagaggccagaaagagggaagaggaagaagaagctctaagacaactgaggaagaacttggtcgttcgagcaaaacccatgccaagcttctaccaagaaggacccccaccaaaggttgaacttaagaaggtgcctccaactcgtgccaagtcaccaaaattgacacggagaaagagctgcagtgacacccctcatacaccagagggaggaaatggcagtgcagtatgctgccggttgcatcgtcacagcatcagcaactccaaagatgccagcagcaaggcacaatgttctccaaagagcgcttcaaagacgggatcagctactaaatccagggtcaccaaatccagggaagacctgaaggcttccatgaagaaagtgggacagccaagcgccgcaaacttcactgtacaaacctaa

SEQ ID NO: 11388 - protein, 360 aa, Sorghum bicolor
  misc_feature: Ceres ANNOT ID no. 6011298
  misc_feature (193)..(249): Pfam Id: TPX2 Pfam Desc: Targeting protein for Xklp2 (TPX2)
  misc_feature (67)..(336): NCBI GI: 42733494 NCBI Desc: bri1-kd interacting protein 116 [oryza sativa (japonica cultivar-group)]
  misc_feature (64)..(350): NCBI GI: 92874845 NCBI Desc: targeting for xklp2 [medicago truncatula]
  misc_feature (84)..(281): NCBI GI: 32395575 NCBI Desc: seed specific protein bn15d14a [brassica napus]
  misc_feature (120)..(284): NCBI GI: 28453880 NCBI Desc: wave-dampened2 [arabidopsis thaliana]
  misc_feature (117)..(325): NCBI GI: 42733498 NCBI Desc: bri1-kd interacting protein 118 [oryza sativa (japonica cultivar-group)]
MGKEVVDMSTDEESDCVVICPPNGNADHEEVVSGSHDEDSSGRQENPYAMNSHMDSNSQEYVSVNPDLPKVIHHQESSLSNTPAKRAVARQQGSSHTVPEPCTVAPERRSSGAGNCAPIPHPSSSGEKLSDKSSSSPRSMAKKSPSVTPRKPLQSDNTSHSQEEDSYSVTSSTVTSARAGKTKKTTVAIAPTFVCANRAEKRGEFYTKLEEKRKALEEEKLQAEARKREEEEEALRQLRKNLVVRAKPMPSFYQEGPPPKVELKKVPPTRAKSPKLTRRKSCSDTPHTPEGGNGSAVCCRLHRHSISNSKDASSKAQCSPKSASKTGSATKSRVTKSREDLKASMKKVGQPSAANFTVQT

SEQ ID NO: 11389 - DNA, 936 bp, Sorghum bicolor
  misc_feature: Ceres ANNOT ID no. 6011303
  misc_feature: Encodes the peptide sequence at SEQ ID NO 11390
atgatactgctccagtccccatcgaggttcctgctccagatcctgcaagaccgtgttctcagtggcgagaagggtatggacatcgactgtcacacagtagagtttgacgatgtccggtatcatattcagttttctatgaggaatccaaaggcaatggtgttgtcagttgctttgcctctgccacctcctgaagcgattctgtatgatgggcttccacttggtgccattgaagctataaaagcagcttatgggccagttgtgcagattcttgatcctccaaaggatgggtttgatctcacgatgaagataaatttgacaaaacttccaccagatgaagagcaaaggaatgctatcttgacacaaattgcatctattagagaggttgtgctgggtgcaccactgaagctcctgctgaaacatttagcctcaaggacagttgcacctaatgttgacaagcttgttgctcttgttcaccgtcctaatgaatcttttttccttgctccccaggcagataaagttactatcatgtacccaatgagattccaggactccattgatattgttttggcaacttccttcctgcaggaatttgtggaggcaagacgaacggctgcacttaataatgttccttcttgtatgtggtctccggcaccacctcatgagttaaaaggagtatctgctgatgcactgaatgcaaatgctggctttgttactttcgttgtttaccctcggcatgttgagggtaaaaagctagatagaacagtttggaatttgttgacatttcatgcttattgttctgaaggattcatgcataccaggatgaggcgcagggttgagtcgctgatccaggcgttggaccgagcgaagtcggatgcagagaaattgaagaagttggtacatggtggatctttccaaagactgattcttaaaatctag

SEQ ID NO: 11390 - protein, 311 aa, Sorghum bicolor
  misc_feature: Ceres ANNOT ID no. 6011303
  misc_feature (53)..(294): Pfam Id: P34-Arc Pfam Desc: Arp2/3 complex, 34 kD subunit p34-Arc
  misc_feature (19)..(266): NCBI GI: 4926828 NCBI Desc: t17h7.13 [arabidopsis thaliana]
  misc_feature (1)..(293): NCBI GI: 30685673 NCBI Desc: actin-related protein 2/3 complex 34kda subunit family / arp2/3 complex 34kda subunit family [arabidopsis thaliana]
  misc_feature (1)..(298): NCBI GI: 38345318 NCBI Desc: osjnba0004n05.15 [oryza sativa (japonica cultivar-group)]
  misc_feature (1)..(298): NCBI GI: 116311081 NCBI Desc: osigba0157k09-h0214g12.22 [oryza sativa (indica cultivar-group)]
  misc_feature (13)..(306): NCBI GI: 60467975 NCBI Desc: p34-arc [dictyostelium discoideum]
MILLQSPSRFLLQILQDRVLSGEKGMDIDCHTVEFDDVRYHIQFSMRNPKAMVLSVALPLPPPEAILYDGLPLGAIEAIKAAYGPVVQILDPPKDGFDLTMKINLTKLPPDEEQRNAILTQIASIREVVLGAPLKLLLKHLASRTVAPNVDKLVALVHRPNESFFLAPQADKVTIMYPMRFQDSIDIVLATSFLQEFVEARRTAALNNVPSCMWSPAPPHELKGVSADALNANAGFVTFVVYPRHVEGKKLDRTVWNLLTFHAYCSEGFMHTRMRRRVESLIQALDRAKSDAEKLKKLVHGGSFQRLILKI

SEQ ID NO: 11391 - DNA, 1554 bp, Sorghum bicolor
  misc_feature: Ceres ANNOT ID no. 6011448
  misc_feature: Encodes the peptide sequence at SEQ ID NO 11392
atggcctccgtggggtcggccgcacgcgaagcgtacgacgaggaggccgccgtccgccggcccctcgagctcgacggccgtgacggcgccaccgcctcgtcctccgaccaccaccgccccggtgggaatgtcatgcctaggtatcaagtggggacgaagggtgatacaagtagtagacactccgaggagcggaggcagcctagcacagatgatgtgcgcaagagcaagcctgggtcgagatacttcacggcgtttggggtggatctgtcccctgataatatggcagttgccattgtatattttgtgcaaggggttctaggtcttgcacggcttgctgtgagcttttacttaaaagatgatcttcatctagatccagctgagactgcagtggtaactggtttctcgtccttgccatggttgatcaagcccctctatggctttatcagtgattccattccactctttggatatcgaagaaggtcatacctttttctgtcagggttacttggagcactttcatggagtttaatggccacagtagtgagcagtaaatacagtgcagcatcctctattcttcttggctcactttctgttgccttctcagatgttgtagtggattctatggttgttgagagagcccgtggagaatctcaaagtacatctggatcactccagtcgctctgttggggatcttctgcctttggaggaattgtgagtgcttacttcagcggttcgcttgtcgatacttatggagtaagatttgtctttggtgttacagcgtttttacccctgatgacatctgctgttgcagttcttgtaaatgaacatcacatatcttctggagagcgtactaccttactctctggttcaggattcgttgagagctctaagcagcacgtcaggcagctttggacttcagtaaagcagcctaacattttgttgccgacattgtttatatttctttggcaagcaacaccgcactcagattctgctatgtttttcttcatcacaaacaagcttggattcactccagagttcctagggcgtgtgaagcttgtaacctcttttgcatccctgcttggtgttgggctctacaactattttctgaaggaagtttctttaaggaaaatctttctcgcgacaaccattataggttcagctcttgggatgacacaggtgcttcttgtaactgggctaaatcggcagtttgggataagcgatgagtggttttctattggtgattcattaatcatcacagtccttggtcaggcttcatttatgccagtcttggtgttagctgcaaaattgtgccctccaggaatggaagccactttatttgcaactttgatgtccatttctaatgctggaagtgttactggtggtctggttggtgctggtctaactcggatatttggggtcactagggacacctttgggaatctacctctattgattgtcgtctgcaatcttagttcactgctgcccttacctcttttaggtctcctgccagaggaatcaggtgacacagataatggagaaacaaagaataactga

SEQ ID NO: 11392 - protein, 517 aa, Sorghum bicolor
  misc_feature: Ceres ANNOT ID no. 6011448
  misc_feature (103)..(518): Pfam Id: BT1 Pfam Desc: BT1 family
  misc_feature (99)..(461): Pfam Id: MFS_1 Pfam Desc: Major Facilitator Superfamily
  misc_feature (83)..(515): NCBI GI: 115455887 NCBI Desc: os03g0795000 [oryza sativa (japonica cultivar-group)]
  misc_feature (85)..(517): NCBI GI: 126656881 NCBI Desc: biopterin transport-related protein bt1 [cyanothece sp. ccy0110]
  misc_feature (89)..(514): NCBI GI: 145348314 NCBI Desc: fbt family transporter: folate/pteridine [ostreococcus lucimarinus cce9901]
  misc_feature (85)..(517): NCBI GI: 67925656 NCBI Desc: biopterin transport-related protein bt1 [crocosphaera watsonii wh 8501]
  misc_feature (74)..(510): NCBI GI: 75907460 NCBI Desc: biopterin transport-related protein bt1 [anabaena variabilis atcc 29413]
MASVGSAAREAYDEEAAVRRPLELDGRDGATASSSDHHRPGGNVMPRYQVGTKGDTSSRHSEERRQPSTDDVRKSKPGSRYFTAFGVDLSPDNMAVAIVYFVQGVLGLARLAVSFYLKDDLHLDPAETAVVTGFSSLPWLIKPLYGFISDSIPLFGYRRRSYLFLSGLLGALSWSLMATVVSSKYSAASSILLGSLSVAFSDVVVDSMVVERARGESQSTSGSLQSLCWGSSAFGGIVSAYFSGSLVDTYGVRFVFGVTAFLPLMTSAVAVLVNEHHISSGERTTLLSGSGFVESSKQHVRQLWTSVKQPNILLPTLFIFLWQATPHSDSAMFFFITNKLGFTPEFLGRVKLVTSFASLLGVGLYNYFLKEVSLRKIFLATTIIGSALGMTQVLLVTGLNRQFGISDEWFSIGDSLIITVLGQASFMPVLVLAAKLCPPGMEATLFATLMSISNAGSVTGGLVGAGLTRIFGVTRDTFGNLPLLIVVCNLSSLLPLPLLGLLPEESGDTDNGETKNN

SEQ ID NO: 11393 - DNA, 1680 bp, Sorghum bicolor
  misc_feature: Ceres ANNOT ID no. 6011556
  misc_feature: Encodes the peptide sequence at SEQ ID NO 11394
atgatggatccggagatgctgcggctggcgcaggagcagatgcgccgcatgtccccggacgacatcgcccggatgcaacagcagctgatgtctaaccctaacctcatgaggatggcgtctgagagcatgaagaacatgaagcctgaggacttaaggcgagctgcggagcaactgaatcaaacaagaccggaggatatgcgtgatatgactgagaaaatcgccaacactactcccgaggagtttgctgctatgaaggctcaagcagatgctcagatgtcgtatgcgatatctggtgcaaagatgttaaagaagcagggaaatgaacttcataaccagggacagtattcagatgctgctagcaaatacaagcttgccaaggataacttaaaaagcataccatcgtccacggcgcatactctgcagttgcaatgtacccttaatttgatggcttgttacttgaagacagggcagtttgatgaatgcataagtgaaggttcagaggttctaacttatgattcgaacaatgtgaaagcttattatcggaggggtcaggcgtataaagaactcgggaagttggaggcggctgttgctgacttgagtaaagcccatgaaatttccccagaggacgaaactattgctgaggttctaagagatgctgaagaaaaactttcacgggaagggggaggagtgagcacacggaaaggtgttgttattgaagaagtcgtagaagatgatgcttcacagccatcaagcagtcaaaggagtactcctgggtatactgtttcacaaccacctgaaggagcaggaaatattgggctctcaggatcttcagaaaggtcaagggatgatcctgcttctatcaggtcatcacaaaattatgtgtccaacaatgatcctgaaggtttgccaaagttcggaattgaaggaatgtcacctgaacttgtcaaaactgccactgatatgattggtacaatgaaaccagaggagcttcagaaaatgtttgaagttgcttcttcgttgaatggcactagctccgctggtccaaatctgggacccaatatgccagaaatgtctcctgatatgcttaagatggcatctgacatgattggtaacatgtctcctgatgagctacagaaaatgatgagttttgcttctcagatgggtgggcctggtggtgcccccagaagacctgagaatagtaactttggaccttcatcgagagctacaagtatttcagcccgtggatcatcatctcaacctattttggagaaccctgatgaactatcaaatgaccataggatgggccagtcgtcttctagtcttccaccttctacagctgatatgcaagaaaccatgaaaaattctatgaaagaccctgcaatgcggcagatgcttacatccatgatgaagaacatgagccctgagatgatggcaaatatgagtgagcagtttggaatgaaactgtcaaaggaggatgctgcaaaagctcaacaagccatgtcgtcattatctccagaggatttggatagaatgatgagatggatggagcgagcgcagaaaggggtagacgtcgcgaagaagacaaagaactggctcctaggccggcgaggcttgatcctcgctattgtcatgctgatcctagccttcatccttcagaagcttgggtttatcggcaggtga

SEQ ID NO: 11394 - protein, 559 aa, Sorghum bicolor
  misc_feature: Ceres ANNOT ID no. 6011556
  misc_feature (176)..(209): Pfam Id: TPR_1 Pfam Desc: Tetratricopeptide repeat
  misc_feature (176)..(209): Pfam Id: TPR_2 Pfam Desc: Tetratricopeptide repeat
  misc_feature (1)..(558): NCBI GI: 30688239 NCBI Desc: tetratricopeptide repeat (tpr)-containing protein [arabidopsis thaliana]
  misc_feature (1)..(333): NCBI GI: 38344068 NCBI Desc: osjnba0006b20.12 [oryza sativa (japonica cultivar-group)]
  misc_feature (10)..(380): NCBI GI: 145351836 NCBI Desc: trp-containing protein [ostreococcus lucimarinus cce9901]
  misc_feature (97)..(218): NCBI GI: 110591172 NCBI Desc: chain a, the solution structure of the tetratrico peptide repeat of human smooth muscle cell associated protein-1, isoform 2
  misc_feature (85)..(212): NCBI GI: 115484171 NCBI Desc: os11g0148300 [oryza sativa (japonica cultivar-group)]
MMDPEMLRLAQEQMRRMSPDDIARMQQQLMSNPNLMRMASESMKNMKPEDLRRAAEQLNQTRPEDMRDMTEKIANTTPEEFAAMKAQADAQMSYAISGAKMLKKQGNELHNQGQYSDAASKYKLAKDNLKSIPSSTAHTLQLQCTLNLMACYLKTGQFDECISEGSEVLTYDSNNVKAYYRRGQAYKELGKLEAAVADLSKAHEISPEDETIAEVLRDAEEKLSREGGGVSTRKGVVIEEVVEDDASQPSSSQRSTPGYTVSQPPEGAGNIGLSGSSERSRDDPASIRSSQNYVSNNDPEGLPKFGIEGMSPELVKTATDMIGTMKPEELQKMFEVASSLNGTSSAGPNLGPNMPEMSPDMLKMASDMIGNMSPDELQKMMSFASQMGGPGGAPRRPENSNFGPSSRATSISARGSSSQPILENPDELSNDHRMGQSSSSLPPSTADMQETMKNSMKDPAMRQMLTSMMKNMSPEMMANMSEQFGMKLSKEDAAKAQQAMSSLSPEDLDRMMRWMERAQKGVDVAKKTKNWLLGRRGLILAIVMLILAFILQKLGFIGR

SEQ ID NO: 11395 - DNA, 660 bp, Sorghum bicolor
  misc_feature: Ceres ANNOT ID no. 6011618
  misc_feature: Encodes the peptide sequence at SEQ ID NO 11396
atggagtgcttaccatctagtgctccacaacgagcgggggtagcggcggctaacctgtccctgacgttggcaccggcggcctgcggcagctccggcgacggcgacgacgacgacgacgtgggaggcaggaacgtgcgtcgtcgtctttacccctgtcttttctgcgacaagacgttcctcaagtcgcaggcgctcggtggccaccagaatgcccacaaaaaggagcgaagcaccagctggaacccctacgtctacgacggccagcacgccggcaccatcgctgagccgacgccggccttgtcgtcgtcgatcgtcggccgcagcgtcagcagcgctgccaccttgtccattccatcgcagtctcacggtggcagcgccatgcgcgcggagcctgtgcctgccggtggccgtgacgggacagatggcattggcaccgccgtcgtcccaaactttcgagcgagaatgctgcaaaggcggcgggcggcgctattcgcaccggtgaacatcaggtcagcagagatggatacggtggtggctgatggcacgatcgacatgctcaattgggtcagggcctcagttgcgcctgaggccaccagtgctggcaccacagctgacctgcagggtgagcatctggatctcaaccttgagctgagactctag

SEQ ID NO: 11396 - protein, 219 aa, Sorghum bicolor
  misc_feature: Ceres ANNOT ID no. 6011618
  misc_feature (16)..(149): NCBI GI: 115455775 NCBI Desc: os03g0786400 [oryza sativa (japonica cultivar-group)]
  misc_feature (18)..(77): NCBI GI: 9758313 NCBI Desc: cchh finger protein 2-like protein [arabidopsis thaliana]
  misc_feature (35)..(135): NCBI GI: 38346721 NCBI Desc: osjnba0086o06.19 [oryza sativa (japonica cultivar-group)]
  misc_feature (20)..(77): NCBI GI: 790679 NCBI Desc: zinc finger protein
  misc_feature (6)..(78): NCBI GI: 115434314 NCBI Desc: os01g0129200 [oryza sativa (japonica cultivar-group)]
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 1091 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 636 in the 10/374,780US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1091 in the 20040045049 US patent application
  misc_feature: The sequence is a functional homolog of SEQ ID NO 1013 in the 20070033671 US patent application
MECLPSSAPQRAGVAAANLSLTLAPAACGSSGDGDDDDDVGGRNVRRRLYPCLFCDKTFLKSQALGGHQNAHKKERSTSWNPYVYDGQHAGTIAEPTPALSSSIVGRSVSSAATLSIPSQSHGGSAMRAEPVPAGGRDGTDGIGTAVVPNFRARMLQRRRAALFAPVNIRSAEMDTVVADGTIDMLNWVRASVAPEATSAGTTADLQGEHLDLNLELRL

SEQ ID NO: 11397 - DNA, 618 bp, Sorghum bicolor
  misc_feature: Ceres ANNOT ID no. 6011626
  misc_feature: Encodes the peptide sequence at SEQ ID NO 11398
atggagcaggagcgctcgtcaccgccatcgcaagcagcagcgacgatgaacctctcgctggacctggcgccggcggcacacggcgaggagacggacgaagtggcggtgccgacgaggtccgtcggcgggaagcaggtgcgcctgttcccctgcctgttctgcaacaagaagttcctcaagtcgcaggcgctcgggggccaccagaacgcgcacaagaaggagcgcgccgcctgctttaatgcctacgtctacgaccacgagtaccaccacgccgcagcgccgccgccgccgccgccggactgccgccgcggtaccaccgacgcttccatgtccgtcgcgatcctctcgtcgcacggcggccccgccggcgccggcgtcaagctcgagatgcctgacgacggtggcgcgccgccttactacgtggaccacgtggtgctcccagcggcggcaccctatcacccctgcaccaagcgcgacgacgacgacactgtgtacaacatgcgcgtctggaaaaggacctcccataccccaagctctgccgccccaccgcggagcgccggcaccaagaccgcatcctccagcgccggcgaggaaatggacctcgagcttcgactctag

SEQ ID NO: 11398 - protein, 205 aa, Sorghum bicolor
  misc_feature: Ceres ANNOT ID no. 6011626
  misc_feature (12)..(126): NCBI GI: 115455775 NCBI Desc: os03g0786400 [oryza sativa (japonica cultivar-group)]
  misc_feature (1)..(131): NCBI GI: 64175606 NCBI Desc: ramosa 1 [zea mays]
  misc_feature (49)..(131): NCBI GI: 64175632 NCBI Desc: ramosa 1 [zea mays]
  misc_feature (49)..(131): NCBI GI: 64175646 NCBI Desc: ramosa 1 [zea mays]
  misc_feature (3)..(130): NCBI GI: 62865694 NCBI Desc: ramosa1 c2h2 zinc-finger transcription factor [sorghum bicolor]
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1091 in the 10/412,699US patent application
  misc_feature: The sequence is a functional homolog of SEQ ID NO 1093 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 636 in the 10/374,780US patent application
  misc_feature: The sequence is a functional homolog of SEQ ID NO 638 in the 10/374,780US patent application
  misc_feature: The sequence is a functional homolog of SEQ ID NO 762 in the 10/666,642US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1091 in the 20040045049 US patent application
  misc_feature: The sequence is a functional homolog of SEQ ID NO 1093 in the 20040045049 US patent application
  misc_feature: Functional homolog of the protein sequence given in SEQ ID NO 13581
  misc_feature: The sequence is a functional homolog of SEQ ID NO. 351 in the 11/188,298 US application
MEQERSSPPSQAAATMNLSLDLAPAAHGEETDEVAVPTRSVGGKQVRLFPCLFCNKKFLKSQALGGHQNAHKKERAACFNAYVYDHEYHHAAAPPPPPPDCRRGTTDASMSVAILSSHGGPAGAGVKLEMPDDGGAPPYYVDHVVLPAAAPYHPCTKRDDDDTVYNMRVWKRTSHTPSSAAPPRSAGTKTASSSAGEEMDLELRL

SEQ ID NO: 11399 - DNA, 1245 bp, Sorghum bicolor
  misc_feature: Ceres ANNOT ID no. 6011633
  misc_feature: Encodes the peptide sequence at SEQ ID NO 11400
atgcgtcgcgtccgggtgtcctcccagcaggcccccgtccacaagctcggcgacgcccagatgaagctcacgcccaggttccgcctcgccgccacctccacctccacctcggatccagagcaccagcagcagcagccaccgtcgtcgtgggaggaggagcaggcgccgctgatcccgggcctgcccgacgacgcggcgctcaactgcctgctccgcctgcccgtctccgcccacgacgcgtgcaggctggtgtgccgccgctggcgcgtgctcctcgccgacaaggcccggttcttcgcgcagcggaggcagctgggcctccggacgccctggctcttcacgctcgcgttccaccgctgcacgggcaagatccagtggaaggtgctggacctgggccacctcacgtggcacgccatcccggccatgccgtgccgcgaccgggcatgcccgcgcgggttcggttgcgtcgctacccccggcggcgacggcgccgacggcgcgctcctcgtctgcggcggcctcgtctccgacatggactgcccgctgcacctcgtgctcaagtatgacatctataagaacaggtggaccgtcatgacacggatgctcactgctcggtctttctttgctggtggcgtgattgatggccgggtttatgttgctggtgggtatagcgcggatcagttcgagctcaattcagccgaggttcttgatcctgagaagggtgtttggcagcccattgctagtatggggatgaacatggcgtcgtctgactctgcggtgatcggcggcaggctctatgtcactgaaggatgcgcttggccgttcttctcatcgccgagaggccaagtgtatgaccccaagatcgaccggtgggaggtgatgccggttggaatgcgtgaagggtggacggggctaagtgtcgtcattgagggacgcctgtttgtcatttcagagtatgagaggatgaaggttaaagtgtatgatgcagaggcggattcatgggactcagtcagcggccctccgatgcctgaaaggattatgaagcccttctcggtcagttgtctcgacagcaagatcgtcgtcgtcggacgaggtctccatgtcgcgattggccatgttcagaaggaacctgctggtgatcctgatagcaggagttcaggctactccatttgctggcaagatgtggatgctcctaaggaattcagcgacctgacaccttcaagcagccagattctgcatgcttag

SEQ ID NO: 11400 - protein, 414 aa, Sorghum bicolor
  misc_feature: Ceres ANNOT ID no. 6011633
  misc_feature (204)..(250): Pfam Id: Kelch_1 Pfam Desc: Kelch motif
  misc_feature (56)..(103): Pfam Id: F-box Pfam Desc: F-box domain
  misc_feature (1)..(414): NCBI GI: 50508810 NCBI Desc: kelch repeat containing f-box protein family-like [oryza sativa (japonica cultivar-group)]
  misc_feature (52)..(414): NCBI GI: 51536380 NCBI Desc: kelch repeat containing f-box protein-like [oryza sativa (japonica cultivar-group)]
  misc_feature (54)..(370): NCBI GI: 115444911 NCBI Desc: os02g0202900 [oryza sativa (japonica cultivar-group)]
  misc_feature (41)..(404): NCBI GI: 92881986 NCBI Desc: cyclin-like f-box [medicago truncatula]
  misc_feature (54)..(334): NCBI GI: 86991186 NCBI Desc: kelch-motif containing protein [oryza sativa (japonica cultivar-group)]
  misc_feature: The sequence is a functional homolog of SEQ ID NO. 440 in the 11/188,298 US application
  misc_feature: The sequence is a functional homolog of SEQ ID NO. 315 in the 11/188,298 US application
MRRVRVSSQQAPVHKLGDAQMKLTPRFRLAATSTSTSDPEHQQQQPPSSWEEEQAPLIPGLPDDAALNCLLRLPVSAHDACRLVCRRWRVLLADKARFFAQRRQLGLRTPWLFTLAFHRCTGKIQWKVLDLGHLTWHAIPAMPCRDRACPRGFGCVATPGGDGADGALLVCGGLVSDMDCPLHLVLKYDIYKNRWTVMTRMLTARSFFAGGVIDGRVYVAGGYSADQFELNSAEVLDPEKGVWQPIASMGMNMASSDSAVIGGRLYVTEGCAWPFFSSPRGQVYDPKIDRWEVMPVGMREGWTGLSVVIEGRLFVISEYERMKVKVYDAEADSWDSVSGPPMPERIMKPFSVSCLDSKIVVVGRGLHVAIGHVQKEPAGDPDSRSSGYSICWQDVDAPKEFSDLTPSSSQILHA

SEQ ID NO: 11401 - DNA, 1155 bp, Sorghum bicolor
  misc_feature: Ceres ANNOT ID no. 6011691
  misc_feature: Encodes the peptide sequence at SEQ ID NO 11402
atggcgtcctcgtctcagtctcagtctcagtctcagtctctgacgccctatctcagggggaatgcccaccatgcgccgtggcgaagccgattcgtccgccgggcactgctcgtggccgcggcggcggcggctctggcggcagcggctggtggctctggtaccgcggacgaccagatcccggccatcttcatgttcggcgactccatcgtcgaccccggcaacaacaacaaccggttgacggaggcgagggccaacttcccgccgtacgggcaggacttccccggcggcgtcgccaccggcaggttctccaatggcttggtccctggggacctcttagcttccaagttgggtatcaaggagctgctgcctcctttccttagttctgatcttgaactaaaggacctactcactggtgtggcgtttgcctgtggtggcagtggctatgatcctctcacatccaagcttgcgacaaccttgtcgagtgacgatcaacttgaactgttccatgagtacaagcagaagctaacggctttggttggagagaaggaaatgacacgagttatctcagaaggcgtcttctttacagtaatggggtcaaatgacattgtaaataactatttcactctacctataagacgccacgaatatgatcttccttcgtacgtggactttcttgtctcttcggcgattaacttcacaaagactttgaatgatatgggagctaagaagattggatttcttggtgtcccaccattgggatgttgtccttcacaaataacacttggaggaagcccatcacgccaatgtgaaccacaaaggaatcaagcatcagagttatataattctagagtttcaaaggaaatagagcgattgaatgcagaacgaagtgcttccggatcaaagattgtttattttgacatatactacaacttgcttgatcttattcagaatccatcttcatatggtttcaaggatgcaagcgaaggttgctgtggaagcacagtgttaaatgctgccatattcattgcatatcacagtgcatgtccaaatgcaattgattatattttttgggatggcttccatcctaccgagaaggcctacaatattgtagtggataagctcattcagcaagcttcaaagtacctgatgatgtga

SEQ ID NO: 11402 - protein, 384 aa, Sorghum bicolor
  misc_feature: Ceres ANNOT ID no. 6011691
  misc_feature (62)..(374): Pfam Id: Lipase_GDSL Pfam Desc: GDSL-like Lipase/Acylhydrolase
  misc_feature (59)..(376): NCBI GI: 115467974 NCBI Desc: os06g0351700 [oryza sativa (japonica cultivar-group)]
  misc_feature (59)..(377): NCBI GI: 140061188 NCBI Desc: lipolytic enzyme, g-d-s-l [medicago truncatula]
  misc_feature (59)..(377): NCBI GI: 140071689 NCBI Desc: lipolytic enzyme, g-d-s-l [medicago truncatula]
  misc_feature (56)..(376): NCBI GI: 92886160 NCBI Desc: lipolytic enzyme, g-d-s-l [medicago truncatula]
  misc_feature (60)..(377): NCBI GI: 140071693 NCBI Desc: lipolytic enzyme, g-d-s-l [medicago truncatula]
MASSSQSQSQSQSLTPYLRGNAHHAPWRSRFVRRALLVAAAAAALAAAAGGSGTADDQIPAIFMFGDSIVDPGNNNNRLTEARANFPPYGQDFPGGVATGRFSNGLVPGDLLASKLGIKELLPPFLSSDLELKDLLTGVAFACGGSGYDPLTSKLATTLSSDDQLELFHEYKQKLTALVGEKEMTRVISEGVFFTVMGSNDIVNNYFTLPIRRHEYDLPSYVDFLVSSAINFTKTLNDMGAKKIGFLGVPPLGCCPSQITLGGSPSRQCEPQRNQASELYNSRVSKEIERLNAERSASGSKIVYFDIYYNLLDLIQNPSSYGFKDASEGCCGSTVLNAAIFIAYHSACPNAIDYIFWDGFHPTEKAYNIVVDKLIQQASKYLMM

SEQ ID NO: 11403 - DNA, 1923 bp, Sorghum bicolor
  misc_feature: Ceres ANNOT ID no. 6012706
  misc_feature: Encodes the peptide sequence at SEQ ID NO 11404
atggtggtgcagaagcagaggagggcgccggccgaggtgttctggcccaagattgtgctcaagaagtggctcaacctcaagagcaaggacctcgacttcggcgccgacgacgacgaggaagacgacgaagaagacgacggcagcagcgacgttgacggccaagagaactgcggctgtgacgacgaccgcggcggcagcgctcgccggccggccgaggacggcgcccacatcaccgatgagagcctggagagcgcgccgtacaagctgcggcggcggaactcggagacgctgcgcgcgcagtacatcaacaccaaggagctgagggtctgcgtcggcacctggaacgccggcggcaaggcgccgccggacgacctggacatcgccgagtggctcggcaccggcggcgacgccgagcccgccgacatctacgtgctcgggttccaggaagtggtgccgctgaacgccggcaacgtgttcggcgcggaggacgggcggccggcgctggcgtgggagtccgtgatccgtggcgcgctgcggcgggcgcagccgtcgaggcccaggtacaggtgctacagccaccctccgtcgccgtcgcggttcgacccgccggtcgacgccgcggctgccgccgacgagctcctccccggcggcacggacacggagaccgacaccgatgaggacgtgcccttcagcttccccgtgcgggccgaggagtacgtcgcggccacaccgaggaagctgagcaggctcaaccacttcagcgtcgtcgtggatgagaaggagaacggctcatcggagctcaacggcgacgaactggacgacggacctgatcagccgccgccgccgcagcagcagcagctaggccttcagcaacgggcgctcctgaggtcgctgagcagggcggacagggtggggctggtctggccggagcagccgctggacctgctccctccgcgcgccatgaacgccgcgtcgtcgttcaaggcgtccaagtcgttcaaatcgttcaggggttcgtttcggtcccgtgtggccgacgcggcggcggcggacgacctgcccatgatcccggacctcgacctggacctggacggcgcgctgcggaagaagagccggtcgccgttcgtacggatcgtgagcaagcagatggtggggatcttcctgacggtgtgggtgcggcgtggcctgagaaagtgcgtccagaacctcaaggtctccaccgtcggcgtcggcgccatgggctacatcggcaacaagggggccgtgtcggtgagcatgtccgtctaccagaccatgttctgcttcgtgtgcagccacctcgccgccggcgagaagcccggcgacgtccacaagcgcaacgccgacgtgcacgagatccaccgccgcacgcgcttcgccgcccccggcgacctgcagctgcccagagacatccacgaccatgaccggatcttctggctgggcgatctgaactaccggctggacgcgtcgtacgagcgagcgcacgagctgatcttggagggacgctggggcgagctggcggagacggaccagctgaagcgggagctgaggaaagggcgggcgttcgacgggtggacggaggggatcctggagttcgcgccgacctacaagtacgagctgagctcgaggaggtacgtcggcgtcggcgtcggggacgaccagagccacaggggcggcggcgggcggcggacgccggcgtggtgcgatcgggtgctgtcgtacggcaaggggatgaggctgctgggctaccggcggtcggagctggcgctgtcggaccaccgcccggtgacggccacgtacgcggcggaggtggaggtgttctccagccggaaactgcagagagcgctcacgctcacggacgccgaggtggagggcggccaggtcgtgccggacctcgatttttga

SEQ ID NO: 11404 - protein, 640 aa, Sorghum bicolor
  misc_feature: Ceres ANNOT ID no. 6012706
  misc_feature (109)..(606): Pfam Id: Exo_endo_phos Pfam Desc: Endonuclease/Exonuclease/phosphatase family
  misc_feature (15)..(630): NCBI GI: 115439585 NCBI Desc: os01g0716800 [oryza sativa (japonica cultivar-group)]
  misc_feature (27)..(630): NCBI GI: 15081807 NCBI Desc: at1g71710/f14o23_9 [arabidopsis thaliana]
  misc_feature (35)..(630): NCBI GI: 7239498 NCBI Desc: contains similarity to the inositol-1,4,5-trisphosphate 5-phosphatase from arabidopsis thaliana gi6117853
  misc_feature (367)..(631): NCBI GI: 10444261 NCBI Desc: inositol polyphosphate 5-phosphatase i [arabidopsis thaliana]
  misc_feature (367)..(631): NCBI GI: 42571739 NCBI Desc: inositol polyphosphate 5-phosphatase i (ip5pi) [arabidopsis thaliana]
MVVQKQRRAPAEVFWPKIVLKKWLNLKSKDLDFGADDDEEDDEEDDGSSDVDGQENCGCDDDRGGSARRPAEDGAHITDESLESAPYKLRRRNSETLRAQYINTKELRVCVGTWNAGGKAPPDDLDIAEWLGTGGDAEPADIYVLGFQEVVPLNAGNVFGAEDGRPALAWESVIRGALRRAQPSRPRYRCYSHPPSPSRFDPPVDAAAAADELLPGGTDTETDTDEDVPFSFPVRAEEYVAATPRKLSRLNHFSVVVDEKENGSSELNGDELDDGPDQPPPPQQQQLGLQQRALLRSLSRADRVGLVWPEQPLDLLPPRAMNAASSFKASKSFKSFRGSFRSRVADAAAADDLPMIPDLDLDLDGALRKKSRSPFVRIVSKQMVGIFLTVWVRRGLRKCVQNLKVSTVGVGAMGYIGNKGAVSVSMSVYQTMFCFVCSHLAAGEKPGDVHKRNADVHEIHRRTRFAAPGDLQLPRDIHDHDRIFWLGDLNYRLDASYERAHELILEGRWGELAETDQLKRELRKGRAFDGWTEGILEFAPTYKYELSSRRYVGVGVGDDQSHRGGGGRRTPAWCDRVLSYGKGMRLLGYRRSELALSDHRPVTATYAAEVEVFSSRKLQRALTLTDAEVEGGQVVPDLDF

SEQ ID NO: 11405 - DNA, 930 bp, Sorghum bicolor
  misc_feature: Ceres ANNOT ID no. 6012717
  misc_feature: Encodes the peptide sequence at SEQ ID NO 11406
atggcgaccaccgatgactccgccgccgtgggcgaggtccggcgtctgctcgcccacctcgactcccagcagcagatcctcgctgactgccacggcgcctggtcgcgcgccctcgcacacttcgcctcgcttgaggaggacctcgcctcccgctccgccgcactcgaggaagccctagccgccgccgacgcttccacctccgagtccctcgcggcgctcgaggcccgcgagtccgccgtccccgcgcgcctttccgaggcctccgccgcgctctccgccgccgtcgctgaggccgagactgaatccaccgggccaccgcccagcgacatcaagggcgcgctccggtggatatgccgccgcatggatgctgctgcgctctggcgcttcatggccgcacaccgccgggagctcgccgtggtccggaaggaggccggccccgccgtcgccatggccgtcgacccgccccgccttgtcctcgacgtggaagaggcaaacaacctggagggcaatgcgtacaggtccatcataaggtgtgttgagtcctgccagctacaatcggtgtgtcctatagaggtcatgaagaagaagttagcgaagttggagaaagataagtctgagaggaagaaggcagctggcccgagcagattccagaacaagcgatcccgaggcgcagctggaccctatcccttccctgctgccaaggctgctaggggctcaaactttggtccgcgtttccagaacccaatctcacgatccttaaactacgcagcccatgctggatatataaatccagcagctgcatcatcatactatgtgcctgggagcgtgtcagggcgacgaggtggtgtgccattcggtggatctggagctacatatggtggctcccctaactttgcagccggtggggggcagcagtcattccgtcgttag

SEQ ID NO: 11406 - protein, 309 aa, Sorghum bicolor
  misc_feature: Ceres ANNOT ID no. 6012717
  misc_feature (1)..(163): NCBI GI: 144924710 NCBI Desc: peptidase s8 and s53, subtilisin, kexin, sedolisin; frigida-like [medicago truncatula]
  misc_feature (8)..(160): NCBI GI: 115470809 NCBI Desc: os07g0173200 [oryza sativa (japonica cultivar-group)]
  misc_feature (23)..(160): NCBI GI: 21554367 NCBI Desc: hydroxyproline-rich glycoprotein-like protein [arabidopsis thaliana]
  misc_feature (27)..(160): NCBI GI: 16974572 NCBI Desc: at4g14900/dl3490c [arabidopsis thaliana]
  misc_feature (23)..(160): NCBI GI: 7268236 NCBI Desc: hydroxyproline-rich glycoprotein homolog [arabidopsis thaliana]
  misc_feature: Useful for making plants with altered alkaloid content
  misc_feature: Useful for making plants with altered cell wall content and/or composition
  misc_feature: Functional homolog of the protein sequence given in SEQ ID NO 13314
  misc_feature: Functional homolog of the protein sequence encoded by LOCUS at3g22440
  misc_feature: Functional homolog of the protein sequence encoded by LOCUS at4g14900
MATTDDSAAVGEVRRLLAHLDSQQQILADCHGAWSRALAHFASLEEDLASRSAALEEALAAADASTSESLAALEARESAVPARLSEASAALSAAVAEAETESTGPPPSDIKGALRWICRRMDAAALWRFMAAHRRELAVVRKEAGPAVAMAVDPPRLVLDVEEANNLEGNAYRSIIRCVESCQLQSVCPIEVMKKKLAKLEKDKSERKKAAGPSRFQNKRSRGAAGPYPFPAAKAARGSNFGPRFQNPISRSLNYAAHAGYINPAAASSYYVPGSVSGRRGGVPFGGSGATYGGSPNFAAGGGQQSFRR

SEQ ID NO: 11407 - DNA, 768 bp, Sorghum bicolor
  misc_feature: Ceres ANNOT ID no. 6012820
  misc_feature: Encodes the peptide sequence at SEQ ID NO 11408
atgagcttcggcggcagcagctccgtcgcatccggtgcgaagaggccgtttgagtacgggagaacgcatgtggtgaggcccaagggcacgcacaaggccaccattgtctggctccacggccttggggacaatggagccagctggtctcaactactggaaactcttccccttcctaatataaaatggatatgccccactgcaccttcaaggcctgtgtcagtgtttggcgggttcccctccacagcatggtttgatgttgctgatctttctgaggatgctcctgatgacattgagggcatggatgcctcagcagcacatgttgcgaatttgttgtcgactgaacctgctgacatcaaacttggtgttggtggctttagtatgggtgctgctactgctctgtactctgcaacatgctttgctcatggaaaatatgggaatgggaatccataccctgtgaacctaagtcttgccgttggacttagtggctggcttccatgtgccaggaccttgaagaacagaattgaagcctcaccagaggctgcacaaaaggcttcatcaatacctcttttgctctgtcatggaaaagctgatgatgtagttctctacaagcacggggagagatctgctgatgccttgaaggcaaatggcttctccaatgtgctattcaagtcatacaatagtcttgggcactacactgttccagaggagatggatgaagtttgcaaatggctcacagcaaatttggcgctcggcactaagtcatcttga

SEQ ID NO: 11408 - protein, 255 aa, Sorghum bicolor
  misc_feature: Ceres ANNOT ID no. 6012820
  misc_feature (19)..(248): Pfam Id: Abhydrolase_2 Pfam Desc: Phospholipase/Carboxylesterase
  misc_feature (1)..(255): NCBI GI: 29409364 NCBI Desc: biostress-resistance-related protein [triticum aestivum]
  misc_feature (2)..(238): NCBI GI: 115434820 NCBI Desc: os01g0175000 [oryza sativa (japonica cultivar-group)]
  misc_feature (6)..(250): NCBI GI: 92869052 NCBI Desc: phospholipase/carboxylesterase [medicago truncatula]
  misc_feature (3)..(250): NCBI GI: 89953382 NCBI Desc: fgenesh protein 43 [beta vulgaris]
  misc_feature (1)..(230): NCBI GI: 54290844 NCBI Desc: lysophospholipase 2-like [oryza sativa (japonica cultivar-group)]
MSFGGSSSVASGAKRPFEYGRTHVVRPKGTHKATIVWLHGLGDNGASWSQLLETLPLPNIKWICPTAPSRPVSVFGGFPSTAWFDVADLSEDAPDDIEGMDASAAHVANLLSTEPADIKLGVGGFSMGAATALYSATCFAHGKYGNGNPYPVNLSLAVGLSGWLPCARTLKNRIEASPEAAQKASSIPLLLCHGKADDVVLYKHGERSADALKANGFSNVLFKSYNSLGHYTVPEEMDEVCKWLTANLALGTKSS

SEQ ID NO: 11409 - DNA, 591 bp, Sorghum bicolor
  misc_feature: Ceres ANNOT ID no. 6012832
  misc_feature: Encodes the peptide sequence at SEQ ID NO 11410
atggcggcgcaggagcaggagcacgagaagcagcaggcgaagacaagcaccacgagctcgctcccctccagcagcgagcgctcctccagctccgcccccaacaacctcagggaaggaggtgcggagagcgacgaggagatacggcgggtgccggagatgggcggcgcgtcggcgtcggcctcgtcgggcgcgggcgcagacgagcgccccaaggaggacggcggcaagcagggcgggcagctggcggctgccgcgggggcgcagcctccggcggcggccgggaagaagcgcggccgcaccgcgggggacaaggagcagaaccggctgaagcgcctgctgcggaaccgcgtgtccgcgcagcaggcgcgggagcggaagaaggcgtacctgacggagctggaggccaaggccaaggacctggaggtccgcaatgccgagctcgagcagcgggtgtccacgctccagaacgagaacaacacgctccgccagattctgaagaacacgacggcgcacgcgagcaagaggagcagcggcggcggcggtggcaagggcggagacggcggcaagaagcaccacttcgccaagagctga

SEQ ID NO: 11410 - protein, 196 aa, Sorghum bicolor
  misc_feature: Ceres ANNOT ID no. 6012832
  misc_feature (103)..(166): Pfam Id: bZIP_1 Pfam Desc: bZIP transcription factor
  misc_feature (103)..(157): Pfam Id: bZIP_2 Pfam Desc: Basic region leucine zipper
  misc_feature (10)..(174): NCBI GI: 6018699 NCBI Desc: thy5 protein [lycopersicon esculentum]
  misc_feature (10)..(186): NCBI GI: 2251085 NCBI Desc: hy5 [arabidopsis thaliana]
  misc_feature (18)..(180): NCBI GI: 23496521 NCBI Desc: bzip with a ring-finger motif [lotus corniculatus var. japonicus]
  misc_feature (17)..(180): NCBI GI: 2934884 NCBI Desc: tgacg-motif binding factor [glycine max]
  misc_feature (13)..(180): NCBI GI: 2934885 NCBI Desc: tgacg-motif-binding factor [glycine max]
  misc_feature: The sequence is a functional homolog of SEQ ID NO 1362 in the 10/374,780US patent application
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 148 in the 10/412,699US patent application
  misc_feature: The sequence is a functional homolog of SEQ ID NO 1482 in the 10/412,699US patent application
  misc_feature: The sequence is a functional homolog of SEQ ID NO 1483 in the 10/412,699US patent application
  misc_feature: The sequence is a functional homolog of SEQ ID NO 1539 in the 10/412,699US patent application
  misc_feature: The sequence is a functional homolog of SEQ ID NO 1541 in the 10/412,699US patent application
  misc_feature: The sequence is a functional homolog of SEQ ID NO 20 in the 10/225,066US patent application
  misc_feature: The sequence is a functional homolog of SEQ ID NO 206 in the 10/225,066US patent application
  misc_feature: The sequence is a functional homolog of SEQ ID NO 2266 in the 10/374,780US patent application
  misc_feature: The sequence is a functional homolog of SEQ ID NO 2356 in the 10/374,780US patent application
  misc_feature: The sequence is a functional homolog of SEQ ID NO 2844 in the 10/374,780US patent application
  misc_feature: The sequence is a functional homolog of SEQ ID NO 341 in the 11/479,226US patent application
  misc_feature: The sequence is a functional homolog of SEQ ID NO 58 in the 11/375,241US patent application
  misc_feature: The sequence is a functional homolog of SEQ ID NO 827 in the 11/479,226US patent application
  misc_feature: The sequence is a functional homolog of SEQ ID NO 933 in the 10/374,780US patent application
  misc_feature: Useful for making plants with modulated growth and phenotype characteristics
  misc_feature: The sequence is a functional homolog of SEQ ID NO 148 in the 20040045049 US patent application
  misc_feature: The sequence is a functional homolog of SEQ ID NO 1482 in the 20040045049 US patent application
  misc_feature: The sequence is a functional homolog of SEQ ID NO 1483 in the 20040045049 US patent application
  misc_feature: The sequence is a functional homolog of SEQ ID NO 1539 in the 20040045049 US patent application
  misc_feature: The sequence is a functional homolog of SEQ ID NO 20 in the 20050160493 US patent application
  misc_feature: The sequence is a functional homolog of SEQ ID NO 206 in the 20050160493 US patent application
  misc_feature: The sequence is a functional homolog of SEQ ID NO 933 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MAAQEQEHEKQQAKTSTTSSLPSSSERSSSSAPNNLREGGAESDEEIRRVPEMGGASASASSGAGADERPKEDGGKQGGQLAAAAGAQPPAAAGKKRGRTAGDKEQNRLKRLLRNRVSAQQARERKKAYLTELEAKAKDLEVRNAELEQRVSTLQNENNTLRQILKNTTAHASKRSSGGGGGKGGDGGKKHHFAKS

SEQ ID NO: 11411 - DNA, 1617 bp, Sorghum bicolor
  misc_feature: Ceres ANNOT ID no. 6012871
  misc_feature: Encodes the peptide sequence at SEQ ID NO 11412
atgccttcggcggcattacaactcggcacggcggtggagggcagcttccaaggcggcggcgccatggtgccgtccgcgcgcctcctcacccccaacggcggcgcggtggccggctccacctccacgccgagtcgtcaggaggagacgacgaaggccaacggcggggggcctggctctggccctgacctcgccgcgctccggcccaccaaaaggccgcgcggaaaagcccaggccgggaagcccaggaagcgggcgccgatctggaacctgcaggccgccgtcttcgtctccgtcgtcctcaacgtcggtctcctcctccagcactacgtcaatagcacggctccgtcgcagcagcagcaccaccaccaccaggagcatctgcaggcctgcccgatgcatccagatgctgctggcgtcaaccgcaacagaaggggaagacaggaggaggagcagccgtccccgtccatgcccaaggccggggcgccgtcgacggggaagccggcggtgacgccggactcggtgatcaaccttgaccacggcgacccaaccatgttcgaggagttctggcgggggacggggtccgccgccgagatcgtcatcccggggtggcagaccatgagctacttctctgacgtcggcaacgtgtgctggttcctggagccgggcctggaccacgaggtgcggcggctgcaccggctggtcggcaacgccgccgtcgacgggtaccacgtcctcgtcggcaccggctccacgcagctcttcatggccgcgctgtacgcgctgtcgcctcccgcgggctccgccgccggcgccgcgcccatgagcgtcgtgtccacggcgccctactactcgtcctaccctgccgtcactgattttctccagtcgggtctcttccgctgggccggcgacgccaacacgttcaatggcgacacctacatcgagctggtgtgctcgccgaacaaccccgacggcgccatccgtgaagccgtcctgtcctcggactccggcatagccgtccatgacttggcctactactggccgcagtacacggccatcaccaaacgcgctgaccacgacatcatgctcttcaccgtgtccaagagcacaggccatgccgggacgaggatcgggtgggcgctggtgaaggaccgtgacgtcgcgaagaggatgaccaagtttatcgagctcaacacgatcggggtctccaaggactcgcagctgcgcgccgccaaggtgctcagggcggtctccgacgcctacgagctcccggaggcgaaagaggaccaccgcctgttcgactacggccgtcgcaagatggtggagcgctggaccatgctgcgtgaagcggccgccgcctcgggcatcttcagcctccccgaggagacctcgggcttctgcaacttcaccaaagaaattgcagtgactaaccccgcgttcgcgtggctgcgctgcgacagggaagacgtggaggactgcgcgagcttcctgcgcggccacaagatactgacgcggagcgggagccagttcggggcggacccgaggtacgtccgggtcagcatgctcgacagggacgacgcctacgacatcttcgtgaagcgcctctcctcgctgcaatga

SEQ ID NO: 11412 - protein, 538 aa, Sorghum bicolor
  misc_feature: Ceres ANNOT ID no. 6012871
  misc_feature (175)..(538): Pfam Id: Alliinase_C Pfam Desc: Allinase
  misc_feature (161)..(537): NCBI GI: 115462323 NCBI Desc: os05g0169300 [oryza sativa (japonica cultivar-group)]
  misc_feature (174)..(538): NCBI GI: 92874174 NCBI Desc: alliinase egf-like; allinase, c-terminal [medicago truncatula]
  misc_feature (172)..(538): NCBI GI: 9295708 NCBI Desc: f26f24.17 [arabidopsis thaliana]
  misc_feature (172)..(538): NCBI GI: 15220705 NCBI Desc: alliinase family protein [arabidopsis thaliana]
  misc_feature (335)..(538): NCBI GI: 115434754 NCBI Desc: os01g0169800 [oryza sativa (japonica cultivar-group)]
MPSAALQLGTAVEGSFQGGGAMVPSARLLTPNGGAVAGSTSTPSRQEETTKANGGGPGSGPDLAALRPTKRPRGKAQAGKPRKRAPIWNLQAAVFVSVVLNVGLLLQHYVNSTAPSQQQHHHHQEHLQACPMHPDAAGVNRNRRGRQEEEQPSPSMPKAGAPSTGKPAVTPDSVINLDHGDPTMFEEFWRGTGSAAEIVIPGWQTMSYFSDVGNVCWFLEPGLDHEVRRLHRLVGNAAVDGYHVLVGTGSTQLFMAALYALSPPAGSAAGAAPMSVVSTAPYYSSYPAVTDFLQSGLFRWAGDANTFNGDTYIELVCSPNNPDGAIREAVLSSDSGIAVHDLAYYWPQYTAITKRADHDIMLFTVSKSTGHAGTRIGWALVKDRDVAKRMTKFIELNTIGVSKDSQLRAAKVLRAVSDAYELPEAKEDHRLFDYGRRKMVERWTMLREAAAASGIFSLPEETSGFCNFTKEIAVTNPAFAWLRCDREDVEDCASFLRGHKILTRSGSQFGADPRYVRVSMLDRDDAYDIFVKRLSSLQ

SEQ ID NO: 11413 - DNA, 537 bp, Sorghum bicolor
  misc_feature: Ceres ANNOT ID no. 6012934
  misc_feature: Encodes the peptide sequence at SEQ ID NO 11414
atgggaggcttgttcttgccgcatcaccaaacctttccaaattctttgcaagctgccatcccgggatctctctctcttcacaaaggtgaccgcaaaaaccttaattacttgacagttggtgtgcacctcttctgttctccgcggcaaggctttccgcgctcattttggtcggccatcatgagatcagaagccaacggcaacggcgtggcgtcaccagacatggtcagcaagcatagcaaggaggagctcattgctttcttcagagacattcagacctccattgccgagagctcgcctaaagcttccaagaggacgaggaagcagccacctgatccgttaaaagaggtccacaggagggagcagtcacacgacagaggagacagcgatgtttcagaggaacgacagaggaaagtgatgaatctggaggacatgaacgtggccgacttgagagaattggcgagggcgagaaggatgaggggttactccaagctaaagaagggcgagctcattgatcggttgaaaggggttatgcaataa

SEQ ID NO: 11414 - protein, 178 aa, Sorghum bicolor
  misc_feature: Ceres ANNOT ID no. 6012934
  misc_feature (140)..(176): Pfam Id: Rho_N Pfam Desc: Rho termination factor, N-terminal domain
  misc_feature (128)..(176): NCBI GI: 90429783 NCBI Desc: rho termination factor, n-terminal [staphylococcus aureus subsp. aureus jh9]
  misc_feature (128)..(176): NCBI GI: 62636793 NCBI Desc: orf047 [bacteriophage 88]
  misc_feature (128)..(176): NCBI GI: 62636866 NCBI Desc: orf048 [bacteriophage 92]
  misc_feature (128)..(176): NCBI GI: 90583175 NCBI Desc: rho termination factor, n-terminal [staphylococcus aureus subsp. aureus jh1]
  misc_feature (128)..(176): NCBI GI: 62636938 NCBI Desc: orf047 [bacteriophage x2]
MGGLFLPHHQTFPNSLQAAIPGSLSLHKGDRKNLNYLTVGVHLFCSPRQGFPRSFWSAIMRSEANGNGVASPDMVSKHSKEELIAFFRDIQTSIAESSPKASKRTRKQPPDPLKEVHRREQSHDRGDSDVSEERQRKVMNLEDMNVADLRELARARRMRGYSKLKKGELIDRLKGVMQ

SEQ ID NO: 11415 - DNA, 1002 bp, Sorghum bicolor
  misc_feature: Ceres ANNOT ID no. 6013047
  misc_feature: Encodes the peptide sequence at SEQ ID NO 11416
atgtccggcatcaccaccaccgcaccgcacgtcgtcgtggaggacttgctcggcatcgtccagctcctcagcgacggttccgtcgtccgcgcagacgaatccgtggtcactccaccgggagcggcattccccgacgtcccgggcgttcactggagggacgtcgtgtacgaccctgcgcgccgcctcaaggtccgcctgtacaggacgtcgccggcggaggcgccggccgcggcgcccaaatccggcaggcggctcccggtgctcgtctacttccacggaggcggctattgcatcggtgcttacgaccaacccgggttccacgccttctgccgctaccgcctcgctcccgagcaccgcctccccgctgccatcgacgacgccgcgaccttcttcttctggctccgcgcgcaggctgcacctgcaccggccgccgccgccgccgctgccgacccgtggcttgccgaatcggccgacttctccaggacgttcgtgtccggcgtgtcggccggttccaaccttgctcaccacgtcgtggtccagatcgcctccgggcagatcgtgccgggcgcggtgcgcgtcgccggatacttcctcttctccccgttcttcggcagcgacgagcgcgtggcgtcggagtcccatcccccggccggcgtgtccgtgacggtgcagatgctcgacgtagcctggcgcatggcgcttccgttgggagccaccagagaccacccgctggcgaacccgttcggccccgacagcccgagcctgcagccgctgccgctgccgccggtgctcctcgaggcgcccgggcgcgacgtgctgtatgaccacgtgctgcgctacgccgccaggctcaaggagatggggaaggccgtggagctcgtcgagttcgccgaggagcgacatggcttctctgttggacagtggagcgaggcgacggaggagttgatgcatatcttgaagcagttcataaacggcggcgccgccgccgccgtgctcaaatga

SEQ ID NO: 11416 - protein, 333 aa, Sorghum bicolor
  misc_feature: Ceres ANNOT ID no. 6013047
  misc_feature (88)..(305): Pfam Id: Abhydrolase_3 Pfam Desc: alpha/beta hydrolase fold
  misc_feature (12)..(327): NCBI GI: 115470703 NCBI Desc: os07g0162700 [oryza sativa (japonica cultivar-group)]
  misc_feature (1)..(323): NCBI GI: 82697949 NCBI Desc: cxe carboxylesterase [malus pumila]
  misc_feature (1)..(323): NCBI GI: 82697963 NCBI Desc: cxe carboxylesterase [actinidia deliciosa]
  misc_feature (10)..(324): NCBI GI: 5487873 NCBI Desc: prmc3 [pinus radiata]
  misc_feature (5)..(313): NCBI GI: 82697961 NCBI Desc: cxe carboxylesterase [actinidia deliciosa]
MSGITTTAPHVVVEDLLGIVQLLSDGSVVRADESVVTPPGAAFPDVPGVHWRDVVYDPARRLKVRLYRTSPAEAPAAAPKSGRRLPVLVYFHGGGYCIGAYDQPGFHAFCRYRLAPEHRLPAAIDDAATFFFWLRAQAAPAPAAAAAAADPWLAESADFSRTFVSGVSAGSNLAHHVVVQIASGQIVPGAVRVAGYFLFSPFFGSDERVASESHPPAGVSVTVQMLDVAWRMALPLGATRDHPLANPFGPDSPSLQPLPLPPVLLEAPGRDVLYDHVLRYAARLKEMGKAVELVEFAEERHGFSVGQWSEATEELMHILKQFINGGAAAAVLK

SEQ ID NO: 11417 - DNA, 975 bp, Sorghum bicolor
  misc_feature: Ceres ANNOT ID no. 6013048
  misc_feature: Encodes the peptide sequence at SEQ ID NO 11418
atgtccagcgacgccacgccgcacgtcgtcgaggacttcttcggcgtcgtccggctcctcggcgacggctccgttgtccgtggcgacgaatccgtcctcatgccagcaggcccgttcccagacatccccggcgttgagtggaaggacgtcgcgtacgacacggcgcgcggcctcaaggtccgcgtgtatcggtcgtcgtcggtggctcgcgggaggctccccgtcctcgtctacttccacggcggcggctactgcatcggcgcctacgacaagcccatgttccactcctgctgccagcgcttcgccgccgagctccccgccgtggtgctctccgtccagtaccgcctcgcgcccgagcaccgcctgcccgccgccatcgacgacggcgcgacgttcttctcctggctgcgaaggcaggccgcggcgggcaccgagccgtggctcgaggagtcggccgacttcgcccagacgttcgtgtccggcgtgtcggccggcgcgaacctcgcccaccacgtcgtggttcacatcgcctcggggaagctcgcggtccacccagcgcgcatcgccggctacgtgctcctgtccgcgttcttcggaagcgccgagcgcacggcggcggagtccgagtcaccggccaacgtgtccctgacggccgcgttcgaccagatctggcgcttggtgctgccggcgggcgccaccagagatcacccgctggccaacccgttcgctcgggacagtcccggcatggagccgctgccgctgccaccggcgctcgtcgtggtgccggggctcgacacgctccgggaccacatgcggcgctacgcggcgaggttggaggagatgggaaaggctgtggagctggtcgagttcgcgggggagcgccatggcttctctgtaagagcgtggagtgaggcgaacgaggagttggtccggatcttgaagcggttcgtcaaccaaggtgccacacgggactga

SEQ ID NO: 11418 - protein, 324 aa, Sorghum bicolor
  misc_feature: Ceres ANNOT ID no. 6013048
  misc_feature (76)..(299): Pfam Id: Abhydrolase_3 Pfam Desc: alpha/beta hydrolase fold
  misc_feature (8)..(321): NCBI GI: 115470703 NCBI Desc: os07g0162700 [oryza sativa (japonica cultivar-group)]
  misc_feature (6)..(322): NCBI GI: 82697949 NCBI Desc: cxe carboxylesterase [malus pumila]
  misc_feature (7)..(317): NCBI GI: 82697963 NCBI Desc: cxe carboxylesterase [actinidia deliciosa]
  misc_feature (4)..(319): NCBI GI: 5487873 NCBI Desc: prmc3 [pinus radiata]
  misc_feature (9)..(307): NCBI GI: 82697961 NCBI Desc: cxe carboxylesterase [actinidia deliciosa]
MSSDATPHVVEDFFGVVRLLGDGSVVRGDESVLMPAGPFPDIPGVEWKDVAYDTARGLKVRVYRSSSVARGRLPVLVYFHGGGYCIGAYDKPMFHSCCQRFAAELPAVVLSVQYRLAPEHRLPAAIDDGATFFSWLRRQAAAGTEPWLEESADFAQTFVSGVSAGANLAHHVVVHIASGKLAVHPARIAGYVLLSAFFGSAERTAAESESPANVSLTAAFDQIWRLVLPAGATRDHPLANPFARDSPGMEPLPLPPALVVVPGLDTLRDHMRRYAARLEEMGKAVELVEFAGERHGFSVRAWSEANEELVRILKRFVNQGATRD

SEQ ID NO: 11419 - DNA, 1224 bp, Sorghum bicolor
  misc_feature: Ceres ANNOT ID no. 6013057
  misc_feature: Encodes the peptide sequence at SEQ ID NO 11420
atggcggatctacgtattagctgtacagcctttgaatcctggatccgtcacctggcgaggggttccaagaagaacggaagcacacgggacgtggtggccgacctccccgacgacatcctcgtcgacattctctcgcgcttgcccataaaatcgctctgccgctgcaaattggtttctacgcgctggcgcaacctcatctcccatcctgaacacagcaagaagctggcccagactcttgctggcttcttctacgagagctactccaaaaaccgcttcccaaagttggctcgccatttcaccaacgtctcaagagcaatcgaccctttcatcgacccctcactgtcgttcctgcctgaatataagagcattgacatcaaggacagctgcaacggactcctcctgtgccactgctggaagcacactgatcccgcgacaatggattctgtcgtgtgcaatcccgccactgagaaatgggtggtcgttccagactctggctggtctagcatggtgaggatcactcgcttggggttcgacccagctgtctcctcccacttccatgtgtttgagttcgtatcaaacgatatttggtatatggatgatggtcataatttcgatggagcaatcgtagcagtagccgtctactcctccaaaagtggagtttggagtctcaatatcaacaaccatctaccgattccgcttggtgaatttgcgatgccccaggattcaaaaggtgtctttttcaatgggattttgcatctgactactttttatggcatggtattagccattgacgtggaggggaaagttttgagaggcatcccttttcctatatcaacacactatgaatatgatgattctcggcctgttcatgtttatctatctcagggacacttgtatcttacaactatatctgatggttatcaaccatcaatctgggttcttgaggactacaatggtgaaaattggactttgaagcacaatgtcaaccttttgcatctgtttggagcagctaattgttcgaaggttgcggataatttcagtattatctcaatccacccagagcatgatatgatttttttggtttgccaaacaaactccatactattgtcatatgaaatggatcacatgaggctgcgttttataagtcatcttggcaggcattacacgagtgatcatattccatatgttcccttgttctcggagtcattggcagatgagcaataa

SEQ ID NO: 11420 - protein, 407 aa, Sorghum bicolor
  misc_feature: Ceres ANNOT ID no. 6013057
  misc_feature (30)..(77): Pfam Id: F-box Pfam Desc: F-box domain
  misc_feature (35)..(405): NCBI GI: 115462391 NCBI Desc: os05g0177100 [oryza sativa (japonica cultivar-group)]
  misc_feature (60)..(403): NCBI GI: 50508392 NCBI Desc: receptor-like kinase-like [oryza sativa (japonica cultivar-group)]
  misc_feature (18)..(326): NCBI GI: 115462393 NCBI Desc: os05g0177400 [oryza sativa (japonica cultivar-group)]
  misc_feature (35)..(326): NCBI GI: 115462373 NCBI Desc: os05g0175800 [oryza sativa (japonica cultivar-group)]
  misc_feature (30)..(191): NCBI GI: 117670145 NCBI Desc: f-box-like protein [hordeum vulgare]
  misc_feature: The sequence is a functional homolog of SEQ ID NO. 456 in the 11/188,298 US application
MADLRISCTAFESWIRHLARGSKKNGSTRDVVADLPDDILVDILSRLPIKSLCRCKLVSTRWRNLISHPEHSKKLAQTLAGFFYESYSKNRFPKLARHFTNVSRAIDPFIDPSLSFLPEYKSIDIKDSCNGLLLCHCWKHTDPATMDSVVCNPATEKWVVVPDSGWSSMVRITRLGFDPAVSSHFHVFEFVSNDIWYMDDGHNFDGAIVAVAVYSSKSGVWSLNINNHLPIPLGEFAMPQDSKGVFFNGILHLTTFYGMVLAIDVEGKVLRGIPFPISTHYEYDDSRPVHVYLSQGHLYLTTISDGYQPSIWVLEDYNGENWTLKHNVNLLHLFGAANCSKVADNFSIISIHPEHDMIFLVCQTNSILLSYEMDHMRLRFISHLGRHYTSDHIPYVPLFSESLADEQ

SEQ ID NO: 11421 - DNA, 1503 bp, Sorghum bicolor
  misc_feature: Ceres ANNOT ID no. 6013382
  misc_feature: Encodes the peptide sequence at SEQ ID NO 11422
atgggagcccggccagctgcccagggtggccgggccttggctccgccggtggtgcaggtggtggatttgtcttccgactccgagggcgaggtgtcggcgcactcgccagatcacaagcgcccctcttggcagccggctccagactccaatcgcgggggtggcgacactggttccagcgccatggacatcctcttcgagcaagcggctgcgggcgcggcgtggggtgacgcgctgaagaaagggaaggataaggtcgtggagggggagagcgcgaggcctccaaagcacagtggagaattgctcggtgctgctggccgcgtcctgggagctgggagtgatccgtggagcgcagtggtgagcaagtgcaaggctggggacggtgggaataatggagctgggtgttggggtacttggggtgaccggggtggccgccttgctaactcggcccccatgccgcgtctagggtcagagaggaaggggtttcatgagacatatgcactgcgagggatgcctcagcttcacagtgattctgcagcatccagtgacaagtggaagggtattcttggtgcaagccctgctgatcatgccaactcactgtggagctcctgtgatactgacatggaagataatgtggatgaaaccttctcccagaggtctgcgtctgctcgtgaaatttctaactgtgatgattttcttatggaagatagtagctcgtcatggctatcgaagatcaaagggctgcacttcccacttcctgacgagcatcagttgagaaccaggcagattgaggatgatgaggcgtttgcccgcagacttcaagagcagctcaatcaggaacagccaggctctcagcattctgaagcggttgatgcaacaatagcctggacattacatgagcaagatgctgagcatgccagatttgctgcaagagaaggccagtctagttctagccagagggacagatcaatggcacatctatattcttatggacgtcactcacctgttcaaagttttgctgcttgggcatccaatcttcctccaattccaatgccaagctttagaggtttgcaaaggaactccaactgccctcaagcggagcaacgcaatatgcttatctctcagttaaccaagggatgcttcggagaagacatggatctagaaatgagaatggctgtactggactcgctttctgaagcatttaggaactgcgaggacacactttctccagattctgatgttgattatgaggacagcatagcatttgatgtggagatccagtacagaggtgcttctgatgatcaaataaacagcctgccgctatcactagttgagggcggaaattgttcggatgaaccctgtaacatatgcttggattgccctgctgctggtgattccatccggcatttgccatgcttgcacaagtttcacaaaaagtgcattgacaggtggcttgggatgaggacatgttgcccgatttgcaagtcaaatgtattctcccagtag

SEQ ID NO: 11422 - protein, 500 aa, Sorghum bicolor
  misc_feature: Ceres ANNOT ID no. 6013382
  misc_feature (453)..(493): Pfam Id: zf-C3HC4 Pfam Desc: Zinc finger, C3HC4 type (RING finger)
  misc_feature (407)..(497): NCBI GI: 38345315 NCBI Desc: osjnba0004n05.9 [oryza sativa (japonica cultivar-group)]
  misc_feature (407)..(497): NCBI GI: 116311076 NCBI Desc: osigba0157k09-h0214g12.17 [oryza sativa (indica cultivar-group)]
  misc_feature (444)..(497): NCBI GI: 115439113 NCBI Desc: os01g0673900 [oryza sativa (japonica cultivar-group)]
  misc_feature (233)..(477): NCBI GI: 7211986 NCBI Desc: contains similarity to the regulatory protein (g1) gbm97204 goliath from d. melanogaster. est gbt76547 comes from this gene. [arabidopsis thaliana]
  misc_feature (444)..(494): NCBI GI: 140045962 NCBI Desc: zinc finger, ring-type [medicago truncatula]
  misc_feature: The sequence is a functional homolog of SEQ ID NO. 329 in the 11/188,298 US application
  misc_feature: The sequence is a functional homolog of SEQ ID NO. 271 in the 11/188,298 US application
MGARPAAQGGRALAPPVVQVVDLSSDSEGEVSAHSPDHKRPSWQPAPDSNRGGGDTGSSAMDILFEQAAAGAAWGDALKKGKDKVVEGESARPPKHSGELLGAAGRVLGAGSDPWSAVVSKCKAGDGGNNGAGCWGTWGDRGGRLANSAPMPRLGSERKGFHETYALRGMPQLHSDSAASSDKWKGILGASPADHANSLWSSCDTDMEDNVDETFSQRSASAREISNCDDFLMEDSSSSWLSKIKGLHFPLPDEHQLRTRQIEDDEAFARRLQEQLNQEQPGSQHSEAVDATIAWTLHEQDAEHARFAAREGQSSSSQRDRSMAHLYSYGRHSPVQSFAAWASNLPPIPMPSFRGLQRNSNCPQAEQRNMLISQLTKGCFGEDMDLEMRMAVLDSLSEAFRNCEDTLSPDSDVDYEDSIAFDVEIQYRGASDDQINSLPLSLVEGGNCSDEPCNICLDCPAAGDSIRHLPCLHKFHKKCIDRWLGMRTCCPICKSNVFSQ

SEQ ID NO: 11423 - DNA, 1443 bp, Sorghum bicolor
  misc_feature: Ceres ANNOT ID no. 6013479
  misc_feature: Encodes the peptide sequence at SEQ ID NO 11424
atgaaatttcttgtcagaacactggttcgtaacttgcgtattggggctatgatgaagacgatattacctgcgcttgcacatgctgttgtttttgatagaaactgtgcagcagatcctgttgtgtccttggaaggcataaaatcacaactacagagtctttcaactgaagttgccgaggcatacaatgtcattcctaatctagatctgctcattccttctcttttgagagaaggcactgcattttcagcttcatccttggcaatggtgcctggcacacctattccacctatgcttgctagaattactaatgggttgactcagtcgctgaaagctttccatggcagatcatttacttgtgagtacaagtatgatggtcagcgagcccagattcacaaactacctgatggatctgtgcgaatattttcaaggcaaatgaaagaatcaacttccagatttcctgatcttgtgaacatgattaaggagctgtgcaagcctgaagtgtccagctttatactggatgctgaggtggtgggaattgacaggaagaaaggaaacaagttgatgtcgttccaagagctatcttcaagagaaagagggaacaagcattcctcaatttcaatagagaacataaaggttgacatttgtgtgtttgtttttgacatcatgttccacggtggagagaggctactggattgccctcttcggcaaagaagaaagtacattcatgacttgttccaggaaaagccaggatattttgagttagctcagcaactaactgtagaagcctgtgaagcttcaccagacaattctagcactttggctaggatgaacacatttttcaaaaatgcatgccagtcttcttgtgagggtataatgttaaagactttggatgtcgatgctggatactctgcttccaaacgctgtgattcatggttaaaggtcaagcgtgactatgtggaaggcttaggtgatagccttgacttagttccaattggtgcatggtatggaaatggacgtaaagctgggtggtacagcccttttctcatggcatgctacaaccctgaaactgaagagttccaaagtgtatgccgtgttatgtctggtttctcagatgatttttataaagagatgaaggagttttattccggggaaaggatactgcccaagaagcctgtttactacaaaacagatgagcaaccagagctgtggttcaccgcagaacaaatttgggagatccgaggtgcagacctgacgttgtcccctgttcaccatgcggccattgggcttgtccatccatcgcgcggcatctcggtgaggatgcccaggtacatccgttcagttccagaccggagcccagaggattgcggcactgccaccgatattgctagcatgttcaaagctcagacccggaagatggatgtcagcagcgagggccaggagtag

SEQ ID NO: 11424 - protein, 480 aa, Sorghum bicolor
  misc_feature: Ceres ANNOT ID no. 6013479
  misc_feature (96)..(315): Pfam Id: DNA_ligase_A_M Pfam Desc: ATP dependent DNA ligase domain
  misc_feature (340)..(404): Pfam Id: DNA_ligase_A_C Pfam Desc: ATP dependent DNA ligase C terminal region
  misc_feature (68)..(235): NCBI GI: 140055044 NCBI Desc: atp-dependent dna ligase [medicago truncatula]
  misc_feature (229)..(480): NCBI GI: 115439237 NCBI Desc: os01g0685500 [oryza sativa (japonica cultivar-group)]
  misc_feature (3)..(468): NCBI GI: 1359495 NCBI Desc: dna ligase [arabidopsis thaliana]
  misc_feature (2)..(469): NCBI GI: 30962491 NCBI Desc: dna ligase i [coprinopsis cinerea]
  misc_feature (1)..(468): NCBI GI: 19112137 NCBI Desc: dna ligase [schizosaccharomyces pombe]
MKFLVRTLVRNLRIGAMMKTILPALAHAVVFDRNCAADPVVSLEGIKSQLQSLSTEVAEAYNVIPNLDLLIPSLLREGTAFSASSLAMVPGTPIPPMLARITNGLTQSLKAFHGRSFTCEYKYDGQRAQIHKLPDGSVRIFSRQMKESTSRFPDLVNMIKELCKPEVSSFILDAEVVGIDRKKGNKLMSFQELSSRERGNKHSSISIENIKVDICVFVFDIMFHGGERLLDCPLRQRRKYIHDLFQEKPGYFELAQQLTVEACEASPDNSSTLARMNTFFKNACQSSCEGIMLKTLDVDAGYSASKRCDSWLKVKRDYVEGLGDSLDLVPIGAWYGNGRKAGWYSPFLMACYNPETEEFQSVCRVMSGFSDDFYKEMKEFYSGERILPKKPVYYKTDEQPELWFTAEQIWEIRGADLTLSPVHHAAIGLVHPSRGISVRMPRYIRSVPDRSPEDCGTATDIASMFKAQTRKMDVSSEGQE

SEQ ID NO: 11425 - DNA, 1113 bp, Sorghum bicolor
  misc_feature: Ceres ANNOT ID no. 6013511
  misc_feature: Encodes the peptide sequence at SEQ ID NO 11426
atgggcggcgtgacgtccaacatcgccgcgcgcttcgccttcttcccgcccacgccgccgtcctacaccgtcgtggtcgcggacgccgccaccggccgcctcgccatcccggagatctcccggggcccctcgcgccgccggaggcgggacggcgccgggggctcctcctcctcctcggcctcctccgtcgcggcggccggtgccgaggaggaggacggcgcggaggtggtgcgcctccggacccgccgcgggaacgagatcgtgggggtgtacgtgcgccacgcgcgggcctcagccacgatgctctactcccacggcaacgccgccgacctcggccagatgtacgggctcttcgtcgagctcagccgccgcctccgcgtcaacctcttcgggtatgattattctggttatgggagatctacagggaagcccactgagtgtaatacatatgcagacattgaagcagcatataactgtctcaaggaaaaatatggtgtcgcagatgaggatataatcttatatggtcagtctgttggaagtggtccaaccattgatcttgcttcgcgattgccagacttgcgagccgtggttttgcatagtcctattttatctggactaagagtactatatccagtcaaacggacgttttggtttgacatttacaagaacatcgataaaattggcttggtaaattgtccggtgcttgtcattcatggtacatcagatgatgtcgttgactgctcccacggaaaacagctatgggagcattgcaaagtaaaatattctccactgtggttgagtggtggtggccactgcaatctcgagctatatccagattacattaagcacttgaagaagtttgtgtcaagcgttagcaaaaagacatcaaaacctgaaccaaaagagataacagcaaaggatggcactaccagtaaagaaacaaaggaagcatactcggagaaacctcaagaggctactaagtgctcacagatctcacggaagagcctagatagccgagttgggaaatccaaaacagtggatgttcctgataaaccacggatgagctcagatgacattgacaagttccggaggagaagatgcttggtttggtga

SEQ ID NO: 11426 - protein, 370 aa, Sorghum bicolor
  misc_feature: Ceres ANNOT ID no. 6013511
  misc_feature (1)..(370): NCBI GI: 56784467 NCBI Desc: cgi67 serine protease-like [oryza sativa (japonica cultivar-group)]
  misc_feature (1)..(370): NCBI GI: 115439289 NCBI Desc: os01g0689800 [oryza sativa (japonica cultivar-group)]
  misc_feature (72)..(356): NCBI GI: 124359459 NCBI Desc: esterase/lipase/thioesterase [medicago truncatula]
  misc_feature (1)..(364): NCBI GI: 51535771 NCBI Desc: cgi67 serine protease-like [oryza sativa (japonica cultivar-group)]
  misc_feature (81)..(315): NCBI GI: 140067578 NCBI Desc: c2; esterase/lipase/thioesterase [medicago truncatula]
MGGVTSNIAARFAFFPPTPPSYTVVVADAATGRLAIPEISRGPSRRRRRDGAGGSSSSSASSVAAAGAEEEDGAEVVRLRTRRGNEIVGVYVRHARASATMLYSHGNAADLGQMYGLFVELSRRLRVNLFGYDYSGYGRSTGKPTECNTYADIEAAYNCLKEKYGVADEDIILYGQSVGSGPTIDLASRLPDLRAVVLHSPILSGLRVLYPVKRTFWFDIYKNIDKIGLVNCPVLVIHGTSDDVVDCSHGKQLWEHCKVKYSPLWLSGGGHCNLELYPDYIKHLKKFVSSVSKKTSKPEPKEITAKDGTTSKETKEAYSEKPQEATKCSQISRKSLDSRVGKSKTVDVPDKPRMSSDDIDKFRRRRCLVW

SEQ ID NO: 11427 - DNA, 552 bp, Sorghum bicolor
  misc_feature: Ceres ANNOT ID no. 6013649
  misc_feature: Encodes the peptide sequence at SEQ ID NO 11428
atggacgaggcaacgaagaagaaggtggaggctgcggtgctggagatcctccggggctccgatatggagtccgtaacggagtataaggtacgcaaagccgccgccgaccgcctcggcatcgacctctccacccccgaccgcaagctcttcgtccgcggcgtcgttgaggaatacctgcgctcactctcctcccaggaggaggcggaggcggaggaggagcagggcggcgctggcagggagagcaaggacaaggaacaagaggaggaggaagaggaggaagatgatgaggaggaggaaggtaagggcggcgggaagagggagtacgacgaccaaggagaccttatcctgtgccgcctgtcgaacaagaggagggtgactctgtcggagttcaaaggcaggtcactggtgtccatccgcgagttttacgtgaaggatggcaaggagatgccctccgccaaaggtattagtatgacgatggagcagtgggaagcattttgcaatgctgtacctgcaatagaggatgccataaaaaagtttgaagattcagactga

SEQ ID NO: 11428 - protein, 183 aa, Sorghum bicolor
  misc_feature: Ceres ANNOT ID no. 6013649
  misc_feature (85)..(176): Pfam Id: PC4 Pfam Desc: Transcriptional Coactivator p15 (PC4)
  misc_feature (5)..(60): Pfam Id: DEK_C Pfam Desc: DEK C terminal domain
  misc_feature (1)..(183): NCBI GI: 19571089 NCBI Desc: p0692c11.10 [oryza sativa (japonica cultivar-group)]
  misc_feature (1)..(180): NCBI GI: 16610191 NCBI Desc: pbf68 protein [nicotiana tabacum]
  misc_feature (82)..(179): NCBI GI: 116117051 NCBI Desc: ensangp00000015817 [anopheles gambiae str. pest]
  misc_feature (100)..(178): NCBI GI: 50725768 NCBI Desc: transcriptional coactivator p15 (pc4) family protein-like [oryza sativa (japonica cultivar-group)]
  misc_feature (56)..(178): NCBI GI: 46250135 NCBI Desc: mgc81442 protein [xenopus laevis]
  misc_feature: Useful for making plants with altered Lignin content
  misc_feature: Functional homolog of the protein sequence given in SEQ ID NO 12875
MDEATKKKVEAAVLEILRGSDMESVTEYKVRKAAADRLGIDLSTPDRKLFVRGVVEEYLRSLSSQEEAEAEEEQGGAGRESKDKEQEEEEEEEDDEEEEGKGGGKREYDDQGDLILCRLSNKRRVTLSEFKGRSLVSIREFYVKDGKEMPSAKGISMTMEQWEAFCNAVPAIEDAIKKFEDSD

SEQ ID NO: 11429 - DNA, 813 bp, Sorghum bicolor
  misc_feature: Ceres ANNOT ID no. 6013740
  misc_feature: Encodes the peptide sequence at SEQ ID NO 11430
atggaggacattcgtcggctgcccgaggacgtcctcacgtcggtgatgtcccgcgccgctacgggaccacgggctgcatgcgtcgccgccacggtgtccccggcctttcgctccgcggctgactccgacaccgtctggtcgcgtttcctcccggccgacctcccgccgctcgtctacccgtcgtcgtcgccgccgccacgctccaagaaggagctcttcctccgcctctccgggaaccatgtcctcctcgaggatggcctcacgagcgcgtggctgcatagggagaccggcgccaagtgctacatggttgcggcgagggctatgcacattgtatggggcgacgcaccgcaatactggcgttggatcccgcgccaagactccaggttcccagaatgcgctgaactgttggcggtttgttggctggacttcagcggcgccatagaaagcaggatgctatccgaaaacacgcgctatgccgcctacctagtgttcaagatggacgatgattgctacggcctagattctccactgcaggttgcgtcaatccacattggagaagacgagatatcatcccacccagtccgcctgcagaacaacataggcaaccaacagaacgacggcgccgaggaaggagctactcctcggcttcccatggagaggcccgatgggtggatggagctggagataggtgagtgggacaaccacggaggggaagacaaacatttttgcgccagagtgagagagaccacgtatggaggcaactggaagaaaggccttattttgcagggtgtcgagataagacctaagaactaa

SEQ ID NO: 11430 - protein, 270 aa, Sorghum bicolor
  misc_feature: Ceres ANNOT ID no. 6013740
  misc_feature (3)..(269): NCBI GI: 47848533 NCBI Desc: f-box family protein-like [oryza sativa (japonica cultivar-group)]
  misc_feature (3)..(251): NCBI GI: 115449503 NCBI Desc: os02g0813100 [oryza sativa (japonica cultivar-group)]
  misc_feature (7)..(268): NCBI GI: 42570651 NCBI Desc: f-box family protein / skp1 interacting partner 3-related [arabidopsis thaliana]
  misc_feature (3)..(193): NCBI GI: 47848218 NCBI Desc: phloem-specific lectin-like [oryza sativa (japonica cultivar-group)]
  misc_feature (3)..(128): NCBI GI: 47848537 NCBI Desc: f-box family protein-like [oryza sativa (japonica cultivar-group)]
MEDIRRLPEDVLTSVMSRAATGPRAACVAATVSPAFRSAADSDTVWSRFLPADLPPLVYPSSSPPPRSKKELFLRLSGNHVLLEDGLTSAWLHRETGAKCYMVAARAMHIVWGDAPQYWRWIPRQDSRFPECAELLAVCWLDFSGAIESRMLSENTRYAAYLVFKMDDDCYGLDSPLQVASIHIGEDEISSHPVRLQNNIGNQQNDGAEEGATPRLPMERPDGWMELEIGEWDNHGGEDKHFCARVRETTYGGNWKKGLILQGVEIRPKN

SEQ ID NO: 11431 - DNA, 819 bp, Sorghum bicolor
  misc_feature: Ceres ANNOT ID no. 6013807
  misc_feature: Encodes the peptide sequence at SEQ ID NO 11432
atgctcgccgccgccgccacggcggtggccatccctccggcggcttctcattgttttccagcaaatacggccaggaaatggaggatttcctggagatgtcgggcggcaagagtcgaggctgggtactcccaattggaggtgagaaaagtcacctatcgacctcctggaactgaacagaacttattgaaggaaattaacctctctcttcgggagaaaagttttggtttgatatttggacggagtgggagtggaaagaccacccttttgcagcttttggctggtctatcagaacctacctctgggtctgtttgcattcagaagtatgatgatactgggaatcctattggcttgcccgaactgctaacttctcaacgagttggaattgtatttcagtttcctgagaggtatttcttagcagatactgtacttgaagaagttacttttggatggccgaggcaaaaggcagacctccgattaaaagaacagctcgctttaaatcttcaaaatgcctttaactcggttggtctgacaaccatctcattagatgaagatccacaagctctaagtggtggatttaagaggcgacttgctttagcaattcaactggttcaaactcctgatttgttgctgcttgatgagcctcttgctggtctagattggaaggctcgggctgatgttgtgaatctcttaaaggacctgaagaaagaacatacgatactggttgtaagtcacgatctaagggaactatatccactagttgattactcatggcgaatggaaatggggggaagtttgaaggaggaaggtttgcctgtgtaa

SEQ ID NO: 11432 - protein, 272 aa, Sorghum bicolor
  misc_feature: Ceres ANNOT ID no. 6013807
  misc_feature (72)..(262): Pfam Id: ABC_tran Pfam Desc: ABC transporter
  misc_feature (135)..(272): NCBI GI: 115485567 NCBI Desc: os11g0490800 [oryza sativa (japonica cultivar-group)]
  misc_feature (28)..(265): NCBI GI: 145344048 NCBI Desc: abc(atp-binding) family transporter: cobalt ion [ostreococcus lucimarinus cce9901]
  misc_feature (45)..(262): NCBI GI: 119486503 NCBI Desc: abc transporter-like protein [lyngbya sp. pcc 8106]
  misc_feature (45)..(262): NCBI GI: 119513127 NCBI Desc: abc transporter-like protein [nodularia spumigena ccy9414]
  misc_feature (45)..(266): NCBI GI: 86609353 NCBI Desc: abc transporter, atp-binding protein [cyanobacteria bacterium yellowstone b-prime]
MLAAAATAVAIPPAASHCFPANTARKWRISWRCRAARVEAGYSQLEVRKVTYRPPGTEQNLLKEINLSLREKSFGLIFGRSGSGKTTLLQLLAGLSEPTSGSVCIQKYDDTGNPIGLPELLTSQRVGIVFQFPERYFLADTVLEEVTFGWPRQKADLRLKEQLALNLQNAFNSVGLTTISLDEDPQALSGGFKRRLALAIQLVQTPDLLLLDEPLAGLDWKARADVVNLLKDLKKEHTILVVSHDLRELYPLVDYSWRMEMGGSLKEEGLPV

SEQ ID NO: 11433 - DNA, 1089 bp, Sorghum bicolor
  misc_feature: Ceres ANNOT ID no. 6013932
  misc_feature: Encodes the peptide sequence at SEQ ID NO 11434
atgtatggtgcgtctgaccccacagctgcggagcgcacggcgttccggtgtgctgagaagcagtacaagctttacaagccactcaacctcaagggcaggtccaggtccaggagcaagctgtctggtggagaaggaggtggcgctgatctgtcagcggtagttgacttccacgtgctgcttgctgctgatggggagcttcccgcggggattggtcggcatgactgtgtggggtttgaccgccccgtgttctgcttcttggacaggccagggttctatttcattcctggtgctttatcaactgaggaacaatgctgttggatcagggaaagcttgaaaacatttccacagccacctaataggactaatttgactgcaatatatggttcaatttctgacttactcatcgctgctaaaaataaaaaggtattggttgaagcagaaaatcctgatatccaagaaagaaatgaacagaataattgtggagggaaaacgaaatccaaatacttcaaatttgtggactcagagagccagaaaggggaagagcataggtcaactgcagccactacccttatgaggaagctccggtggagcacccttggtctacaatttgattggtcaaagcggaactatgatgtatcacttccacacaacaagattccagatgctctagctggtcttgccaaaaagatggctattccagctatgccttctggagaagaattcaagccagaagctgctatagtgaactattatggtccaagtgatatgcttggtggccatgttgatgacatggaagcagattggacaaaacctattgtaagcataagtttgggctgcaaatgcatctttcttctgggaggaaagacaagagatgaagttccaacagcaatgttcctgcgcagcggtgatatagttttgatggctggggaagcacgagaacgcttccatggtgtacctcggatcttcgcagagagtgaccaacaagaaatctctgcactgatttcacaactatctagtggagatgacgactttattttggactatatcaagaattctaggataaatatcaacatcagacaggtctactga

SEQ ID NO: 11434 - protein, 362 aa, Sorghum bicolor
  misc_feature: Ceres ANNOT ID no. 6013932
  misc_feature (2)..(317): NCBI GI: 115485553 NCBI Desc: os11g0488500 [oryza sativa (japonica cultivar-group)]
  misc_feature (49)..(362): NCBI GI: 15221095 NCBI Desc: oxidoreductase, 2og-fe(ii) oxygenase family protein [arabidopsis thaliana]
  misc_feature (49)..(362): NCBI GI: 4835778 NCBI Desc: f25c20.6 [arabidopsis thaliana]
  misc_feature (189)..(361): NCBI GI: 19343600 NCBI Desc: alkbh protein [homo sapiens]
  misc_feature (189)..(361): NCBI GI: 60810576 NCBI Desc: alkb, alkylation repair-like [synthetic construct]
MYGASDPTAAERTAFRCAEKQYKLYKPLNLKGRSRSRSKLSGGEGGGADLSAVVDFHVLLAADGELPAGIGRHDCVGFDRPVFCFLDRPGFYFIPGALSTEEQCCWIRESLKTFPQPPNRTNLTAIYGSISDLLIAAKNKKVLVEAENPDIQERNEQNNCGGKTKSKYFKFVDSESQKGEEHRSTAATTLMRKLRWSTLGLQFDWSKRNYDVSLPHNKIPDALAGLAKKMAIPAMPSGEEFKPEAAIVNYYGPSDMLGGHVDDMEADWTKPIVSISLGCKCIFLLGGKTRDEVPTAMFLRSGDIVLMAGEARERFHGVPRIFAESDQQEISALISQLSSGDDDFILDYIKNSRININIRQVY

SEQ ID NO: 11435 - DNA, 948 bp, Sorghum bicolor
  misc_feature: Ceres ANNOT ID no. 6014433
  misc_feature: Encodes the peptide sequence at SEQ ID NO 11436
atgggcaactcttgcttcactggtgcctctcctgcactgctgggaaagacccatgatccagctttcaaatggaagttctatggcttctcagctctacttgataggggggctgtatcagccaattctgccatttttcgctgttgtggatatggttggttcctgcaagtgagcccaatgcagaaaaaaactggtcacaagattccacatattgctctttcgctctcggtgtaccaaaacagcttaaaggcagatgacatcttgagcgctgtgttcgagttgtcaatgtacaaccattcaaaagggacatatcatggatgcaaagctagctaccactttgatatcaagaacacgcgatcagagaaacaatgcttgattcctcttgaagaactactgaaatcatctgattttctggttgatgatagctgtgtctttggtgtgaggatattaaaggcacatgtctcttctcagaataagcctattgtgattcaaaagaagcctagcacagttcagaacatcttcctccagaaaaaggggttcatcaaaggaacctacacctggaccatgaacaacttccctgacattgtcccagtccgttctcctgcatttgaagctggtgggcataaatggtacatcaacatgtacccacttggtgaccaatgcagcaccaattcactttccctctacttacacctgcatgatctgaacaagatccctcttgagactggaatggtgattgaactgactctctccatcttggaccagaagcatgacagacactacacagttacaggtcgctttgtttttggagttgcagcaaagaatggctggggatggcccaacttcattcctctcaagacactcatggatccatttagctgctatattgtgggagcaaactgtatgctgaaggcagatgtcaccatcatcgggtcatccaatgacggttag

SEQ ID NO: 11436 - protein, 315 aa, Sorghum bicolor
  misc_feature: Ceres ANNOT ID no. 6014433
  misc_feature (191)..(308): Pfam Id: MATH Pfam Desc: MATH domain
  misc_feature (65)..(313): NCBI GI: 110289266 NCBI Desc: math domain containing protein [oryza sativa (japonica cultivar-group)]
  misc_feature (25)..(216): NCBI GI: 115482540 NCBI Desc: os10g0478500 [oryza sativa (japonica cultivar-group)]
  misc_feature (25)..(310): NCBI GI: 18401489 NCBI Desc: meprin and traf homology domain-containing protein / math domain-containing protein [arabidopsis thaliana]
  misc_feature (146)..(308): NCBI GI: 115470711 NCBI Desc: os07g0163800 [oryza sativa (japonica cultivar-group)]
  misc_feature (167)..(308): NCBI GI: 18415260 NCBI Desc: ubiquitin-specific protease 12 (ubp12) [arabidopsis thaliana]
MGNSCFTGASPALLGKTHDPAFKWKFYGFSALLDRGAVSANSAIFRCCGYGWFLQVSPMQKKTGHKIPHIALSLSVYQNSLKADDILSAVFELSMYNHSKGTYHGCKASYHFDIKNTRSEKQCLIPLEELLKSSDFLVDDSCVFGVRILKAHVSSQNKPIVIQKKPSTVQNIFLQKKGFIKGTYTWTMNNFPDIVPVRSPAFEAGGHKWYINMYPLGDQCSTNSLSLYLHLHDLNKIPLETGMVIELTLSILDQKHDRHYTVTGRFVFGVAAKNGWGWPNFIPLKTLMDPFSCYIVGANCMLKADVTIIGSSNDG

SEQ ID NO: 11437 - DNA, 1623 bp, Sorghum bicolor
  misc_feature: Ceres ANNOT ID no. 6014477
  misc_feature: Encodes the peptide sequence at SEQ ID NO 11438
atgtacaagaaccagctgcaggagctggcgcagcggagctgcttcaacctgccggcttacacgtgcctgcgggaggggcccgaccatgcgccgcggttcaaggcggcggtgaacttcaacggggagcagttcgagagtcccgggttcttcaccacgctccgccaggcagagcacgccgccgcggaggttgccctcgccgcgctcgcgcgacgcggcccgtcctactcgctcgccgcccgcatcctggacgaaacaggggtttataaaaaccttctgcaggaagtagctcaaagagttggggcgccattaccattgtatacaacagagcgatctggccttggccacctaccggttttcacatgcacagtagagctagctggtattacatttacaggtgatcctgctaagaataagaaacaggctgaaaaaaatgctgcttcagctgcatggtcagcactgaaacaattggtacgcgaggaagtgaattcatccaatgagccagaaaacaatgatgagcaggagcagatcaggattgcccgagccctcctcaattatcgcttgaaggagaagatggcgatggccaattatcctcatgtttcaccattccctaagaaatttcccatgcagccagagaggaagccttcttttggtcaatcttctcagtccagctactcgaagattctccctctattccgccctaaatctaattcaagatccagaccagagtccccagcatctactgatggtgtatcacaaattcctagtcgggccatggatagcctcactccaagtccaaggtcaagatttccagctgcagaggcagccccctatgtgccagttgggcactaccgtatgccttgccacagcatggctccttcagtcacaattaggactgcagttcctgtgttctctgctccacctctcccatctccgtctgcacgcccgcagcagcttcctccactcatgagccacccaccaccgattcggatggcatccccagttcgcatgaggccatcctctccaatgtttgcctcctcggctgctgttcaagggccgaaacctgtgatgcctattcagttaaagaatgtgcaagatcaatcaaggaaggaaacagctccatctgcgatccctgttcaggtaaaagatgtgcaataccaaccaaggaagagctcaatgtctcctgtgattcctgtctcggtaaaggatgcacaacgccagcctcttgtgggatcactatcaactgcaatcccagttcagatgaaggatatgcaaacccaaaccccaaaggaatcactatcaactgcaatcccagttcagatgaaggacgtgcaaacccaagccccaaaggaatcactgtcagctccaattccagcaatcaggccttctttagttaagattgatttgcctgctcaaggcaaggaagcttcagctagtgctaccagcgaagtgccatcttctgctactggcaataatgctgctgtggaatgcactgcatcatcagatgctctcttggcaagacaatcaagggctgcggatggggacaaggataaggcggaagctaagcacgaggccgaggctcaagcagttgcagaggcagccatcaggcagctggagatcaattga

SEQ ID NO: 11438 - protein, 540 aa, Sorghum bicolor
  misc_feature: Ceres ANNOT ID no. 6014477
  misc_feature (2)..(68): Pfam Id: dsrm Pfam Desc: Double-stranded RNA binding motif
  misc_feature (88)..(153): Pfam Id: dsrm Pfam Desc: Double-stranded RNA binding motif
  misc_feature (1)..(394): NCBI GI: 92872274 NCBI Desc: double-stranded rna binding [medicago truncatula]
  misc_feature (1)..(438): NCBI GI: 115462131 NCBI Desc: os05g0150400 [oryza sativa (japonica cultivar-group)]
  misc_feature (1)..(165): NCBI GI: 102139807 NCBI Desc: double-stranded rna-binding (dsrbd) domain-containing protein [musa acuminata]
  misc_feature (1)..(501): NCBI GI: 92875779 NCBI Desc: double-stranded rna binding [medicago truncatula]
  misc_feature (1)..(154): NCBI GI: 50511731 NCBI Desc: dsrna-binding protein lh-c [brassica napus]
MYKNQLQELAQRSCFNLPAYTCLREGPDHAPRFKAAVNFNGEQFESPGFFTTLRQAEHAAAEVALAALARRGPSYSLAARILDETGVYKNLLQEVAQRVGAPLPLYTTERSGLGHLPVFTCTVELAGITFTGDPAKNKKQAEKNAASAAWSALKQLVREEVNSSNEPENNDEQEQIRIARALLNYRLKEKMAMANYPHVSPFPKKFPMQPERKPSFGQSSQSSYSKILPLFRPKSNSRSRPESPASTDGVSQIPSRAMDSLTPSPRSRFPAAEAAPYVPVGHYRMPCHSMAPSVTIRTAVPVFSAPPLPSPSARPQQLPPLMSHPPPIRMASPVRMRPSSPMFASSAAVQGPKPVMPIQLKNVQDQSRKETAPSAIPVQVKDVQYQPRKSSMSPVIPVSVKDAQRQPLVGSLSTAIPVQMKDMQTQTPKESLSTAIPVQMKDVQTQAPKESLSAPIPAIRPSLVKIDLPAQGKEASASATSEVPSSATGNNAAVECTASSDALLARQSRAADGDKDKAEAKHEAEAQAVAEAAIRQLEIN

SEQ ID NO: 11439 - DNA, 1242 bp, Sorghum bicolor
  misc_feature: Ceres ANNOT ID no. 6014487
  misc_feature: Encodes the peptide sequence at SEQ ID NO 11440
atggattctgaagctgagtttaatctactaaatgaattggtggattcatcatcttcggatgatgatgatgatttatatattgttgctgcccatatagtatcaacagatattggcaatgaaccacatcatcgtggtttagttgagggacaccgtgtattaaatcgtgatagacaggctgggcatgagagactttatcaagactatttttcagataatcctacatacgggccaaactatttcaggcgcagatttcgaatgaggcgacatgtgtttgtccgtataatgaatgttgctgacaagcatgacaattattttgtgcaaaagaggaatgcagctggaaccctaggactatcttgtttgcagaaggttgtggcggcatttcagatgttagcttatggtgtagcggctgatgctacagatgactatgttcgtattggtgaaagtactgctcttgagagtctgagaaggtttgttagagctgttgttgaaatatttggggatgagtacatgagaatgcctaatgagaaagatacagctagattgcttgcaattggtgagagaagaggttttccaggtatgttgggttccatagactgcatgcattggacctggaaaaattgcccggttgcatggcagggcatgtacatggggcacaaaaagaatcctacaattatacttgaagcagttgcttcaaaagatctttggatttggcacgctttttttggatgccagagatctcctgtttttgcaaggcttgctgaaggtcaaggtccacaggttaattatagcattaacggaaacaattatacaatgggttattatcttgccgatggcatatatccatcttggaccacttttgtgaagaccataccagagccacaaggtaacaagaataaatattttgctaaggcacaagaagcgtgtaggaaggatgttgaacgagcgtttggggttctacaagctcgctttgctatagttcgaagaccagctcgtttgtgggatgaggacacgcttcgagacatcatgaacgcttgtgtcattatgcataacatgattgttgaggatgagggggttgacgaagacgatttcaattacgacgacatgggagaaaaagtgaaagtatcccatgagagtacacttgagctagaaaaagtgaaagtatccatggcgcctgtgaagaaaaaaacacatggacaatcaagatcatatactgaaagtctgaaatatgatttcaagaagtag

SEQ ID NO: 11440 - protein, 413 aa, Sorghum bicolor
  misc_feature: Ceres ANNOT ID no. 6014487
  misc_feature (250)..(361): Pfam Id: Plant_tran Pfam Desc: Plant transposon protein
  misc_feature (8)..(401): NCBI GI: 48717071 NCBI Desc: ribosomal protein-like [oryza sativa (japonica cultivar-group)]
  misc_feature (9)..(401): NCBI GI: 115487548 NCBI Desc: os12g0169200 [oryza sativa (japonica cultivar-group)]
  misc_feature (9)..(401): NCBI GI: 115487898 NCBI Desc: os12g0228300 [oryza sativa (japonica cultivar-group)]
  misc_feature (13)..(401): NCBI GI: 55296301 NCBI Desc: ribosomal protein -like [oryza sativa (japonica cultivar-group)]
  misc_feature (2)..(399): NCBI GI: 38345929 NCBI Desc: osjnbb0078d11.4 [oryza sativa (japonica cultivar-group)]
MDSEAEFNLLNELVDSSSSDDDDDLYIVAAHIVSTDIGNEPHHRGLVEGHRVLNRDRQAGHERLYQDYFSDNPTYGPNYFRRRFRMRRHVFVRIMNVADKHDNYFVQKRNAAGTLGLSCLQKVVAAFQMLAYGVAADATDDYVRIGESTALESLRRFVRAVVEIFGDEYMRMPNEKDTARLLAIGERRGFPGMLGSIDCMHWTWKNCPVAWQGMYMGHKKNPTIILEAVASKDLWIWHAFFGCQRSPVFARLAEGQGPQVNYSINGNNYTMGYYLADGIYPSWTTFVKTIPEPQGNKNKYFAKAQEACRKDVERAFGVLQARFAIVRRPARLWDEDTLRDIMNACVIMHNMIVEDEGVDEDDFNYDDMGEKVKVSHESTLELEKVKVSMAPVKKKTHGQSRSYTESLKYDFKK

SEQ ID NO: 11441 - DNA, 405 bp, Sorghum bicolor
  misc_feature: Ceres ANNOT ID no. 6014590
  misc_feature: Encodes the peptide sequence at SEQ ID NO 11442
atggcgagcaccaagcttgcgttcctggctgtcgccgccgtcctgcttctgcaggcgtcgtggtggtgcggggccaacggtgatacgccggcggtgatgacggtgacctcattcgagaacgacgggaacggaggcggccccgcggcgtgcgacgggacctaccactcgaacggggagccgctcgtggcgctgcccacggcgctgtacgcgggcgggagccggtgcggcaagcagatccgcatcacgagcacgcagagcgggatttacatgatggccaaggtcgtggacgagtgcgacgccgacagctgcaaggacaacatgatcagcacgtccaagttcgtctgggacgtgctcgaggtcgatacctacatcggcgaggttcccatcacctggtctgacgcctaa

SEQ ID NO: 11442 - protein, 134 aa, Sorghum bicolor
  misc_feature: Ceres ANNOT ID no. 6014590
  misc_feature (29)..(134): NCBI GI: 38346744 NCBI Desc: osjnba0081g05.7 [oryza sativa (japonica cultivar-group)]
  misc_feature (29)..(134): NCBI GI: 85701136 NCBI Desc: kiwellin (allergen act c ?)
  misc_feature (29)..(134): NCBI GI: 92874714 NCBI Desc: barwin-related endoglucanase [medicago truncatula]
  misc_feature (27)..(120): NCBI GI: 115447493 NCBI Desc: os02g0637000 [oryza sativa (japonica cultivar-group)]
  misc_feature (29)..(134): NCBI GI: 92874720 NCBI Desc: barwin-related endoglucanase [medicago truncatula]
MASTKLAFLAVAAVLLLQASWWCGANGDTPAVMTVTSFENDGNGGGPAACDGTYHSNGEPLVALPTALYAGGSRCGKQIRITSTQSGIYMMAKVVDECDADSCKDNMISTSKFVWDVLEVDTYIGEVPITWSDA

SEQ ID NO: 11443 - DNA, 1983 bp, Sorghum bicolor
  misc_feature: Ceres ANNOT ID no. 6014658
  misc_feature: Encodes the peptide sequence at SEQ ID NO 11444
atgaacgggagcaagtgtgacatcagacgacgacgcaagtggaggccatggcggtggtggctcgtcgcttcgtgggttctagcggtgttcctgcagcggggcggcgccgcggaggtgacggagctggacctggaggagcgccgtgacgagcggcgcgacctgctggtgctgcgcgacacgctgcggtcggcgctggacctgcactccaactggacgggtcctccgtgccacggcgagcgtagccggtggcgcggcgtgtcgtgcgacggcgacgggcgcgtggtccgcgtggcgctcgacggcgcgcagctcacgggcacgctcccgcgtggcgcgctccgcgccgtgtcgcgcctcgaggcgctgtccctgcgcgggaacgcgctccacggcgcgctcccggggctcgacggcctgccgcggctccgcgccgtcgacctgtccagcaaccggttctcgggccccatcccgcgccagtacgccacgtcgctgcgggacctcgcgcggctcgagctccaggacaacctgctcagcggcaccctcccggcgttcgagcagcacggcctcgtcgtcttcaacgtctcctacaacttcctccagggcgaggtccccggcaccgccgcgctgcgccggttccccgcgagcgcgttcgaccacaacctcaggctctgtggcgaggttgtgaacgccgagtgcctggagggcccgacgacgtcgtccggtgctccagcgtatggaagcagcggcagcagtccggtcgtcgtgaggccgccggctggcgacggcggtcgggcggcacggaagcacgcgcggttcaggctggcggcgtggagcgtcgtggcgatcgccctcatcgcggcgctggtgccgttcgcggctgtgttcatcttcctgcaccacaggaagaaaagccaggaggccttcttgtttctgacggggacttgttctctgtacaatgcgaaagtgacggcggcggaggacatcaaggacaaggtggaggtggagcaaggccgagggagcggcagccggagcacggagtccggcaaggggggcgagctgcagttcttccgcgaggacgggcaagccagcttcgacctcgacgagctcttccggtccacggcggagatgctcggcaaggggcggctggggatcacgtaccgggtgaccctccaggccggccccgtcgtcgtcgtgaagcggctgcgcaacatgtcgcacgtgccgcgcagggacttcacgcacaccatgcagctcctgggcaagctccggcacgagaacgtcgtcgacctcgtcgcgtgcttctactccaaggaggagaagctggtcgtgtacgagcacgttcccgggtgcagcctcttccagctcctgcatggaaacagaggcgaggggaggacgccgctgccgtggccggcgcggctgtcgatagcgcagggcatggcgcgcgggctggcgtacctgcacaagtcgatgccgtacttccaccggccgccgcacggcaacctcaagtcgtccaacgtgctcgtcttcttctcggcggctgccaatggcggacagcagaagcaggcggtgccgaagctgacggaccacggcttccacccgctgctcccgcaccacgcgcaccggctggcggcggccaagtgccccgagttcgcgcgccgcggcggcaggcggctgtcgtcccgcgccgacgtgtactgcctaggcttggtgctgctggagctggtgacggggaaggtgcccgtggaggaagacggcgacctggcggagtgggcgcggctggcgctcagccacgagtggtccacggacatcctcgacgtggagatcgtcggcgaccggggacggcacggggacatgctcagactcaccgaggtcgctctcctctgcgccgccgtcgatcccgacaggcggcccaaggtgcaggacgccgtcaggatgatcgacgagatcgccgacggcgacggatcagagctagatcgtcgttga

SEQ ID NO: 11444 - protein, 660 aa, Sorghum bicolor
  misc_feature: Ceres ANNOT ID no. 6014658
  misc_feature (370)..(646): Pfam Id: Pkinase_Tyr Pfam Desc: Protein tyrosine kinase
  misc_feature (371)..(646): Pfam Id: Pkinase Pfam Desc: Protein kinase domain
  misc_feature (122)..(649): NCBI GI: 92884945 NCBI Desc: protein kinase [medicago truncatula]
  misc_feature (97)..(654): NCBI GI: 53793399 NCBI Desc: receptor-like protein kinase 1-like [oryza sativa (japonica cultivar-group)]
  misc_feature (54)..(655): NCBI GI: 92869587 NCBI Desc: protein kinase [medicago truncatula]
  misc_feature (34)..(655): NCBI GI: 115434366 NCBI Desc: os01g0133900 [oryza sativa (japonica cultivar-group)]
  misc_feature (340)..(649): NCBI GI: 115451643 NCBI Desc: os03g0223000 [oryza sativa (japonica cultivar-group)]
  misc_feature: The sequence is a functional homolog of SEQ ID NO. 391 in the 11/188,298 US application
  misc_feature: The sequence is a functional homolog of SEQ ID NO. 312 in the 11/188,298 US application
  misc_feature: The sequence is a functional homolog of SEQ ID NO. 323 in the 11/188,298 US application
  misc_feature: The sequence is a functional homolog of SEQ ID NO. 446 in the 11/188,298 US application
  misc_feature: The sequence is a functional homolog of SEQ ID NO. 495 in the 11/188,298 US application
  misc_feature: The sequence is a functional homolog of SEQ ID NO. 520 in the 11/188,298 US application
  misc_feature: The sequence is a functional homolog of SEQ ID NO. 464 in the 11/188,298 US application
  misc_feature: The sequence is a functional homolog of SEQ ID NO. 310 in the 11/188,298 US application
MNGSKCDIRRRRKWRPWRWWLVASWVLAVFLQRGGAAEVTELDLEERRDERRDLLVLRDTLRSALDLHSNWTGPPCHGERSRWRGVSCDGDGRVVRVALDGAQLTGTLPRGALRAVSRLEALSLRGNALHGALPGLDGLPRLRAVDLSSNRFSGPIPRQYATSLRDLARLELQDNLLSGTLPAFEQHGLVVFNVSYNFLQGEVPGTAALRRFPASAFDHNLRLCGEVVNAECLEGPTTSSGAPAYGSSGSSPVVVRPPAGDGGRAARKHARFRLAAWSVVAIALIAALVPFAAVFIFLHHRKKSQEAFLFLTGTCSLYNAKVTAAEDIKDKVEVEQGRGSGSRSTESGKGGELQFFREDGQASFDLDELFRSTAEMLGKGRLGITYRVTLQAGPVVVVKRLRNMSHVPRRDFTHTMQLLGKLRHENVVDLVACFYSKEEKLVVYEHVPGCSLFQLLHGNRGEGRTPLPWPARLSIAQGMARGLAYLHKSMPYFHRPPHGNLKSSNVLVFFSAAANGGQQKQAVPKLTDHGFHPLLPHHAHRLAAAKCPEFARRGGRRLSSRADVYCLGLVLLELVTGKVPVEEDGDLAEWARLALSHEWSTDILDVEIVGDRGRHGDMLRLTEVALLCAAVDPDRRPKVQDAVRMIDEIADGDGSELDRR

SEQ ID NO: 11445 - DNA, 1296 bp, Sorghum bicolor
  misc_feature: Ceres ANNOT ID no. 6014660
  misc_feature: Encodes the peptide sequence at SEQ ID NO 11446
atgacgccgcatctacccgccgccgtcgccgtcgccgtcgcctgctcctcctcctccgcctcctccacgcccaccaccacatcccgcgccgccgcctaccaccaccaccaccaccaccacctgctcgacgccgccgccgcgcctccgtcgtcctcgccgcagcaccagtaccggaggcggaggcggcgccgggtgcccggttgcctccgcccgtcgcgcccctcgcgcgccgcgtccgtccgctgctgcgccgccgccgcgcccgcgccgcaggcggcgctgcccgcggcggcgcgcgccgaggcggaggccaccacgcgggtcttcgtcgtctccgacctgcacacggactacccggagaacatggactgggtgcgccgcctccccgccgaggtcggcgccggcaagggccacggcgtcgacgcgctcgtcgtcgccggcgacgtggccgagaccagggacaacttcgcgcgcaccatggaggtcctcagggagcgattcgccgccgtcttctacgtgccagggaaccacgatctctggctgcgccgcgagggcggacgctacatggattcgctggagaaactgactgcattgcttgatgcgtgtagtgagctgggtgtggatacaggcccaagaacaataggtgacttgggaatcatacctttgttctcatggtatcacaagagctttgacaaggagaaggatgttaacagtgtgcgtgtcccttcgctagagatggcctgtaaagacttccatgcttgccaatggccttcagacctgacaaatgatgacgaggctcttgctgtttactttgacaagctgaatgacaagaatcatgatgctattgaagaagtgaaaagaagcagcaaacaaatattaacattttcacacttcgtaccaaggcaagagttgtgtccggagaaacgtatgctttattacccataccttcctaaggtcattggttctgattttttggagaggaggctcagagatatacacagcaacagaaaagacggagcagcttgccatgtttttgggcacactcatttctgttgggattctgtggttgatgagatcaggtacgtgcaagcccctctggcatacccacgagaaagaaaacgccggatgaacagtgaaggctggttgccattttgtgtataccgtgatggtttcaacccagaaatatacccggcattgtggtcagactactacaacaagaacaaaagggaacccgagaacactcagctcgcgccatgggttgccagccatttcgcgaagtaccataagttccactga

SEQ ID NO: 11446 - protein, 431 aa, Sorghum bicolor
  misc_feature: Ceres ANNOT ID no. 6014660
  misc_feature (106)..(351): Pfam Id: Metallophos Pfam Desc: Calcineurin-like phosphoesterase
  misc_feature (229)..(428): NCBI GI: 115482682 NCBI Desc: os10g0492800 [oryza sativa (japonica cultivar-group)]
  misc_feature (107)..(426): NCBI GI: 92872542 NCBI Desc: metallophosphoesterase [medicago truncatula]
  misc_feature (107)..(334): NCBI GI: 83717406 NCBI Desc: ser/thr protein phosphatase family [burkholderia thailandensis e264]
  misc_feature (99)..(230): NCBI GI: 74026497 NCBI Desc: phosphoesterase [streptomyces neyagawaensis]
  misc_feature (108)..(412): NCBI GI: 118466859 NCBI Desc: metallophosphoesterase [mycobacterium avium 104]
MTPHLPAAVAVAVACSSSSASSTPTTTSRAAAYHHHHHHHLLDAAAAPPSSSPQHQYRRRRRRRVPGCLRPSRPSRAASVRCCAAAAPAPQAALPAAARAEAEATTRVFVVSDLHTDYPENMDWVRRLPAEVGAGKGHGVDALVVAGDVAETRDNFARTMEVLRERFAAVFYVPGNHDLWLRREGGRYMDSLEKLTALLDACSELGVDTGPRTIGDLGIIPLFSWYHKSFDKEKDVNSVRVPSLEMACKDFHACQWPSDLTNDDEALAVYFDKLNDKNHDAIEEVKRSSKQILTFSHFVPRQELCPEKRMLYYPYLPKVIGSDFLERRLRDIHSNRKDGAACHVFGHTHFCWDSVVDEIRYVQAPLAYPRERKRRMNSEGWLPFCVYRDGFNPEIYPALWSDYYNKNKREPENTQLAPWVASHFAKYHKFH

SEQ ID NO: 11447 - DNA, 1326 bp, Sorghum bicolor
  misc_feature: Ceres ANNOT ID no. 6014810
  misc_feature: Encodes the peptide sequence at SEQ ID NO 11448
atggcaaatactagtgttgcagaaggtgcagtgaggacgctccctgacaatctcaagttggtcaccgtactgagcatcgatggtggcggcatcagagggatcatcccggccaccatcctcgccttcctagaagcgaagctccaagaactggatggaccagatgctcgtattgcagactacttcgacgtcgtcgctggcactagcaccggcggtctcttgacggcgatgctcacagccccggacgctaacgaacgaccactgttcgctgccaaggacctggcgcggttctacattcagcactcacccaaaatcttccgacacaagagtggtatgaggtccaagctcgctagcacgctgaggatggcgtgtgggcccaagtacgacggcaagtacctccatgggctgctccgacggtaccttggtaatacgaggctggacaggacgctgaccaatgttgtcattccgaccttcgacattgcgtacctgcaaccgacgattttctccagctttgagttgaagcaccggccgtggaaaaatgcgcttctgtcagacatatcgatgagcacctcggcagcgcccaccttcttcccgccgcactacttcgagaccaaggacgagaatggcaggaggaggggcttcaacctcgtcgatggtgggatcgctgcgaataaccctactctgtgcgcgatgaaccaggtgtctcaggacatcatcctcggcgacgacgacttgttcccggtgatgccggcggactacggcaagttcatggtgatctccctcggctgcgggtcgaaccggaaccgcaggtactgcgccaaggccgccgccaagtggggcgtcttcagctggctcttcaaggacggcaacgctcccatcatcgacatgttcaactccgccagcgccgacatggtcgacatcaacctctgcgtcctcttcagggccctgcgctccagccagaactacctgcgcatccagtatgatcagctgacgggcagcgcgggctccatagacgacacctccaaggagaacatggataggctggtgagaatcgggaacaagctcctggacatgaacgtctcccgggtggacctggagactggccggatcgtggaggtgcccggtgcagggaccaacgccgagcagctcgccaagttcgccaagcagctttctgacgagcgacgccgccggctccaggacgagcttactagttccgaacccgaagtagaattccatgtccaacatcaagcttggacgtctgatggagtgagtccctgggtgctgctgcttcgctcggtggatagtctgatgatagttactctatgttaa

SEQ ID NO: 11448 - protein, 441 aa, Sorghum bicolor
  misc_feature: Ceres ANNOT ID no. 6014810
  misc_feature (24)..(230): Pfam Id: Patatin Pfam Desc: Patatin-like phospholipase
  misc_feature (20)..(396): NCBI GI: 9794868 NCBI Desc: patatin-like protein 1 [nicotiana tabacum]
  misc_feature (15)..(396): NCBI GI: 4539677 NCBI Desc: patatin-like protein [sorghum bicolor]
  misc_feature (20)..(396): NCBI GI: 62766606 NCBI Desc: patatin-like protein [gossypium hirsutum]
  misc_feature (108)..(396): NCBI GI: 4539676 NCBI Desc: patatin-like protein [sorghum bicolor]
  misc_feature (19)..(399): NCBI GI: 9794870 NCBI Desc: patatin-like protein 3 [nicotiana tabacum]
  misc_feature: Useful for making plants with modulated heat sensitivity
  misc_feature: Functional homolog of the protein sequence given in SEQ ID NO 13256
MANTSVAEGAVRTLPDNLKLVTVLSIDGGGIRGIIPATILAFLEAKLQELDGPDARIADYFDVVAGTSTGGLLTAMLTAPDANERPLFAAKDLARFYIQHSPKIFRHKSGMRSKLASTLRMACGPKYDGKYLHGLLRRYLGNTRLDRTLTNVVIPTFDIAYLQPTIFSSFELKHRPWKNALLSDISMSTSAAPTFFPPHYFETKDENGRRRGFNLVDGGIAANNPTLCAMNQVSQDIILGDDDLFPVMPADYGKFMVISLGCGSNRNRRYCAKAAAKWGVFSWLFKDGNAPIIDMFNSASADMVDINLCVLFRALRSSQNYLRIQYDQLTGSAGSIDDTSKENMDRLVRIGNKLLDMNVSRVDLETGRIVEVPGAGTNAEQLAKFAKQLSDERRRRLQDELTSSEPEVEFHVQHQAWTSDGVSPWVLLLRSVDSLMIVTLC

SEQ ID NO: 11449 - DNA, 705 bp, Sorghum bicolor
  misc_feature: Ceres ANNOT ID no. 6014818
  misc_feature: Encodes the peptide sequence at SEQ ID NO 11450
atgtcgtcgtccgcttccagcgccgggggcgagaccgccggcgagttcacggaggtcgtcatcgtgcggcacggagagacttcatggaacgcctcgcgcatcatacagggacacttggatgcagagcttaatgatattgggaggcagcaagctgttgcggttgctcatcgcctttctaaagaagtgaaaccagttgccatatactcttctgatctgaagcgagcagcagagactgcgcaaacaatcgcaagaatttgcaatgtgccaaatgtcatgtttgatccggcactgagagaaagacacattggagatctgcagggcatgaagcttcaagatgctgctacagagaagccagaggcatacaaagcttttatgtcccataagagaaatcaacaaattcctggtggtggagagagtcttgatcaactgtcggagcgatgtgtgtcgtgtctgtacaacattgttgagaaacacaaaggggagcgagttatcctggtttcacatggcggcaccatcagagaactctacagacacgccagccctacaaagccgctccactgtaaaatacacaacacgtcagtgagtgtcatcctcgtgtccgattccaccggtcgctgcatcgtcaagatgtgcggggacatcagtcaccttcaggagacgggcgtcctggagaatgcctttggtggcgataagaactccgcctaa

SEQ ID NO: 11450 - protein, 234 aa, Sorghum bicolor
  misc_feature: Ceres ANNOT ID no. 6014818
  misc_feature (18)..(175): Pfam Id: PGAM Pfam Desc: Phosphoglycerate mutase family
  misc_feature (3)..(234): NCBI GI: 42408059 NCBI Desc: phosphoglycerate mutase-like protein [oryza sativa (japonica cultivar-group)]
  misc_feature (15)..(230): NCBI GI: 9955567 NCBI Desc: phosphoglycerate mutase-like protein [arabidopsis thaliana]
  misc_feature (15)..(230): NCBI GI: 15237633 NCBI Desc: phosphoglycerate/bisphosphoglycerate mutase family protein [arabidopsis thaliana]
  misc_feature (16)..(124): NCBI GI: 115484075 NCBI Desc: os11g0138400 [oryza sativa (japonica cultivar-group)]
  misc_feature (91)..(186): NCBI GI: 115476890 NCBI Desc: os08g0476400 [oryza sativa (japonica cultivar-group)]
MSSSASSAGGETAGEFTEVVIVRHGETSWNASRIIQGHLDAELNDIGRQQAVAVAHRLSKEVKPVAIYSSDLKRAAETAQTIARICNVPNVMFDPALRERHIGDLQGMKLQDAATEKPEAYKAFMSHKRNQQIPGGGESLDQLSERCVSCLYNIVEKHKGERVILVSHGGTIRELYRHASPTKPLHCKIHNTSVSVILVSDSTGRCIVKMCGDISHLQETGVLENAFGGDKNSA

SEQ ID NO: 11451 - DNA, 768 bp, Sorghum bicolor
  misc_feature: Ceres ANNOT ID no. 6014876
  misc_feature: Encodes the peptide sequence at SEQ ID NO 11452
atgctctctccatggcacacgattgcacctgctgccatggagctacggtcacccctgaactcaaagaactgctccctttactccacgattagatcaccaccaccgcgctccttggcgcgggcgccctccaagctctccgccgccgcagcggccgtctcgtcgctgtccgacacggcagcggcggccatctcctcgccttcctgtccaaagaagaaggttctcgtgcccgtcgccatgggtacggaggagatggaggcggtcatcatcgccggcgtcctccggagagctggcgctgacgtgacgcttgcctctgtcgaggacggcctcgaggtggaggcgtcctgcggctcccgcatcgtcgcggacacgcacattgcctcctgcgctgaccaagtgttcgatcttgtggctctcccgggaggaatgcctggttcagtgcggttgagagacagtgacatccttcagaggatcacagttagacaggctgaggagaaaagattgtatggtgctatatgtgccgcaccagcggttgttctaatgccgtggggtctccacaggagaaaaaagatcacctgccacccatcttttataggagatctccctgcattccgagctgttgaatcaaatgttcaggtttcaggagagcttactacaagtcgtggcccagggacagcatttgagtttgctttatcatttgttgagcaaatgtttgggcctcacacagctgaagatatgggcaggattttggtttgtcaaaagaaactttaa

SEQ ID NO: 11452 - protein, 255 aa, Sorghum bicolor
  misc_feature: Ceres ANNOT ID no. 6014876
  misc_feature (99)..(237): Pfam Id: DJ-1_PfpI Pfam Desc: DJ-1/PfpI family
  misc_feature (28)..(250): NCBI GI: 115468368 NCBI Desc: os06g0531200 [oryza sativa (japonica cultivar-group)]
  misc_feature (32)..(245): NCBI GI: 115435298 NCBI Desc: os01g0217800 [oryza sativa (japonica cultivar-group)]
  misc_feature (71)..(245): NCBI GI: 33149230 NCBI Desc: thij-like protein [brassica rapa subsp. pekinensis]
  misc_feature (71)..(250): NCBI GI: 146305868 NCBI Desc: dj-1 family protein [pseudomonas mendocina ymp]
  misc_feature (71)..(238): NCBI GI: 28899138 NCBI Desc: 4-methyl-5(b-hydroxyethyl)-thiazol monophosphate biosynthesis enzyme [vibrio parahaemolyticus rimd 2210633]
MLSPWHTIAPAAMELRSPLNSKNCSLYSTIRSPPPRSLARAPSKLSAAAAAVSSLSDTAAAAISSPSCPKKKVLVPVAMGTEEMEAVIIAGVLRRAGADVTLASVEDGLEVEASCGSRIVADTHIASCADQVFDLVALPGGMPGSVRLRDSDILQRITVRQAEEKRLYGAICAAPAVVLMPWGLHRRKKITCHPSFIGDLPAFRAVESNVQVSGELTTSRGPGTAFEFALSFVEQMFGPHTAEDMGRILVCQKKL

SEQ ID NO: 11453 - DNA, 510 bp, Sorghum bicolor
  misc_feature: Ceres ANNOT ID no. 6015030
  misc_feature: Encodes the peptide sequence at SEQ ID NO 11454
atgcgtgccaccatgtccttgaccgggtccgcccttgccaatgatccctgcctcaccaagatcctgtccaagcaaggggacaacaaagttctctttgcagacaaggtattaaagttcagccagtcaggaaagatgaaaaggcgcatcctagtgattacagactttgctctataccttgttgaccccgatgccaatatattgaagaggaggatagcacttgcagctgtggataagctatgcattagcaacctcagtgataacttctttgcgatcattgtgccgactgagtacgattgtttaatggccagcactagaaagaaggaaattgttggtatcatagttaaggctatcaagagcacatctgagtatgaacctgaggtggcgtcctctaacaggtttgagtatcatgcagctgctgaagttattaaggttgtcgaatttgaggaagttgatgtgtggttctttgccaggaactttggtgcagacaattcggagaaagaggtgaagtag

SEQ ID NO: 11454 - protein, 169 aa, Sorghum bicolor
  misc_feature: Ceres ANNOT ID no. 6015030
  misc_feature (1)..(169): Pfam Id: Myosin_TH1 Pfam Desc: Myosin tail
  misc_feature (12)..(149): NCBI GI: 13605555 NCBI Desc: at5g53310/k19e1_11 [arabidopsis thaliana]
  misc_feature (18)..(119): NCBI GI: 60471518 NCBI Desc: myosin id heavy chain [dictyostelium discoideum]
  misc_feature (18)..(119): NCBI GI: 28850380 NCBI Desc: similar to dictyostelium discoideum (slime mold). myosin id heavy chain
  misc_feature (29)..(149): NCBI GI: 462679 NCBI Desc: myosin ib heavy chain
  misc_feature (29)..(149): NCBI GI: 60464742 NCBI Desc: myosin ib [dictyostelium discoideum]
  misc_feature: Useful for making plants with altered alkaloid content
  misc_feature: Functional homolog of the protein sequence given in SEQ ID NO 13068
MRATMSLTGSALANDPCLTKILSKQGDNKVLFADKVLKFSQSGKMKRRILVITDFALYLVDPDANILKRRIALAAVDKLCISNLSDNFFAIIVPTEYDCLMASTRKKEIVGIIVKAIKSTSEYEPEVASSNRFEYHAAAEVIKVVEFEEVDVWFFARNFGADNSEKEVK

SEQ ID NO: 11455 - DNA, 738 bp, Sorghum bicolor
  misc_feature: Ceres ANNOT ID no. 6015094
  misc_feature: Encodes the peptide sequence at SEQ ID NO 11456
atggccaccgactcctcggtagccccgttccagaagatccagatccagcgcgaggacaccacttttgatgcctatgttgttggcaaagaaaatgctcctggaattgtggttttgcaagaatggtggggagttgactatgagataaagaaccatgcgatccacatttcccaacttggtggaggatacagagcactcattccagatttataccgtggaaaagttgctctggatgttgctgaggcacagcatctgatggagggtctcgactggcagggtgcagtcaaggatattcaggcttcagttaaatggctgaagtcaaatggatcacccaaggttggtgtgactggctattgcatgggaggtgctttatcaattgcaagtggagttttagttccattggttgatgctgttgttgctttctatgggacaccatcttctgagcttgctgatccttccaaggctaaggctcctatacaggctcatttcggggagcatgacagttttgttggtttttcagatgtcactgcagccaagtccctggaggagaagctcaaatcttctgggataccatatgaagttcacatataccctggatgttcacatgccttcatgaacacttcgcctgaggccctcaagaggaagaaggggatgggtctgactgatgagaaccaggaagccgtcgacctggcctggtctcgcttctcttcttggatgggccgtttcctcggatctgcttga

SEQ ID NO: 11456 - protein, 245 aa, Sorghum bicolor
  misc_feature: Ceres ANNOT ID no. 6015094
  misc_feature (22)..(242): Pfam Id: DLH Pfam Desc: Dienelactone hydrolase family
  misc_feature (30)..(233): NCBI GI: 145589457 NCBI Desc: carboxymethylenebutenolidase [polynucleobacter sp. qlw-p1dmwa-1]
  misc_feature (30)..(242): NCBI GI: 91779542 NCBI Desc: carboxymethylenebutenolidase [burkholderia xenovorans lb400]
  misc_feature (34)..(204): NCBI GI: 89293438 NCBI Desc: dienelactone hydrolase family protein [tetrahymena thermophila sb210]
  misc_feature (30)..(242): NCBI GI: 118037014 NCBI Desc: dienelactone hydrolase [burkholderia phytofirmans psjn]
  misc_feature (30)..(242): NCBI GI: 121529499 NCBI Desc: carboxymethylenebutenolidase [ralstonia pickettii 12j]
MATDSSVAPFQKIQIQREDTTFDAYVVGKENAPGIVVLQEWWGVDYEIKNHAIHISQLGGGYRALIPDLYRGKVALDVAEAQHLMEGLDWQGAVKDIQASVKWLKSNGSPKVGVTGYCMGGALSIASGVLVPLVDAVVAFYGTPSSELADPSKAKAPIQAHFGEHDSFVGFSDVTAAKSLEEKLKSSGIPYEVHIYPGCSHAFMNTSPEALKRKKGMGLTDENQEAVDLAWSRFSSWMGRFLGSA

SEQ ID NO: 11457 - DNA, 1044 bp, Sorghum bicolor
  misc_feature: Ceres ANNOT ID no. 6015099
  misc_feature: Encodes the peptide sequence at SEQ ID NO 11458
atgggaaagaagattcgcagcgccaatggcacctcgacgccggtcaggtccatgaaccaggccgtgtcgctccgtgaggagacctccgggaggacgcacgtagacgatgtctccctgctgagggtcaagcacctgcagaggctagcggcgtgggcgggcgcagaggccggggtgggcccgatcggcgcgctgctggggcgccgcctcgccgcgagcgccgaggccgccggagtacccctcgacgccgccactttcctttgccagaggtgtgagacaatcttaaagccaggcttcaactgcactgtccgcataaggaacaagagaaataaagcaaaacgtcgtaagaaatcaaactgttgtcagaacagtgtttcctatgcatgccatttttgtggagatcagaacctagtattaggtagtgggaagggtgttgttaagagcctgttaccattaagagaccatagtactatgaactcatcccatagaattatgagaggaaacaataacaacagaagaacacatgataagaaagaagtgcttgagctttctcaagcagcaattttgcaagtggaattgtcatctctgttgagacagtcaacttctgaaagtgatgagcatggcgaaaggttaaaatgtaatcttgatgaacagatgcatgaaactgaccctattgcttctgagaaggttaaaatatgcgaagctacttcgcaagcagaacttccagttggttcatcatttgtcacacctcagaaaaagaaaccactggtggtgactgtccctaaagattcagcaggaatactcaagacaggaagtagcgtgatttctggctcagtcactcacacactttcaggctctagcaagtctgcctcgaatgactctagaaataatgtgaaatatgcagcaaaggattcttctcaggtttctggcagctcaagaaagcggacaagaaaggggtggacgactctgaaacaaatagctgagaaggatgagctcgaaaagaaggagaagatgggtaattttgtaatcccgttcttcatgcactaa

SEQ ID NO: 11458 - protein, 347 aa, Sorghum bicolor
  misc_feature: Ceres ANNOT ID no. 6015099
  misc_feature (40)..(133): Pfam Id: Rpr2 Pfam Desc: RNAse P Rpr2/Rpp21/SNM1 subunit domain
  misc_feature (72)..(239): NCBI GI: 115437218 NCBI Desc: os01g0531000 [oryza sativa (japonica cultivar-group)]
  misc_feature (164)..(346): NCBI GI: 20521343 NCBI Desc: p0702h08.13 [oryza sativa (japonica cultivar-group)]
MGKKIRSANGTSTPVRSMNQAVSLREETSGRTHVDDVSLLRVKHLQRLAAWAGAEAGVGPIGALLGRRLAASAEAAGVPLDAATFLCQRCETILKPGFNCTVRIRNKRNKAKRRKKSNCCQNSVSYACHFCGDQNLVLGSGKGVVKSLLPLRDHSTMNSSHRIMRGNNNNRRTHDKKEVLELSQAAILQVELSSLLRQSTSESDEHGERLKCNLDEQMHETDPIASEKVKICEATSQAELPVGSSFVTPQKKKPLVVTVPKDSAGILKTGSSVISGSVTHTLSGSSKSASNDSRNNVKYAAKDSSQVSGSSRKRTRKGWTTLKQIAEKDELEKKEKMGNFVIPFFMH

SEQ ID NO: 11459 - DNA, 987 bp, Sorghum bicolor
  misc_feature: Ceres ANNOT ID no. 6015430
  misc_feature: Encodes the peptide sequence at SEQ ID NO 11460
atgcggaggaagctgctggagttcccgtccctcatcgcgcagcacgccctccgcggggccccaaaacccagaccccaaccccagccccaccaccaccgcttcgtgcactccccctcagcgcccacatccgcatccccttccccctccccgtcggcccacctcctatggaatcgcctctccggcgctaccgggctctctctcctgccgaggacggctgcggacgtcgcagcggtcgcgcggaccgccgcgtcccggtggctggccgccgcgcgcggctccggctctctcgatctcttctcgttgcagcggcgacgcagggcctcgtggtggcagttatcgtcttcccctttcctccaaggcgcgccctgggcgtactggatggagtctcccgacagtgcggtgtggatgcttatcggtgcgaatgtagctgtctttatgctgtggcgtgtggctgatccagggttcatgaggaggcatttcatgatttcactagacaatttgaagagcggacggttgcacaccttgctcacgaatgctttcagccatgctgagtctaatcacctctttgccaatatgattggcctctacttctttgggaacaatattgcaaatgtgtttggtccggcctttctattgaagttgtacgttggtggagcacttactggatcagtattcttcttgctggagaaggcttttctagctcatcggaaacaggattatgaaggatgggatacttcaagagttgctggacttggtgcaagtgccgcagttaatgcaactatcctccttcagatttttctgtatcccaagggactagtgtatctttatttcctcattcctgttccagctgcacttatgggtgcagccataattggtgctgatttacttaggttgaagaggcatggcgaggtatcaggttcagctcatttagggggtgccctggttgctgctcttatgtgggctcgaattaggaaaggctggatctga

SEQ ID NO: 11460 - protein, 328 aa, Sorghum bicolor
  misc_feature: Ceres ANNOT ID no. 6015430
  misc_feature (166)..(328): Pfam Id: Rhomboid Pfam Desc: Rhomboid family
  misc_feature (38)..(299): NCBI GI: 57900364 NCBI Desc: rhomboid family protein-like [oryza sativa (japonica cultivar-group)]
  misc_feature (123)..(305): NCBI GI: 42572101 NCBI Desc: rhomboid family protein [arabidopsis thaliana]
  misc_feature (125)..(326): NCBI GI: 146162537 NCBI Desc: rhomboid family protein [tetrahymena thermophila sb210]
  misc_feature (133)..(313): NCBI GI: 117578550 NCBI Desc: rhomboid family protein [gramella forsetii kt0803]
  misc_feature (127)..(314): NCBI GI: 86133051 NCBI Desc: cytoplasmic membrane protein [tenacibaculum sp. med152]
MRRKLLEFPSLIAQHALRGAPKPRPQPQPHHHRFVHSPSAPTSASPSPSPSAHLLWNRLSGATGLSLLPRTAADVAAVARTAASRWLAAARGSGSLDLFSLQRRRRASWWQLSSSPFLQGAPWAYWMESPDSAVWMLIGANVAVFMLWRVADPGFMRRHFMISLDNLKSGRLHTLLTNAFSHAESNHLFANMIGLYFFGNNIANVFGPAFLLKLYVGGALTGSVFFLLEKAFLAHRKQDYEGWDTSRVAGLGASAAVNATILLQIFLYPKGLVYLYFLIPVPAALMGAAIIGADLLRLKRHGEVSGSAHLGGALVAALMWARIRKGWI

SEQ ID NO: 11461 - DNA, 891 bp, Sorghum bicolor
  misc_feature: Ceres ANNOT ID no. 6015444
  misc_feature: Encodes the peptide sequence at SEQ ID NO 11462
atggccttcaagctgggcaccaaggccgcggcggcggcgtcgcccgcggctgctcaccggggaggtctcgcccgcgggccgcagggcgcgagccgcgtcgtcttcggaccagcagcggaagagagggttgatcgaagtgaaacattgacattggatagcattagacaagttttgattagacttgaagacagcatcatattcggcctcttggagagagcccagttttgttacaatgctgagacatatgatagcaatgctttccacatggatggttttgaaggatctttggttgaatatatggtcagagaaactgaaaagctccatgcacaggttgggagatacaatagcccagatgagtaccctttctttcctgaggatctgcctgagccccgcttgccacctatacaatacccaagggttttgcatcccattgctgattctataaatatcaacaaagagatttggaaaatgtatttcgatgaacttcttccaagattggtgaaagaaggaagtgatggtaatgctggatccagtgctgtttgtgacacgacctgcttgcaggcactctctaaaaggatccactatgggatgtttgtggcagaggccaagtttcaggaggcccctgaatcttacatgccagccataatagcccaggaccctgatcagctcatgcaccttctcacatatgaaacggtggagcgtgctatcgaacacagggtggaagccaaagccaagatcttcgggcaagaggtgaacatcggtgctgaggacagcggcagcccaccggtttacaagatgaggccgagcttggtcgctgagctgtacagctacagaatcatgccgctaaccaaggatgttcaagtcgcgtacttgcttaggaggctggattga

SEQ ID NO: 11462 - protein, 296 aa, Sorghum bicolor
  misc_feature: Ceres ANNOT ID no. 6015444
  misc_feature (55)..(122): Pfam Id: CM_2 Pfam Desc: Chorismate mutase type II
  misc_feature (40)..(296): NCBI GI: 429153 NCBI Desc: chorismate mutase precursor [arabidopsis thaliana]
  misc_feature (40)..(296): NCBI GI: 18406100 NCBI Desc: chorismate mutase, chloroplast (cm1) [arabidopsis thaliana]
  misc_feature (40)..(296): NCBI GI: 9293913 NCBI Desc: chorismate mutase precursor [arabidopsis thaliana]
  misc_feature (40)..(296): NCBI GI: 5824343 NCBI Desc: chorismate mutase [arabidopsis thaliana]
  misc_feature (42)..(296): NCBI GI: 4512122 NCBI Desc: chorismate mutase 3 [arabidopsis thaliana]
  misc_feature (40)..(296): SWISSPROT Homolog: EC 5.4.99.5 Chorismate mutase, chloroplast precursor
MAFKLGTKAAAAASPAAAHRGGLARGPQGASRVVFGPAAEERVDRSETLTLDSIRQVLIRLEDSIIFGLLERAQFCYNAETYDSNAFHMDGFEGSLVEYMVRETEKLHAQVGRYNSPDEYPFFPEDLPEPRLPPIQYPRVLHPIADSININKEIWKMYFDELLPRLVKEGSDGNAGSSAVCDTTCLQALSKRIHYGMFVAEAKFQEAPESYMPAIIAQDPDQLMHLLTYETVERAIEHRVEAKAKIFGQEVNIGAEDSGSPPVYKMRPSLVAELYSYRIMPLTKDVQVAYLLRRLD

SEQ ID NO: 11463 - DNA, 1455 bp, Sorghum bicolor
  misc_feature: Ceres ANNOT ID no. 6015599
  misc_feature: Encodes the peptide sequence at SEQ ID NO 11464
atggaggacgaccgcgccacggccaatgtccgcgtggacggcgcgccggcggaagccacgctcagcggcggggagctgcggtggcgccgcggcggtgctggcggggccgggccggagcgggcgctgtcgctggagagcgacgtgctcggggtccaggtgacggggaaggaggtcgtcgtcagggccttcgtggcggcgggcgcggcgagggcgctgtcgtgcgcgggcgcgggagggaagcggtgcagaagggacttcgtgctccagatggcggacggcgagggcgccgccgtggcctggggagaggggctcacacgctacctcgactccttcggccgccccaagagattgttcgtcttcgtcaaccccttcggcggcaagaaatgcgccaggaagatctacgacacggaaatcaagcctctgtttgaagctgcggagaccgagtaccaggggcatgcccgggaggtggtgtattccctcgacctcgcggagtacgacggcgtcgtctgcgttagcggtgatggcgtcctcgtggaggtagtgaacggaattcttcaacggacagattgggaggaggcaataaaagtgcctatcggtgtagttccagcaggttcaggaaatggcatggctaaatcacttctgcatgctgccagtgagaaatactcggtttcaaatgctgtatttgccataatcaaaggtcacaagcagtccttagatgtctgtaccattttgcaaggggacacgaaattttttagtgtcttgctaatgacttggggtttggtggccgatatagatatcgagtctgagaaatacagatggatgggaagtgcacgcttcgacttctatgctctggtgcgcataatgaacttgcgaaaatactgtggaagtattcagttcgtgcctgccccaggctacgaggcatatggagaacccatcaagcaagtcaagaattccattgtagagtctgtggagcaaaatggaaaatctcatcggtcttcttatccaggtccttcagttgagtttcaagcttcagattggagatttattgatggcccatttattgcagtttgggtaaacaacgtgccatgggctgctgaggatatcatggcggctccagaggcaaagttctcagatggctatatggatgcagccatactcagagattgtccaaaggctgatcttttagctctattgatgaagatgagcgacggcagttatgtcaaatcaccatatgttgcttacctcaaggtgagaacttttcaattatcaccaggccagcttgttgagaaccccaaaaggggtggcattatagatgtggacggagaggtaattgctagaggaaaaggaacttacgacaaaaaccaacatcaagatgtgatggcttatggccaacctattcagctgacagtgcaccaagcattggctaccatatattgccctgacaaaattcactga

SEQ ID NO: 11464 - protein, 484 aa, Sorghum bicolor
  misc_feature: Ceres ANNOT ID no. 6015599
  misc_feature (116)..(241): Pfam Id: DAGK_cat Pfam Desc: Diacylglycerol kinase catalytic domain
  misc_feature (23)..(480): NCBI GI: 115440333 NCBI Desc: os01g0782200 [oryza sativa (japonica cultivar-group)]
  misc_feature (10)..(481): NCBI GI: 79481008 NCBI Desc: d-erythro-sphingosine kinase/ diacylglycerol kinase [arabidopsis thaliana]
  misc_feature (10)..(480): NCBI GI: 115472791 NCBI Desc: os07g0563000 [oryza sativa (japonica cultivar-group)]
  misc_feature (200)..(481): NCBI GI: 79325211 NCBI Desc: diacylglycerol kinase [arabidopsis thaliana]
  misc_feature (10)..(277): NCBI GI: 79325207 NCBI Desc: diacylglycerol kinase [arabidopsis thaliana]
MEDDRATANVRVDGAPAEATLSGGELRWRRGGAGGAGPERALSLESDVLGVQVTGKEVVVRAFVAAGAARALSCAGAGGKRCRRDFVLQMADGEGAAVAWGEGLTRYLDSFGRPKRLFVFVNPFGGKKCARKIYDTEIKPLFEAAETEYQGHAREVVYSLDLAEYDGVVCVSGDGVLVEVVNGILQRTDWEEAIKVPIGVVPAGSGNGMAKSLLHAASEKYSVSNAVFAIIKGHKQSLDVCTILQGDTKFFSVLLMTWGLVADIDIESEKYRWMGSARFDFYALVRIMNLRKYCGSIQFVPAPGYEAYGEPIKQVKNSIVESVEQNGKSHRSSYPGPSVEFQASDWRFIDGPFIAVWVNNVPWAAEDIMAAPEAKFSDGYMDAAILRDCPKADLLALLMKMSDGSYVKSPYVAYLKVRTFQLSPGQLVENPKRGGIIDVDGEVIARGKGTYDKNQHQDVMAYGQPIQLTVHQALATIYCPDKIH

SEQ ID NO: 11465 - DNA, 366 bp, Sorghum bicolor
  misc_feature: Ceres ANNOT ID no. 6015614
  misc_feature: Encodes the peptide sequence at SEQ ID NO 11466
atggcaaaccatggagctgccgccttcctcttgatcgcgtccctccttgtggcagttgccctctccggggctgacgcgaggctcagcaccgtgcgccacaacaaggcggcagccctccgtggggccaagaccaacgcgaggctcaccgggcgcatatcacaaggttacgctgtggtcgagaaggctgcggcggtgccagagctgacctgcaacaaggtgcacggggtgcaggtgggcgagacgtgcttttccgtggggctgggggcggggctgacccaggatcagtttctcagcttcaaccccaacatcaactgtgggaagatattcgtcggccagtgggtctgccttgaagccacatccgcttga

SEQ ID NO: 11466 - protein, 121 aa, Sorghum bicolor
  misc_feature: Ceres ANNOT ID no. 6015614
  misc_feature (74)..(117): Pfam Id: LysM Pfam Desc: LysM domain
MANHGAAAFLLIASLLVAVALSGADARLSTVRHNKAAALRGAKTNARLTGRISQGYAVVEKAAAVPELTCNKVHGVQVGETCFSVGLGAGLTQDQFLSFNPNINCGKIFVGQWVCLEATSA

SEQ ID NO: 11467 - DNA, 1335 bp, Sorghum bicolor
  misc_feature: Ceres ANNOT ID no. 6015771
  misc_feature: Encodes the peptide sequence at SEQ ID NO 11468
atgatcccgggatccgcggtgtaccacgtcgtggaggcgatggcgccgctgtacacggcggcggtgctgggctacgcgtcggtgcggtggctcaaggccttctccgacgagcagtgcgcggggatcaaccacttcgtggcgctctacgccgtccccgtgctcatcttccacatggtctccaccaacgacccctaccacatgaacgagcgcctcatcgccgccgacacgctgcagaaggccgtcatgctgctggcgctcacggcctgggccttctggtcccacttccgcaggcggcgtgacggcaaggcgtcgtcggcgtcggcggcgtcgccgatcaagtgggtggtgaccaacttctcggtggcgtcgctgcccaacaccatcatcatgggcgtgccgctcctggacggcatgtacgggtccgtctccggcgggctcatgaagcagatcgtcgtcatgcagttctgcatctggtacaacgtcgtcatcttcctctacgagttcatggcggcgcgggacggcaccgccaagatcagccccgccaccgtgccgccggcggcggcggcggccgagaatcgcgaccgtgtcatcatcgacgaaaacggcggaagcagtattcatgaacatgaccaccgtagccatcaccaggtggtcgtcaacattgagatcacggaggtggcggcggcggcagttgcgtcgacgcccactgcaccagtcgacggcgcggcggccgcgaaggagctgatgagcgcagacgacgctggagatggagatgcagatgctaacaataacaaggcggccgtggatgtcgtcccgccgccaacgccggtccagccgcaggtgccgtcggtgatgcacgtcgtgtggatggccacgaagaagcttctccagattccgaatacctatgccagtttccttggcctcatctggtctctcatggcattcaagattggattctcaatgccaaaaattgttggtgactctctgttcatcatctacacaaccgcagttgggctgagcatgttcgcttcagggacgttcatagcgcggcagtcgcggttcgtgccatgcggctacaccatcgcgtcgctctccatggtcctcaagttcctgattggcccgatcatcatgctgctcgcctcgctggccgttggaatgcacggcacccttctgcacattgctgttgtacaggcggctctccccctggccgtgacctcattcgtgtatgcggaggagtacaaggtccacgccgacatcatgagcactggggttattctcgggatatttatctcgctgcccgtcacaattgtgtactacatactgctcggcctttga

SEQ ID NO: 11468 - protein, 444 aa, Sorghum bicolor
  misc_feature: Ceres ANNOT ID no. 6015771
  misc_feature (9)..(439): Pfam Id: Mem_trans Pfam Desc: Membrane transport protein
  misc_feature (1)..(262): NCBI GI: 75110110 NCBI Desc: probable auxin efflux carrier component 5 (ospin5)
  misc_feature (1)..(199): NCBI GI: 75116026 NCBI Desc: probable auxin efflux carrier component 1c (ospin1c)
  misc_feature (1)..(199): NCBI GI: 75251559 NCBI Desc: auxin efflux carrier component 1 (ospin1) (ethylene insensitive root 1 homolog)
  misc_feature (1)..(199): NCBI GI: 42556526 NCBI Desc: auxin transporter pin1 [triticum aestivum]
  misc_feature (231)..(444): NCBI GI: 10441744 NCBI Desc: pin1-like auxin transport protein [populus tremula x populus tremuloides]
MIPGSAVYHVVEAMAPLYTAAVLGYASVRWLKAFSDEQCAGINHFVALYAVPVLIFHMVSTNDPYHMNERLIAADTLQKAVMLLALTAWAFWSHFRRRRDGKASSASAASPIKWVVTNFSVASLPNTIIMGVPLLDGMYGSVSGGLMKQIVVMQFCIWYNVVIFLYEFMAARDGTAKISPATVPPAAAAAENRDRVIIDENGGSSIHEHDHRSHHQVVVNIEITEVAAAAVASTPTAPVDGAAAAKELMSADDAGDGDADANNNKAAVDVVPPPTPVQPQVPSVMHVVWMATKKLLQIPNTYASFLGLIWSLMAFKIGFSMPKIVGDSLFIIYTTAVGLSMFASGTFIARQSRFVPCGYTIASLSMVLKFLIGPIIMLLASLAVGMHGTLLHIAVVQAALPLAVTSFVYAEEYKVHADIMSTGVILGIFISLPVTIVYYILLGL

SEQ ID NO: 11469 - DNA, 1467 bp, Sorghum bicolor
  misc_feature: Ceres ANNOT ID no. 6015787
  misc_feature: Encodes the peptide sequence at SEQ ID NO 11470
atgacaagggtcatccatgactccggagatgacatgcacaaggaggcacttgatttggtctcatcggatgttaactttcccaagggccgtttcccagactacaggattggaccaaacaaccaaatcattgatccagaggagactcatgaggctgtacctctcaaggagattgttgcaaaggaaacagcacagttgctagagcagcacaagcgcctttctgtgcgtgatctcaaagagaagtttgagaagggtctatctggcgcttccaagctttctgaagaggctaagcgtcgagaagccgcttcattagacaggcaggttcttctgaagaagctcagagatgttttagacacactgaaaggccgtgtggctggtcgaaatagagacgatgctgaggaagctatctcactggtggaggctctagctgtccagctgacacaacgagaaggggagttaatttatgagaaggctgaagtaaaaaaattggctaacttccttaagcaggctactgaagatgcacggaaagtagctgaagaggaaagggctcttgcgcttgctgaaattgaaaaggctagagctgcgatcgaaaaagtcgagaaagcattgcacgtgcatgattctgcgtcaagtagcagagagaaggaggagatagaggaacttaggaaagaggtccgagaggctaggagaataaaaatgctacaccagccaagcaaggtcatggacatggagtttgagcttcaggcactgcggactctcatctcagagaagactcaactatgcaatcagctaaagaaagagcttgccatgatcaagaggttagaagaggatagttctgacctctttgagctcgaaggttctaatacccttggatcacagttttgtattgtccctcgagttgatggtgctccgaacattgcgaactgtccaattcagtggtatcgtgtaatttctggaggcactagagaactcatatcaggagcaacaaaatttacgtatgccccagagccgtttgatgttggccgattattgcaagcagagatacttttgaatgcggacagaattgtagttcagacagatggccctatagataacggacttcaacgctatgcggactcacttatgaaaaggacggatattgagttcaatgtagtagtaacccaaatgaatgggaaggattactcgtcgaattctgtccatgtatttcacattggaaagctgagaataaaacttcgaaaaggatggtctacaaaggcaagagagtcatattccactatgatgaagttatgtgggagccgtggtggtggtaatgctgcagctagggcagttttctggcaagctaggaaaggcttgtcctacactctagctttcgaaacagacagggacaggaatgctgcaattatgattgctcgcaagtttgcttcgaactgcaatatcgctctcgctggcccaggcgaccaaggcacctga

SEQ ID NO: 11470 - protein, 488 aa, Sorghum bicolor
  misc_feature: Ceres ANNOT ID no. 6015787
  misc_feature (1)..(486): NCBI GI: 115440567 NCBI Desc: os01g0805700 [oryza sativa (japonica cultivar-group)]
  misc_feature (12)..(486): NCBI GI: 55296828 NCBI Desc: plectin-related protein-like [oryza sativa (japonica cultivar-group)]
  misc_feature (20)..(428): NCBI GI: 42569815 NCBI Desc: proline-rich family protein [arabidopsis thaliana]
  misc_feature (249)..(486): NCBI GI: 115453143 NCBI Desc: os03g0364500 [oryza sativa (japonica cultivar-group)]
  misc_feature (50)..(285): NCBI GI: 1477646 NCBI Desc: plectin [homo sapiens]
  misc_feature: Useful for making plants with altered alkaloid content
  misc_feature: Useful for making plants with altered terpenoid content
  misc_feature: GREAT-hit functional homolog of the protein sequence given in SEQ ID NO 13203
  misc_feature: Useful for making plants with altered alkaloid content
  misc_feature: Useful for making plants with altered terpenoid content
  misc_feature: Functional homolog of the protein sequence given in SEQ ID NO 13203
MTRVIHDSGDDMHKEALDLVSSDVNFPKGRFPDYRIGPNNQIIDPEETHEAVPLKEIVAKETAQLLEQHKRLSVRDLKEKFEKGLSGASKLSEEAKRREAASLDRQVLLKKLRDVLDTLKGRVAGRNRDDAEEAISLVEALAVQLTQREGELIYEKAEVKKLANFLKQATEDARKVAEEERALALAEIEKARAAIEKVEKALHVHDSASSSREKEEIEELRKEVREARRIKMLHQPSKVMDMEFELQALRTLISEKTQLCNQLKKELAMIKRLEEDSSDLFELEGSNTLGSQFCIVPRVDGAPNIANCPIQWYRVISGGTRELISGATKFTYAPEPFDVGRLLQAEILLNADRIVVQTDGPIDNGLQRYADSLMKRTDIEFNVVVTQMNGKDYSSNSVHVFHIGKLRIKLRKGWSTKARESYSTMMKLCGSRGGGNAAARAVFWQARKGLSYTLAFETDRDRNAAIMIARKFASNCNIALAGPGDQGT

SEQ ID NO: 11471 - DNA, 1158 bp, Sorghum bicolor
  misc_feature: Ceres ANNOT ID no. 6015803
  misc_feature: Encodes the peptide sequence at SEQ ID NO 11472
atgatcctggtgcggcgcctggcgggggccacccgcccgcggggcctcgctggtcgaggcctcgcgtcgcggacctcgggggcgccgcgggaggcggcggacgccgtggtggtgggcgcgggcgtcgtcggcctcgcggcggcgcgggcgctggcgatggccgggcgcgaggtggtcgtggtcgaggcggcccccagcttcggcaccggcgccagttcccgtaacagcgaggtcatccacgccggcatctactaccctccgcgaagcctcaaggctaccctttgtgtaaggggaaaggaaatgctctacaagtactgcaaagaacgaggtgttgcccacaaacgaatcagcaaactcatcgttgccactggtgctgcagaggttccaaagctggacatgctcctcaggaatgccaaagaaaatggggtggatgatcttcagttgatggagggttctgaagctatggagatggaacctgagcttcgatgccttaaagctttactatcacctagtactgggataattgactctcattcactcatgctctcccttttggctgatgctgaaaacttgggaacaactgtatcatataacacagcagttatcagtgcacatgttggatccgaaggccttgaactccatgtttgcgaaagcaaagagctgcagaactgtcatgcatttgtgcccactcctcactatgcgcgtggatgttacttcaccctctctcaaaccaagagtcctttcaggcgcttaatatatcctctgccagaggatggtggcataggggtccatgtcactatagatatgaacggccttgtcagatttggtccagacgttgaatggatatctgatggtggaaaggaccatgtgtcatgttttctgaataagtttgattactcagtaaatcccaaccgctgttctgtattttaccctgtggtaaggaagtattttccaaatctcaaggatgggtctttggaacctggttattctgggatccgaccaaagctttctggtcctggacaacccccttcagattttgttattcagggatgggatgtccatggtattcctggactggttaatttgtttggaatagaatcccctggtttgacatcaagcttggcaattgctgaacacattgtttcaaaatatttgtga

SEQ ID NO: 11472 - protein, 385 aa, Sorghum bicolor
  misc_feature: Ceres ANNOT ID no. 6015803
  misc_feature (34)..(383): Pfam Id: DAO Pfam Desc: FAD dependent oxidoreductase
  misc_feature (31)..(382): NCBI GI: 120611122 NCBI Desc: fad dependent oxidoreductase [acidovorax avenae subsp. citrulli aac00-1]
  misc_feature (31)..(383): NCBI GI: 46241704 NCBI Desc: glycerol-3-p dehydrogenase-like protein [azospirillum brasilense]
  misc_feature (31)..(222): NCBI GI: 146284326 NCBI Desc: oxidoreductase, fad-binding family protein [pseudomonas stutzeri a1501]
  misc_feature (31)..(380): NCBI GI: 118733824 NCBI Desc: fad dependent oxidoreductase [delftia acidovorans sph-1]
  misc_feature (31)..(383): NCBI GI: 73540954 NCBI Desc: fad dependent oxidoreductase [ralstonia eutropha jmp134]
MILVRRLAGATRPRGLAGRGLASRTSGAPREAADAVVVGAGVVGLAAARALAMAGREVVVVEAAPSFGTGASSRNSEVIHAGIYYPPRSLKATLCVRGKEMLYKYCKERGVAHKRISKLIVATGAAEVPKLDMLLRNAKENGVDDLQLMEGSEAMEMEPELRCLKALLSPSTGIIDSHSLMLSLLADAENLGTTVSYNTAVISAHVGSEGLELHVCESKELQNCHAFVPTPHYARGCYFTLSQTKSPFRRLIYPLPEDGGIGVHVTIDMNGLVRFGPDVEWISDGGKDHVSCFLNKFDYSVNPNRCSVFYPVVRKYFPNLKDGSLEPGYSGIRPKLSGPGQPPSDFVIQGWDVHGIPGLVNLFGIESPGLTSSLAIAEHIVSKYL

SEQ ID NO: 11473 - DNA, 678 bp, Sorghum bicolor
  misc_feature: Ceres ANNOT ID no. 6015804
  misc_feature: Encodes the peptide sequence at SEQ ID NO 11474
atgtcgtcgctgcggaatgcgatcccgcggcgcgctcacaaggagcgctcccagccggaggcgaggaagaagtttgggcttttggagaagcacaaggactatgtcgtccgggcgcgggcttaccacatcaaggaggcaaccatcgcgaaattgaaggagaaggcagcatttaggaacccggatgagttctactttaaaatgatcaacagtaggactgttggtggaattcatagacctaagcctgaagataataagtatacagaagaggaacttcttctgttgaaaaataaagatatgggatatatccttcagagcattcaaagtgaaaaaaagaaaatcgaaaagttaagctcaacacttcatgaactggataacaagcctcaaaacaagcatgtttattttgctgaagacagagaagaagcgaaagaaatacaatcaaggataggacaaagcaacaacatgcctggtcttgacaacatcccttctcgtataaagaaggagttagaagagaggaagcagcggcttcaaaagcttgagaaattgtatgcagacatggcattgcaaaaagaattgaagaaacctggacgcaagaggaaactgaaactcaatgaagatgaggagacggataatcaaacatcacagcctgtttataagtggcgagcacagaggaagcggtga

SEQ ID NO: 11474 - protein, 225 aa, Sorghum bicolor
  misc_feature: Ceres ANNOT ID no. 6015804
  misc_feature (10)..(225): Pfam Id: Utp11 Pfam Desc: Utp11 protein
  misc_feature (1)..(225): NCBI GI: 73621302 NCBI Desc: probable u3 small nucleolar rna-associated protein 11 (u3 snorna-associated protein 11)
  misc_feature (1)..(225): NCBI GI: 122890850 NCBI Desc: utp11-like, u3 small nucleolar ribonucleoprotein (yeast) [danio rerio]
  misc_feature (1)..(225): NCBI GI: 41053383 NCBI Desc: cgi-94 protein [danio rerio]
  misc_feature (1)..(225): NCBI GI: 116128422 NCBI Desc: ensangp00000013368 [anopheles gambiae str. pest]
  misc_feature (1)..(215): NCBI GI: 95102926 NCBI Desc: utp11-like u3 small nucleolar ribonucleoprotein [bombyx mori]
MSSLRNAIPRRAHKERSQPEARKKFGLLEKHKDYVVRARAYHIKEATIAKLKEKAAFRNPDEFYFKMINSRTVGGIHRPKPEDNKYTEEELLLLKNKDMGYILQSIQSEKKKIEKLSSTLHELDNKPQNKHVYFAEDREEAKEIQSRIGQSNNMPGLDNIPSRIKKELEERKQRLQKLEKLYADMALQKELKKPGRKRKLKLNEDEETDNQTSQPVYKWRAQRKR

SEQ ID NO: 11475 - DNA, 714 bp, Sorghum bicolor
  misc_feature: Ceres ANNOT ID no. 6015846
  misc_feature: Encodes the peptide sequence at SEQ ID NO 11476
atgtcggcggcggatcttcccgacgagctgtgggcgcgcgtgctggagctgggagccgcgtcgtccgcgctggggttccgcgacctctgctgcctcgccatcgcttcccgccgcctcggacgcctctccgtccaccccaccctctggtcggaactcctctctcgcgacttcccctcccagtccacgtcctcgtcctccacctcccagccgcagcagcagctccaccccaaatccctttacaagaccaagtttgagaggcacaaggtgcggatggcggaggcgaggcggcgagctgtgttcgaggcggaggcgcgggtgctggcttccaggaggcggctggcggagctggaggggtccattcgggaagagggggacaagatgaagacggctgcgcaggagctcgacaacctcgagagagtcaggagagcttctgtggcattaaacgtatggcaaccacaagttgttcgtgggcgtcagaagcagttggttcagcaatgcacagttcctgttgattctcgtctcagtgatctaaacatggaactgaaagtttgtaagcaacaaatagcaacttataagaattcttatagcaaagagaagcacaagttgaatgattatgaggaagcattgcaacgagcaaagtatcacccactgcaggatagttatgcaagtggacttgtcaatgagccacgtgcaaagaggaagaaactgaaataa

SEQ ID NO: 11476 - protein, 237 aa, Sorghum bicolor
  misc_feature: Ceres ANNOT ID no. 6015846
  misc_feature (1)..(237): NCBI GI: 145323808 NCBI Desc: f-box family protein [arabidopsis thaliana]
  misc_feature (1)..(237): NCBI GI: 9802559 NCBI Desc: f22o13.19 [arabidopsis thaliana]
MSAADLPDELWARVLELGAASSALGFRDLCCLAIASRRLGRLSVHPTLWSELLSRDFPSQSTSSSSTSQPQQQLHPKSLYKTKFERHKVRMAEARRRAVFEAEARVLASRRRLAELEGSIREEGDKMKTAAQELDNLERVRRASVALNVWQPQVVRGRQKQLVQQCTVPVDSRLSDLNMELKVCKQQIATYKNSYSKEKHKLNDYEEALQRAKYHPLQDSYASGLVNEPRAKRKKLK

SEQ ID NO: 11477 - DNA, 1113 bp, Sorghum bicolor
  misc_feature: Ceres ANNOT ID no. 6015911
  misc_feature: Encodes the peptide sequence at SEQ ID NO 11478
atgtggacacccatgtcttttattggcctccgctcggctgtgattgctgcagcagccgtgaagaaatgggcaaaattttgcagcgattttactgcgagtgatggaaaacagcatgcattgcttgataatctgaataaggatttgtcccagaagtctgtaatactgggtgatggtttaaaactatcggctgctgataatgatgtgtttgcaactgttcatccttttgtgattcgtgttagtgacagcgagttgcagaaatatacacatgtattgcggtggatggactacattcagaacactgttggttctggtacaactttgcaaaagataaatgtggtcaagtctgtctttgatccaccttctcatccaaagaaagctgataaaggagatgctgaatcaagttcgaagaaagccatttccggacagaagactgctgacaagtcaaatggaagtgctgactcaaagaaacctgcaggggagactaagcctcctgaaaataaggagaatcctactgctgcggggaacaacaaaacctctggagagaaaaagaaagataaagagaagtcagcaggaaaaacagcagagaaagctccagagaaagttgcagacaaggaatcagagtgcaatatcagtatcctgaatatacaggttggccttatccgcaaagcatggaagcacccatctgctgacagccttttggttgaggagatagatttgggagatggtaatgtgcgtcaagttgttagtggtcttgcgaagtactgcagcccagatgatctaactaatcggcatgttgtcttgatcacgaatgtgaagcctgggaagctgcgggatgttatgtctgctggattggtcttgtgtgcttcaactgaagatcatactgctgtggagcctttgattcctcccgaaggagccaagattggagaacgcatttcatttgctgggtttgatgggaagcctgaagatgttctaaatccaaagaaaaagcagctggacaagattactccgcatcttcgtactgatgagaatggaattgcaacattcaaaggtgtaccctttactacatcagctggcccatgtagatcttcgattcgcaacggaaatgttaagtga

SEQ ID NO: 11478 - protein, 370 aa, Sorghum bicolor
  misc_feature: Ceres ANNOT ID no. 6015911
  misc_feature (215)..(310): Pfam Id: tRNA_bind Pfam Desc: Putative tRNA binding domain
  misc_feature (13)..(369): NCBI GI: 4140281 NCBI Desc: aminoacyl-trna synthetase cofactor [euplotes octocarinatus]
  misc_feature (120)..(370): NCBI GI: 115468260 NCBI Desc: os06g0508700 [oryza sativa (japonica cultivar-group)]
  misc_feature (120)..(370): NCBI GI: 109940177 NCBI Desc: probable methionyl-trna synthetase (methionine--trna ligase) (metrs)
  misc_feature (120)..(370): NCBI GI: 54290977 NCBI Desc: methionyl-trna synthetase [oryza sativa (japonica cultivar-group)]
  misc_feature (120)..(370): NCBI GI: 4091008 NCBI Desc: methionyl-trna synthetase [oryza sativa]
MWTPMSFIGLRSAVIAAAAVKKWAKFCSDFTASDGKQHALLDNLNKDLSQKSVILGDGLKLSAADNDVFATVHPFVIRVSDSELQKYTHVLRWMDYIQNTVGSGTTLQKINVVKSVFDPPSHPKKADKGDAESSSKKAISGQKTADKSNGSADSKKPAGETKPPENKENPTAAGNNKTSGEKKKDKEKSAGKTAEKAPEKVADKESECNISILNIQVGLIRKAWKHPSADSLLVEEIDLGDGNVRQVVSGLAKYCSPDDLTNRHVVLITNVKPGKLRDVMSAGLVLCASTEDHTAVEPLIPPEGAKIGERISFAGFDGKPEDVLNPKKKQLDKITPHLRTDENGIATFKGVPFTTSAGPCRSSIRNGNVK

SEQ ID NO: 11479 - DNA, 1548 bp, Sorghum bicolor
  misc_feature: Ceres ANNOT ID no. 6015958
  misc_feature: Encodes the peptide sequence at SEQ ID NO 11480
atgatggccaccgagccctcgtccccggtgagccccgtcgaggacctagacacactacccctcgaatcctcctcctccagtgtcggtgtcgcggccacgaccgaccccctgctccgcccacctcctcctccctcgtccacctcctcacccaccgccggcgagaaccacggcgtgtttctggacgaggaggacgaggatggggtggaggacttcacgcctcccccggctccccacaccgctgcggccgcgacgaagtcccgcgaggcgtcgccggggttcgctgagatcactgtctccgagcctaggaagcacgcggagcctgcgaccggagccgttggcgtcattccaggctcggccaactacgtctcctacctcatcgccactcgggtgcccgacggcggcgagttccgcgtgcgtcggcgcttccgcgacgtcgtggcgctcgccgaccgcctcgcggagacacaccgtggcctcttcgtaccggcaaggcccgacaagagcatcgtcgaggggcaggtcatgcagcggcacgacttcgtgaaccagcggtgcgtcacgatccagcgctacctccgccgcctcgccgcgcaccccgttgtcggccgcagcccggtcctccacgccttccttaccgagcctagcggtatccccacttcggacggtgagtcccccaggtggagccctgagatgagtgctgccacgtccatggctgctgccactccagtgacgcctacgaagagtgggagggacttttttggggtgttcaaggacctgaagcagacagtaaccaatgggtgggtggcagtaaggccacctccagtggaggaggagatcgacaaaaagtaccttgtgcacaaggccaagcttgaggacttggagaaacatctagtgacagcatctcagcaggcagaggcatttgttaaagattatgacgatcttagagcaacgacaggtttcttgggaatgtcattcatcaaactggctaagtttgaaaaggagcaggctacgtgtagttctcagaaaagacgagctgctgacatcagtaattttgccagtgctgttgttagaactagcagatcacaggcaaaactaaatgctgaaattgtaaaacatctgggcgttatccatgagtacatggagacaatggcttctgttcataacgcttttaatgctcgttccaatgctttgcttcgtgtgcaaaatttgtcagcagaactatatttcttacgtacccgggcaggaaaacttgaatctgtatcatcgagaggaatggatcaggaaagaccaagggatcagaagatagaagaactgaaagaaacagtaagagccacggaagatgcaaaagcacatgcacttaaagaattggaacttatcaaggaaaacaacatgaatgaaattaaaagatttaacaaggaaaggcgccaggatttggtggagatgctgaaaggctttgtatcggatcaggccacatactcagatcattttgctagcatatggacaaaggtagcagaagaaacaaaaggatatgcaaaaagcagcagttga

SEQ ID NO: 11480 - protein, 515 aa, Sorghum bicolor
  misc_feature: Ceres ANNOT ID no. 6015958
  misc_feature (91)..(214): Pfam Id: PX Pfam Desc: PX domain
  misc_feature (259)..(506): Pfam Id: Vps5 Pfam Desc: Vps5 C terminal like
  misc_feature (5)..(515): NCBI GI: 115440797 NCBI Desc: os01g0827200 [oryza sativa (japonica cultivar-group)]
  misc_feature (1)..(515): NCBI GI: 115464451 NCBI Desc: os05g0474500 [oryza sativa (japonica cultivar-group)]
  misc_feature (66)..(515): NCBI GI: 30681754 NCBI Desc: phox (px) domain-containing protein [arabidopsis thaliana]
  misc_feature (275)..(507): NCBI GI: 60502217 NCBI Desc: sorting nexin 1 [acetabularia peniculus]
  misc_feature (95)..(211): NCBI GI: 73621923 NCBI Desc: sorting nexin-4 (autophagy-related protein 24)
MMATEPSSPVSPVEDLDTLPLESSSSSVGVAATTDPLLRPPPPPSSTSSPTAGENHGVFLDEEDEDGVEDFTPPPAPHTAAAATKSREASPGFAEITVSEPRKHAEPATGAVGVIPGSANYVSYLIATRVPDGGEFRVRRRFRDVVALADRLAETHRGLFVPARPDKSIVEGQVMQRHDFVNQRCVTIQRYLRRLAAHPVVGRSPVLHAFLTEPSGIPTSDGESPRWSPEMSAATSMAAATPVTPTKSGRDFFGVFKDLKQTVTNGWVAVRPPPVEEEIDKKYLVHKAKLEDLEKHLVTASQQAEAFVKDYDDLRATTGFLGMSFIKLAKFEKEQATCSSQKRRAADISNFASAVVRTSRSQAKLNAEIVKHLGVIHEYMETMASVHNAFNARSNALLRVQNLSAELYFLRTRAGKLESVSSRGMDQERPRDQKIEELKETVRATEDAKAHALKELELIKENNMNEIKRFNKERRQDLVEMLKGFVSDQATYSDHFASIWTKVAEETKGYAKSSS

SEQ ID NO: 11481 - DNA, 945 bp, Sorghum bicolor
  misc_feature: Ceres ANNOT ID no. 6015971
  misc_feature: Encodes the peptide sequence at SEQ ID NO 11482
atggcggcagccggggacgccggcggcctcctcgtctgcgtgacgggcgccagcggcttcattggctcctggctcgtccgctgcctccttgaccgcggctacaccgtccacgccaccgtcaagaacctccaagatgagggcgagacgaagcacttgcaggccatgggcggcgccgacgcgcgtctccggctgttccagatggacctcgtcgaccctgcttccgttcagccagcgatcgaaggcgcccacggcgcagaagatccggagaaggagctgctggaacctgcggtgaagggcacgctcaacgtgctgcgagcagcgaaagattgtggagtcggccgcgttgtgctcatgtcgtcacaggcggccatggtgcccaatcccaactggcctccgggtaaggtcatagatgatgactgttgggcagacgttgagctgctcaagaagcttcagctctggtacagcgtttctaaaacactggcagagaaggctgcatgggattttgccgaaaaggaggagttgcagatagctgtgctcaatccagggatggtattgggcccaatgttaacaccatcagtgaacgccagcctgcgtctcttgctgcaaattctgggaggcgagaggattgacttggacgacatctacatgggttgtgttgatgtgagagacgtcgcgcactctctgataatgttgtacgagaacccatcagcacaaggacgccacttatgcatggaatccgctgaacgcctggttgatttggccaataagattgctgatctttaccctgaacacccagttcagagaatccgggaggacaagcaagggtgggtggtgagagcaaaggacccttccaagaaattgatcaaattgggtgttcgtttcactccactggacaaaaccatcagggacaccgtggattgttttaggagcaaaggactcatctag

SEQ ID NO: 11482 - protein, 314 aa, Sorghum bicolor
  misc_feature: Ceres ANNOT ID no. 6015971
  misc_feature (12)..(254): Pfam Id: Epimerase Pfam Desc: NAD dependent epimerase/dehydratase family
  misc_feature (14)..(228): Pfam Id: NAD_binding_4 Pfam Desc: Male sterility protein
  misc_feature (13)..(266): Pfam Id: 3Beta_HSD Pfam Desc: 3-beta hydroxysteroid dehydrogenase/isomerase family
  misc_feature (10)..(147): Pfam Id: adh_short Pfam Desc: short chain dehydrogenase
  misc_feature (91)..(314): NCBI GI: 115440809 NCBI Desc: os01g0828100 [oryza sativa (japonica cultivar-group)]
  misc_feature (11)..(314): NCBI GI: 68159360 NCBI Desc: cinnamoyl-coa reductase [acacia mangium x acacia auriculiformis]
  misc_feature (11)..(314): NCBI GI: 92897570 NCBI Desc: lipocalin [medicago truncatula]
  misc_feature (9)..(312): NCBI GI: 57282092 NCBI Desc: cinnamoyl-coa reductase [linum album]
  misc_feature (9)..(314): NCBI GI: 28544961 NCBI Desc: cinnamoyl-coa reductase [zea mays]
  misc_feature: Useful for making plants with altered cell wall content and/or composition
  misc_feature: Functional homolog of the protein sequence encoded by LOCUS at5g58490
  misc_feature: Useful for making plants with altered carbohydrate content
  misc_feature: Functional homolog of the protein sequence given in SEQ ID NO 13679
  misc_feature: The sequence is a functional homolog of SEQ ID NO. 453 in the 11/188,298 US application
MAAAGDAGGLLVCVTGASGFIGSWLVRCLLDRGYTVHATVKNLQDEGETKHLQAMGGADARLRLFQMDLVDPASVQPAIEGAHGAEDPEKELLEPAVKGTLNVLRAAKDCGVGRVVLMSSQAAMVPNPNWPPGKVIDDDCWADVELLKKLQLWYSVSKTLAEKAAWDFAEKEELQIAVLNPGMVLGPMLTPSVNASLRLLLQILGGERIDLDDIYMGCVDVRDVAHSLIMLYENPSAQGRHLCMESAERLVDLANKIADLYPEHPVQRIREDKQGWVVRAKDPSKKLIKLGVRFTPLDKTIRDTVDCFRSKGLI

SEQ ID NO: 11483 - DNA, 699 bp, Sorghum bicolor
  misc_feature: Ceres ANNOT ID no. 6015973
  misc_feature: Encodes the peptide sequence at SEQ ID NO 11484
atggctcccaatcccaaaccgcaaccgcctcttcgtcttcttcccctcgtcctgctctgcctatccccggcatgcgccgccgggagagtcccggtttcggtctactacgagacgctgtgcccgttctgctccgcgtttgtcgtgaacgacctctccagggtcttccgcaacgggatctcctccattgctgacctgcggctcgtccctttcggcaatgggcgtgtctccgccgacgggaccatcacttgccagcatggagaggaggagtgccaactcaacgccatagaagcttgtgtgatcagaatatggcctgatgcggaacagcatttccctttcattcaatgtgttgagcatttagcactgactcggaaatgggacgcctggcaggcttgctttcaggaaactggtctcccatatcaacctgctattgactgctacaactcaggatatggcaggcagctcgtactccagtatgctgccgagacaaatgctctgcagcctcctcatcagtttgtaccttgggtggtcgtcaacggcaaaccactcggtgatgattacatgaactttgaggcctacatctgcagcgcttatgatggcaagcttccagaggcatgcaaggggaagcacctagcaattgctcaagagacgaaagccagcagaggagacaaggtgtgcccagctagcaaaactatcagctaa

SEQ ID NO: 11484 - protein, 232 aa, Sorghum bicolor
  misc_feature: Ceres ANNOT ID no. 6015973
  misc_feature (30)..(139): Pfam Id: GILT Pfam Desc: Gamma interferon inducible lysosomal thiol reductase (GILT)
  misc_feature (29)..(205): NCBI GI: 15809756 NCBI Desc: at1g07080/f10k1_15 [arabidopsis thaliana]
  misc_feature (29)..(206): NCBI GI: 30793446 NCBI Desc: 27k protein [triticum aestivum]
  misc_feature (27)..(220): NCBI GI: 18413888 NCBI Desc: gamma interferon responsive lysosomal thiol reductase family protein / gilt family protein [arabidopsis thaliana]
  misc_feature (30)..(205): NCBI GI: 37572313 NCBI Desc: legumaturain [homo sapiens]
  misc_feature (30)..(205): NCBI GI: 21411337 NCBI Desc: interferon, gamma-inducible protein 30, preproprotein [homo sapiens]
MAPNPKPQPPLRLLPLVLLCLSPACAAGRVPVSVYYETLCPFCSAFVVNDLSRVFRNGISSIADLRLVPFGNGRVSADGTITCQHGEEECQLNAIEACVIRIWPDAEQHFPFIQCVEHLALTRKWDAWQACFQETGLPYQPAIDCYNSGYGRQLVLQYAAETNALQPPHQFVPWVVVNGKPLGDDYMNFEAYICSAYDGKLPEACKGKHLAIAQETKASRGDKVCPASKTIS

SEQ ID NO: 11485 - DNA, 402 bp, Sorghum bicolor
  misc_feature: Ceres ANNOT ID no. 6015988
  misc_feature: Encodes the peptide sequence at SEQ ID NO 11486
atgggtggcgggagctgctgcgtctgcaaggaggcgccgcccaagtacaagtgcccctcctgccgcacgccctattgctctgtcacatgctttaaaaagcacaaagaggaatcttgccaaaagacatcgcctcaggaagaaattagcaagtcaccactgcaggaggaagttaaatctccaaatacagtgggccctacaaaagctcttgaagttgaggacccaagctgggttgttgacaacaatagactaaggtctttagcggaactgaaagggatccaagatgctctcagggatcctgaactgcagaaaatgatacttaaaattgatgggtctttggaaccagaaaaagaattggagaaattgatggaaggtcaagcttttggccagttcgctgataagtag

SEQ ID NO: 11486 - protein, 133 aa, Sorghum bicolor
  misc_feature: Ceres ANNOT ID no. 6015988
  misc_feature (2)..(32): Pfam Id: zf-HIT Pfam Desc: HIT zinc finger
  misc_feature (6)..(132): NCBI GI: 703110 NCBI Desc: thyroid receptor interactor
  misc_feature (6)..(132): NCBI GI: 119577956 NCBI Desc: zinc finger, hit type 3, isoform cra_a [homo sapiens]
  misc_feature (6)..(132): NCBI GI: 62511206 NCBI Desc: thyroid receptor interacting protein 3 (trip-3) (thyroid hormone receptor interactor 3)
  misc_feature (14)..(132): NCBI GI: 62511207 NCBI Desc: thyroid receptor interacting protein 3 (trip-3) (thyroid hormone receptor interactor 3)
  misc_feature (6)..(132): NCBI GI: 125812026 NCBI Desc: ga20895-pa [drosophila pseudoobscura]
MGGGSCCVCKEAPPKYKCPSCRTPYCSVTCFKKHKEESCQKTSPQEEISKSPLQEEVKSPNTVGPTKALEVEDPSWVVDNNRLRSLAELKGIQDALRDPELQKMILKIDGSLEPEKELEKLMEGQAFGQFADK

SEQ ID NO: 11487 - DNA, 1293 bp, Sorghum bicolor
  misc_feature: Ceres ANNOT ID no. 6016011
  misc_feature: Encodes the peptide sequence at SEQ ID NO 11488
atgtcgcctttgttcagacactgctgtgcctttggaagtcatcatcctcatcccttaatttggaggagcatcttccaaacatcgggaagagaacaaaaacaaatcaggagttggagggcacagtgctcagcaaatcaggatcaagcttctatagagaaaagcaatgctccaaagaatttagcaatacctgatgattcacttctcgatgctcgtattctctattgtacctctcctgccctgggtcataacaaagaagcccatccagaatctaacaaaagagttcctgcaatagttgatgctcttgagaaattggagcttagtcccaagcatcgtggttcacaggttcttgaaattcaaaatttcaacccggcttctctagatgatgttgcacgagttcattcaagatcttacatcactggactcgaaaaggctatgcgtagagcttcagatgaaggtctgatatttattgaagggactggaccaacatacgctacagagactactttccaagaatcacttctatcagctggtgccggcatcacattggttgattcagtggtcgcagcgtcaaagttaggtcctaatccgccccttggctttgctttagtaaggccaccaggacatcatgctgttcctcaaggtcccatgggtttttgtgtctttgggaacatcgcagtggcagctcggtacgctcagcatcaacatggactaaagcgtgtgatgataatagattttgatgttcaccatggcaatgggacatccgatgcattttatgttgatccagacatattcttcctctcaactcaccagcttggaagctaccctggtactggtaagatcaatgaagtcgggcagggtgatggtgaaggcacgacactcaaccttcctctgcccggtggtgcaggtgactacgcaatgagatatgcatttgatgaggtcattgctccatcggctcatcgattcaagcctgatataatccttgtctcagccggatacgatgcacacgtgctggaccctctggctggcctgcagttcacaacaggcacgttctacatgttggcattcagcatcaagcagctggcgaaggaactctgtggtggccgctgtgtcttcttcctggaaggcgggtacaacctgcagtcgctctccagctctgttgccgacacgttccgtgcattccttgatgagaccagcctcgcagcacagttcgatgatccagcgatactttttgaagagccaactcggaagatcaaagacgcaattgagaaggccaagggcatccactcactctag

SEQ ID NO: 11488 - protein, 430 aa, Sorghum bicolor
  misc_feature: Ceres ANNOT ID no. 6016011
  misc_feature (71)..(399): Pfam Id: Hist_deacetyl Pfam Desc: Histone deacetylase domain
  misc_feature (49)..(430): NCBI GI: 21360523 NCBI Desc: at4g33470/f17m5_230 [arabidopsis thaliana]
  misc_feature (41)..(232): NCBI GI: 62642129 NCBI Desc: histone deacetylase [picea abies]
  misc_feature (123)..(424): NCBI GI: 116753988 NCBI Desc: histone deacetylase superfamily [methanosaeta thermophila pt]
  misc_feature (113)..(407): NCBI GI: 118063046 NCBI Desc: histone deacetylase superfamily [roseiflexus castenholzii dsm 13941]
  misc_feature (80)..(399): NCBI GI: 52550445 NCBI Desc: acetoin utilization protein [uncultured archaeon gzfos9d1]
MSPLFRHCCAFGSHHPHPLIWRSIFQTSGREQKQIRSWRAQCSANQDQASIEKSNAPKNLAIPDDSLLDARILYCTSPALGHNKEAHPESNKRVPAIVDALEKLELSPKHRGSQVLEIQNFNPASLDDVARVHSRSYITGLEKAMRRASDEGLIFIEGTGPTYATETTFQESLLSAGAGITLVDSVVAASKLGPNPPLGFALVRPPGHHAVPQGPMGFCVFGNIAVAARYAQHQHGLKRVMIIDFDVHHGNGTSDAFYVDPDIFFLSTHQLGSYPGTGKINEVGQGDGEGTTLNLPLPGGAGDYAMRYAFDEVIAPSAHRFKPDIILVSAGYDAHVLDPLAGLQFTTGTFYMLAFSIKQLAKELCGGRCVFFLEGGYNLQSLSSSVADTFRAFLDETSLAAQFDDPAILFEEPTRKIKDAIEKAKGIHSL

SEQ ID NO: 11489 - DNA, 396 bp, Sorghum bicolor
  misc_feature: Ceres ANNOT ID no. 6016080
  misc_feature: Encodes the peptide sequence at SEQ ID NO 11490
atggcaccgacgcaggccaagtcaggtctcttcgtcggcataaacaagggacacgttgtcaccaagcgcgagctgccgcttcgcccgtccgaccgcaaggggaaagctaccaagagggtgacattcgtcagaagcttgattagggaggttgctggttttgctccctatgagaaacgcatcactgagcttctcaaagttgggaaggacaagcgtgcactcaagttggctaagaggaagcttggtactcacaagagagcaaagaagaagagagaggagatggcgaatgttgttaggaagatgagtctgtttcgtcatgatgcagtttactatgcaagtgcaaacttctttctattgtgtcatgagcctgcaatgaatcctttggcactatcttggtag

SEQ ID NO: 11490 - protein, 131 aa, Sorghum bicolor
  misc_feature: Ceres ANNOT ID no. 6016080
  misc_feature (5)..(105): Pfam Id: Ribosomal_L36e Pfam Desc: Ribosomal protein L36e
  misc_feature (1)..(100): NCBI GI: 57471698 NCBI Desc: ribosomal protein l36 [triticum aestivum]
  misc_feature (1)..(100): NCBI GI: 140060403 NCBI Desc: ribosomal protein l36e [medicago truncatula]
  misc_feature (1)..(100): NCBI GI: 21592383 NCBI Desc: 60s ribosomal protein l36-1 [arabidopsis thaliana]
  misc_feature (1)..(100): NCBI GI: 79314916 NCBI Desc: structural constituent of ribosome [arabidopsis thaliana]
  misc_feature (7)..(101): NCBI GI: 145342473 NCBI Desc: 60s ribosomal protein l36, probable [ostreococcus lucimarinus cce9901]
MAPTQAKSGLFVGINKGHVVTKRELPLRPSDRKGKATKRVTFVRSLIREVAGFAPYEKRITELLKVGKDKRALKLAKRKLGTHKRAKKKREEMANVVRKMSLFRHDAVYYASANFFLLCHEPAMNPLALSW

SEQ ID NO: 11491 - DNA, 1692 bp, Sorghum bicolor
  misc_feature: Ceres ANNOT ID no. 6016096
  misc_feature: Encodes the peptide sequence at SEQ ID NO 11492
atgggggcgatggcggaggtcgtgcaggaggggtgcgtggagaatcggcagcccctggcggcttcgagctcttccgtgtcggatggcagcagctgtggtggtggagggcgagcggggacgtcgccgcccgtgtcaagctctgggaattccatctccgttctgaggcgaacaagtggaccgataagaagagctaagggtggctggacgccggaagaggatgaaacactgcggaaggcagttgaagctttcaagggtagaaattggaaaaaaatagctgaattctttcaggacaggactgaggttcaatgtttgcatcgctggcagaaggttcttaatccggagcttatcaaaggcccttggactcaagaggaagatgaaaaaatcattgaccttgtgggcaagtatggaccaacaaaatggtctatcatcgcgaaatcattgcctggccgcataggcaagcaatgccgagagaggtggcataatcatctgaatccagaaataaggaaagatgcttggactcctgaggaggaaagggcacttattaatgctcataaagtgtttgggaataaatgggcagaaatagcaaaagctcttcctggaaggaccgataattccataaagaatcattggaacagttctttgagaaagaagttagaagcctatagtaacagcagcgttctttcagctccgaagctgtttgttcatgatgatttcaaggacaaaatgaagcccgtgggtactgacagccatcttgatctgaaccaaatgccaagcattggttcaaaagatgtccctggaagagcttatcgttccattttgagcccaccttcacaggcatacaatttggactcctcaggcttcctttctctttctataccaactgtgcagcctctaactaaatatgaaatgccatcactagttgatggttctgctgttactttggctgtacaaggtctggaaagtgattctgtccgtgacaagggcctagaaattgacgctgttcatgagaagggtgttgaggttagctcaactcctgatcctgttggggttgaattagaatctgcaccagccaaaagaggtgcagtattatcttcaaagaacgagttgcattctacccttggtcctctttgttatcagattccaaacatggaatatgtggccccaatccgtaccccgctccgttctgaatgtaatggttcacatcaaacacaacatttcatgtcacccaatggttatacttctccttctccaacgattggaaaagtatcaagtcagctaactgttgattcaattttgaggattgctgctgacagctttccaggtactccttctatactaaggaaaagaaaacgtgataaagcaacacctgcttcaggtaatgagttgaagacgggtggagtaagcaatgatagcttttacactcctaatggaactaatgggaaggacactactccacgatcatttaaaactgctgcatcctttttgtcgctgggttctgttgatgggttattgacttctgtaaggagctttgattcttcaccaccctatcagaaaaggtcaaaaagaatggctatcatcaaatcagttgagaaacagctggatttttcagcagatggactggatacttctggttctgagatgaagaactctccttgccataattcccaaggcgcaaattctaacaggacgtaa

SEQ ID NO: 11492 - protein, 563 aa, Sorghum bicolor
  misc_feature: Ceres ANNOT ID no. 6016096
  misc_feature (65)..(111): Pfam Id: Myb_DNA-binding Pfam Desc: Myb-like DNA-binding domain
  misc_feature (117)..(163): Pfam Id: Myb_DNA-binding Pfam Desc: Myb-like DNA-binding domain
  misc_feature (169)..(214): Pfam Id: Myb_DNA-binding Pfam Desc: Myb-like DNA-binding domain
  misc_feature (1)..(560): NCBI GI: 115440975 NCBI Desc: os01g0841500 [oryza sativa (japonica cultivar-group)]
  misc_feature (4)..(560): NCBI GI: 56784674 NCBI Desc: myb-like protein [oryza sativa (japonica cultivar-group)]
  misc_feature (92)..(560): NCBI GI: 56382762 NCBI Desc: transcription factor myb [oryza sativa]
  misc_feature (1)..(561): NCBI GI: 115464297 NCBI Desc: os05g0459000 [oryza sativa (japonica cultivar-group)]
  misc_feature (8)..(230): NCBI GI: 71041080 NCBI Desc: myb4 [malus x domestica]
  misc_feature: The sequence is a functional homolog of SEQ ID NO 1054 in the 10/225,066US patent application
  misc_feature: The sequence is a functional homolog of SEQ ID NO 118 in the 10/412,699US patent application
  misc_feature: The sequence is a functional homolog of SEQ ID NO 124 in the 11/375,241US patent application
  misc_feature: The sequence is a functional homolog of SEQ ID NO 144 in the 10/412,699US patent application
  misc_feature: The sequence is a functional homolog of SEQ ID NO 150 in the 10/412,699US patent application
  misc_feature: The sequence is a functional homolog of SEQ ID NO 188 in the 10/225,068US patent application
  misc_feature: The sequence is a functional homolog of SEQ ID NO 1917 in the 10/374,780US patent application
  misc_feature: The sequence is a functional homolog of SEQ ID NO 2256 in the 10/374,780US patent application
  misc_feature: The sequence is a functional homolog of SEQ ID NO 2262 in the 10/374,780US patent application
  misc_feature: The sequence is a functional homolog of SEQ ID NO 2264 in the 10/374,780US patent application
  misc_feature: The sequence is a functional homolog of SEQ ID NO 2684 in the 10/374,780US patent application
  misc_feature: The sequence is a functional homolog of SEQ ID NO 2806 in the 10/374,780US patent application
  misc_feature: The sequence is a functional homolog of SEQ ID NO 284 in the 11/479,226US patent application
  misc_feature: The sequence is a functional homolog of SEQ ID NO 772 in the 10/225,066US patent application
  misc_feature: The sequence is a functional homolog of SEQ ID NO 774 in the 10/225,066US patent application
  misc_feature: The sequence is a functional homolog of SEQ ID NO 830 in the 11/435,388US patent application
  misc_feature: The sequence is a functional homolog of SEQ ID NO 84 in the 10/225,066US patent application
  misc_feature: The sequence is a functional homolog of SEQ ID NO 844 in the 10/225,066US patent application
  misc_feature: The sequence is a functional homolog of SEQ ID NO 910 in the 11/435,388US patent application
  misc_feature: The sequence is a functional homolog of SEQ ID NO 912 in the 11/435,388US patent application
  misc_feature: Useful for making plants with modulated growth and phenotype characteristics
  misc_feature: The sequence is a functional homolog of SEQ ID NO 118 in the 20040045049 US patent application
  misc_feature: The sequence is a functional homolog of SEQ ID NO 144 in the 20040045049 US patent application
  misc_feature: The sequence is a functional homolog of SEQ ID NO 150 in the 20040045049 US patent application
  misc_feature: The sequence is a functional homolog of SEQ ID NO 774 in the 20050160493 US patent application
  misc_feature: The sequence is a functional homolog of SEQ ID NO 84 in the 20050160493 US patent application
  misc_feature: The sequence is a functional homolog of SEQ ID NO 844 in the 20050160493 US patent application
  misc_feature: The sequence is a functional homolog of SEQ ID NO 1917 in the 20060162006 US patent application
  misc_feature: Useful for making plants with modulated water use efficiency
  misc_feature: Functional homolog of the protein sequence given in SEQ ID NO 13678
  misc_feature: The sequence is a functional homolog of SEQ ID NO 2684 in the 10/374,780 US patent application
  misc_feature: The sequence is a functional homolog of SEQ ID NO 844 in the 10/225,066 US patent application
  misc_feature: The sequence is a functional homolog of SEQ ID NO. 395 in the 11/188,298 US application
MGAMAEVVQEGCVENRQPLAASSSSVSDGSSCGGGGRAGTSPPVSSSGNSISVLRRTSGPIRRAKGGWTPEEDETLRKAVEAFKGRNWKKIAEFFQDRTEVQCLHRWQKVLNPELIKGPWTQEEDEKIIDLVGKYGPTKWSIIAKSLPGRIGKQCRERWHNHLNPEIRKDAWTPEEERALINAHKVFGNKWAEIAKALPGRTDNSIKNHWNSSLRKKLEAYSNSSVLSAPKLFVHDDFKDKMKPVGTDSHLDLNQMPSIGSKDVPGRAYRSILSPPSQAYNLDSSGFLSLSIPTVQPLTKYEMPSLVDGSAVTLAVQGLESDSVRDKGLEIDAVHEKGVEVSSTPDPVGVELESAPAKRGAVLSSKNELHSTLGPLCYQIPNMEYVAPIRTPLRSECNGSHQTQHFMSPNGYTSPSPTIGKVSSQLTVDSILRIAADSFPGTPSILRKRKRDKATPASGNELKTGGVSNDSFYTPNGTNGKDTTPRSFKTAASFLSLGSVDGLLTSVRSFDSSPPYQKRSKRMAIIKSVEKQLDFSADGLDTSGSEMKNSPCHNSQGANSNRT

SEQ ID NO: 11493 - DNA, 234 bp, Sorghum bicolor
  misc_feature: Ceres ANNOT ID no. 6016123
  misc_feature: Encodes the peptide sequence at SEQ ID NO 11494
atgccggagctggagccaccgttccggccgagggagaagctgctggaggggcagatgtacttccagaacgtccacaagcacacctacttgaagggctgctacaacgccatcacgtccgtccgcatccctctcgccctggccgcctccagcttgttcctcatccattttctctgcactgggaagaagggcctaccacatgtcccgtggcatcgagaagaaggaacgaaggtctag

SEQ ID NO: 11494 - protein, 77 aa, Sorghum bicolor
  misc_feature: Ceres ANNOT ID no. 6016123
  misc_feature (11)..(67): Pfam Id: COX7a Pfam Desc: Cytochrome c oxidase subunit VIIa
  misc_feature (5)..(54): NCBI GI: 115444403 NCBI Desc: os02g0162000 [oryza sativa (japonica cultivar-group)]
MPELEPPFRPREKLLEGQMYFQNVHKHTYLKGCYNAITSVRIPLALAASSLFLIHFLCTGKKGLPHVPWHREEGTKV

SEQ ID NO: 11495 - DNA, 735 bp, Sorghum bicolor
  misc_feature: Ceres ANNOT ID no. 6016174
  misc_feature: Encodes the peptide sequence at SEQ ID NO 11496
atggtgaatgacggcgagcaatcggcgatcgccaccgccactgccgtggagcctggcgtcgtggagcggggccgcgtgagcggcggcgggcggcggctcgcgggggagagctcgggcgaagaggaggggagccagcgcttctcggatgctgaggaccggtcctggcactcgcactcgcggcaagggtcggccttggaggtctgtatctccgcgtccgcatccatcagctgcgacgccgacgccgccagtgccggcggcgtggacacggccgccgaacgcgccaggaagtcgtgcgtgtcggagtgctcgctggacgacgacgtcgtcgacctggaggccgggctggccgagatcaccaaggccagcccggacaagggtgagaggaactgccgcatctgccacctcggccttgacagcgccgccgccgagtccggcgccgggatcgtgctcggctgttcctgcaaggccgacctctcccgtgcccacaagcagtgcgccgagacctggttcaagatcagaggcaacaaggctaggagtggcatgtccccaactgtcagagaaccaatcgttataggattggtggctacaactacatggggcttggagggggatcaaaacagaaggggttcgactcagctcttcgctctagtaagccggcaggtctggaaagggaggaatgcccagttgttccatgaagaaacctcggtgatcaatcaagtgcaaaaagagctctga

SEQ ID NO: 11496 - protein, 244 aa, Sorghum bicolor
  misc_feature: Ceres ANNOT ID no. 6016174
  misc_feature (130)..(176): Pfam Id: zf-C3HC4 Pfam Desc: Zinc finger, C3HC4 type (RING finger)
  misc_feature (1)..(224): NCBI GI: 20805170 NCBI Desc: p0529h11.12 [oryza sativa (japonica cultivar-group)]
  misc_feature (92)..(176): NCBI GI: 117667936 NCBI Desc: zinc finger protein [brassica rapa]
  misc_feature (86)..(176): NCBI GI: 92875384 NCBI Desc: zinc finger, ring-type; ringv [medicago truncatula]
  misc_feature (145)..(175): NCBI GI: 15237796 NCBI Desc: zinc finger (c3hc4-type ring finger) family protein [arabidopsis thaliana]
  misc_feature (83)..(191): NCBI GI: 102139798 NCBI Desc: zinc finger (c3hc4 type ring finger) family protein [musa acuminata]
MVNDGEQSAIATATAVEPGVVERGRVSGGGRRLAGESSGEEEGSQRFSDAEDRSWHSHSRQGSALEVCISASASISCDADAASAGGVDTAAERARKSCVSECSLDDDVVDLEAGLAEITKASPDKGERNCRICHLGLDSAAAESGAGIVLGCSCKADLSRAHKQCAETWFKIRGNKARSGMSPTVREPIVIGLVATTTWGLEGDQNRRGSTQLFALVSRQVWKGRNAQLFHEETSVINQVQKEL

SEQ ID NO: 11497 - DNA, 1428 bp, Sorghum bicolor
  misc_feature: Ceres ANNOT ID no. 6016237
  misc_feature: Encodes the peptide sequence at SEQ ID NO 11498
atgccgactctccgcagcgcgacggcgaacgcgtcgtccgtggccgtgggcacgccatcccctgcggcggcgagcacgccgcgcagcgtcaagcgccggctgacgccaggccgcgccggcgagttgcccgccgcgtcgcggcacacctcccctcacagatccccgcacgccggcaccggaaccgtatgcatgccgaagctgctctccgcgtcgccgaagtcctccaggaagcgtctctacggcgaccttgtcgcagccgagaagcccaagtggaatccccgagatgccgcgcagatgagggctgtcaaggaggcgctgcacgtggcaacagtgccgtcgtctgaattggtttgccgggacaacgagctcaggcgcgtccttgagttctgtaaggctagtgttgagcaggagaaggctggtagcctctatgtctgtgggtgccctggcacagggaagacattgtctattaacaagatcaaggatagcttggtgtgttgggcggatgagatgggaatggagacacctgattccttagcaatcaattgtacaaacctagccaacacctcagagatttttggcaagatactaggaaaatttcagaaccgaaagaaaggaagcagcaaattgtcgccacttcagctggtcattgtggatgagatggactacttaataacaagagaccgtgctgtgctacatgatcttttcatgcttacgacttgtgcattctctagatgcatactaataggaattgcaaatgccatagacttagcagatcggtttcttccaaagcttgaatccttaaactgcaagcctcttgttgtgacttttcgagcatattccaaggatcaaatatctgacattgttaagcataggctaaagggtcttgagtatgatgtttttgaaccactagctctggagttttgtgctagaaaagttgcagcagcctctggtgacatgagaaaagctctaggcgtttgcaggagtgctgtggaggttcttgaagcaaggctacaagattcccctgatcaagaactaggaatagtgacatttgaccatatggatatagctttgtcaaaagcattcaagtcagcagtcatagatagcatactatgtcttccccagcaccaacagatggtgctgtgtgcgttggcaaatacttttcagcattgcaagaaaaaggctactactctaggcgagctcaacaaatcgtacattgagatttgtagatcaacccaagttccagcagttggaatgcttgaattttctaacatgtgtatggttttgagcgatcaggggttcatgaagctagggcaatccaaggaagataagcttaggagagtaacacttcagattgacagttcagatatcacttttgcctttaagggaaatcgtttctttcaaaaatgcctggagcagccaagatgctaa

SEQ ID NO: 11498 - protein, 475 aa, Sorghum bicolor
  misc_feature: Ceres ANNOT ID no. 6016237
  misc_feature (380)..(460): Pfam Id: Cdc6_C Pfam Desc: CDC6, C terminal
  misc_feature (141)..(335): Pfam Id: AAA Pfam Desc: ATPase family associated with various cellular activities(AAA)
  misc_feature (214)..(474): NCBI GI: 115441131 NCBI Desc: os01g0856000 [oryza sativa (japonica cultivar-group)]
  misc_feature (249)..(470): NCBI GI: 14578037 NCBI Desc: cell division control protein 6 [arabidopsis thaliana]
  misc_feature (71)..(335): NCBI GI: 1881587 NCBI Desc: cdc6-related protein [xenopus laevis]
  misc_feature (71)..(335): NCBI GI: 1655928 NCBI Desc: cell division control protein 6 [xenopus laevis]
  misc_feature (103)..(335): NCBI GI: 89267477 NCBI Desc: cdc6 cell division cycle 6 homolog [xenopus tropicalis]
MPTLRSATANASSVAVGTPSPAAASTPRSVKRRLTPGRAGELPAASRHTSPHRSPHAGTGTVCMPKLLSASPKSSRKRLYGDLVAAEKPKWNPRDAAQMRAVKEALHVATVPSSELVCRDNELRRVLEFCKASVEQEKAGSLYVCGCPGTGKTLSINKIKDSLVCWADEMGMETPDSLAINCTNLANTSEIFGKILGKFQNRKKGSSKLSPLQLVIVDEMDYLITRDRAVLHDLFMLTTCAFSRCILIGIANAIDLADRFLPKLESLNCKPLVVTFRAYSKDQISDIVKHRLKGLEYDVFEPLALEFCARKVAAASGDMRKALGVCRSAVEVLEARLQDSPDQELGIVTFDHMDIALSKAFKSAVIDSILCLPQHQQMVLCALANTFQHCKKKATTLGELNKSYIEICRSTQVPAVGMLEFSNMCMVLSDQGFMKLGQSKEDKLRRVTLQIDSSDITFAFKGNRFFQKCLEQPRC

SEQ ID NO: 11499 - DNA, 1434 bp, Sorghum bicolor
  misc_feature: Ceres ANNOT ID no. 6016242
  misc_feature: Encodes the peptide sequence at SEQ ID NO 11500
atgaggccgcgcggcaggggcgacgacgtcgaagacgacgatgacgaggacgagtacgaggacatcacgccgcctcgaagaacgccagagcccgaggccgaccccgcccctgcccctgatccctcgccctcgccctcgcccgcccccgcccccgcccccgccccgccgcagcccgcgcgtgccccgctcagcagcctcgtcgtcaggccgccgccgccgcaggagaacggcgggggatcctccccgcactcaccctccgcccgctcgccctctcccagcgccggcagacaccgaggccgcggggcctcgtcaccccggcgacggcgggacttctctccgccgcctccccgcggttgggagaggcgccggtcgcctccgccgcagccgccggagaggcggcgtcctgggagcccgccgccccagcgccgacgcttcactccaccgccacggttccagccaccgcggcatccgcgcttccacgatgagcagcaaggatatggaatgcatgcaggcccttcgccaccacgcccacgcagagcagaagccagcaaatttgatgatgatgttggtccacgttacacccatggatatcatggtggtggtagaggaggtgcaaggttccgagagggttctccgccatatggaagaggaggcagatcatatgggagaggctatggtgctccacatggaaaggatttcattaatattgatggacaatatgttcaccgaaatgacccaaatctgtcgccaagagaaggtgattggatatgccagaaccctaactgtggaaatctcaattttgctcggcgcactcactgtaacaactgcaacaagttccgctattcatcacatgaagcatatgagcctaggcgcagcccccccttcaggggttaccccagctctccacgagggcctccaaggattggtccacctggtgatcgtgcccctgcaagagagatgaccaggtacagatcaccacctcatggttggggagcaagtgatcctagggcatatgcagctcgatcccctccagaacgtgcaggacggtttacagatccatcacctaaggaaagaatgggcttccgtggtgagcgcgacccaagggaccgtgtgaaatttgagtggtctgccactgatgactacattcagagggagcgcccacatgatggttatcttgacaggagtcagcgtcactcaggatctcctcgtggtaactggggaaatgatctgcgtgatagaagccgctctcctccaaggaacaggcctatgaagaattccttcaccggcagaggtcggcctgatgactatgctgctgatcgatatgccagccgtgggcgtgggcatgtttacagaccaggcagtggcccataccctggtgagggtcgaggtggccgacgtgctgcaccacgtgctaggcacgaagatggctattag

SEQ ID NO: 11500 - protein, 477 aa, Sorghum bicolor
  misc_feature: Ceres ANNOT ID no. 6016242
  misc_feature (251)..(282): Pfam Id: zf-RanBP Pfam Desc: Zn-finger in Ran binding protein and others
  misc_feature (168)..(477): NCBI GI: 50725498 NCBI Desc: rna-binding protein-like [oryza sativa (japonica cultivar-group)]
  misc_feature (139)..(455): NCBI GI: 92896488 NCBI Desc: zinc finger, ranbp2-type [medicago truncatula]
  misc_feature (25)..(215): NCBI GI: 91209 NCBI Desc: proline-rich protein mp2 - mouse (fragment)
  misc_feature (1)..(232): NCBI GI: 16716579 NCBI Desc: proline rich protein mp4 [mus musculus]
  misc_feature (2)..(417): NCBI GI: 55665385 NCBI Desc: serine\/arginine repetitive matrix 1 [homo sapiens]
  misc_feature: Useful for making plants with altered Lignin content
  misc_feature: GREAT-hit functional homolog of the protein sequence given in SEQ ID NO 13306
MRPRGRGDDVEDDDDEDEYEDITPPRRTPEPEADPAPAPDPSPSPSPAPAPAPAPPQPARAPLSSLVVRPPPPQENGGGSSPHSPSARSPSPSAGRHRGRGASSPRRRRDFSPPPPRGWERRRSPPPQPPERRRPGSPPPQRRRFTPPPRFQPPRHPRFHDEQQGYGMHAGPSPPRPRRAEASKFDDDVGPRYTHGYHGGGRGGARFREGSPPYGRGGRSYGRGYGAPHGKDFINIDGQYVHRNDPNLSPREGDWICQNPNCGNLNFARRTHCNNCNKFRYSSHEAYEPRRSPPFRGYPSSPRGPPRIGPPGDRAPAREMTRYRSPPHGWGASDPRAYAARSPPERAGRFTDPSPKERMGFRGERDPRDRVKFEWSATDDYIQRERPHDGYLDRSQRHSGSPRGNWGNDLRDRSRSPPRNRPMKNSFTGRGRPDDYAADRYASRGRGHVYRPGSGPYPGEGRGGRRAAPRARHEDGY

SEQ ID NO: 11501 - DNA, 1059 bp, Sorghum bicolor
  misc_feature: Ceres ANNOT ID no. 6016421
  misc_feature: Encodes the peptide sequence at SEQ ID NO 11502
atggcggacacggcctcgtcctcatcagcagcgggaccctcgccggtagacgcggcctctctcgccgcggtggcggaggcggcgccgccggaggagatgacgctggtggtgaagtggcgcgggcaggagcagacggtgcggatggtgggggacgatacgctgggtgagctcaaactgcgcatctgcgaggtcaccggggtgctccccaagcgtcagacgctgctctaccccaagctcatactcaaggacatcgacgactccaccctcctctcctccatcccattcaagcccaacgggaagatcagcatgatcggtactattgaagaagaaatatttgtcggacaagaagatgatccggagttacttgatgattttgactttgagcagaatgaagctacagccattaaggataaagatgtctacaagcaaaaattaaagcggcgtgcaagtcaatataagatcaagctcttgaatccatgccgcaaaggaaagaagctgcttgtccttgacattgactatactctgtttgaccataagtcaacagctgagaatcctatggaactcatgcgcccatatcttcaccagttcctcacagctgcatattcaaaatatgacatcatgatatggtcagcaactagtatgaaatgggtggagttgaaaatggaacaacttggagttcttggcaaccctgactacaaaattactgctcttatggatcacttggctatgataactgtgcaatccgaaaatcaaagtaggaagaaaacttttgactgcaagcctcttggtgtcatttgggctcaatttcctgagtactacaacgaaaagaacaccatcatgtttgatgatctgagaaggaattttgtcatgaatccacagaatggtcttgtgatcaagccattcaggaaagcgcactcgaacaggcatgatgatcatgagctggtgaagcttacacactacctgctttcgataggagacctagaagatctcagcaagctggaccacggtaaatgggagtcctttgtagatgagagcgcaaagagacgcaagcgctcttag

SEQ ID NO: 11502 - protein, 352 aa, Sorghum bicolor
  misc_feature: Ceres ANNOT ID no. 6016421
  misc_feature (31)..(349): NCBI GI: 55245120 NCBI Desc: ensangp00000019582 [anopheles gambiae str. pest]
  misc_feature (19)..(350): NCBI GI: 92889089 NCBI Desc: ubiquitin; nli interacting factor [medicago truncatula]
  misc_feature (6)..(348): NCBI GI: 89257618 NCBI Desc: ubiquitin family protein [brassica oleracea]
  misc_feature (33)..(344): NCBI GI: 119581981 NCBI Desc: ubiquitin-like domain containing ctd phosphatase 1, isoform cra_a [homo sapiens]
  misc_feature (33)..(342): NCBI GI: 51950004 NCBI Desc: mgc81798 protein [xenopus laevis]
  misc_feature (33)..(344): SWISSPROT Homolog: EC 3.1.3.16 Ubiquitin-like domain-containing CTD phosphatase 1
MADTASSSSAAGPSPVDAASLAAVAEAAPPEEMTLVVKWRGQEQTVRMVGDDTLGELKLRICEVTGVLPKRQTLLYPKLILKDIDDSTLLSSIPFKPNGKISMIGTIEEEIFVGQEDDPELLDDFDFEQNEATAIKDKDVYKQKLKRRASQYKIKLLNPCRKGKKLLVLDIDYTLFDHKSTAENPMELMRPYLHQFLTAAYSKYDIMIWSATSMKWVELKMEQLGVLGNPDYKITALMDHLAMITVQSENQSRKKTFDCKPLGVIWAQFPEYYNEKNTIMFDDLRRNFVMNPQNGLVIKPFRKAHSNRHDDHELVKLTHYLLSIGDLEDLSKLDHGKWESFVDESAKRRKRS

SEQ ID NO: 11503 - DNA, 1608 bp, Sorghum bicolor
  misc_feature: Ceres ANNOT ID no. 6016601
  misc_feature: Encodes the peptide sequence at SEQ ID NO 11504
atgctgctgcccgtctgctccgccgcgcccagctgctcccccctctgcccggtgacggcgtcgcacgtcgtcgcgcgggtgccgcggagggtggacgtcggcgccgcgctaaggtcctacgccgacccgctcgtcgcgcaggtgcccgaccgcccgccgctcgccgactcctccatcctctccccctacaccgccgcgccggacgacatcgcgcgagccttcggcgcccccgcctccgagctcccgccgctccctagcgctgaccccagcgccgggctatgttgcacgggcaccgaccagccgctcacggccgtcgcggacctggccgccaccgccgtggtcaactcggcccccaccgatgccgcggagcgggccctgtcggacgcgccgttccccagcacgttcccgtccgacgcgtccgaggtcgaggactccgtggccaggttcatcgataaggtcggcaagcaggtgttccaggcggaggacgcgctcaccgaggcctacgacaagctgaggctgtcggcgtacgacgcgctcggtgcgtggaggaagacggtgcgcgacacgatcggtgggctcaaggcgtcggtcgacgccggtaaggagcaggccgcaggaggggtcacggacgcttccggcgcgttgcaggcgaaggtggccggagctggggctgtggctgttgatgttcttaggaaagcgattgttgcagcagaggattcactgggcagtgcagccacattcgttgtgtattcttatgggtctgccaaggagtctctaccaccaaatgttagagatttgttgagctcgtctgaggagaaagctggtctagttttgagaccaattggaaatgctctgcaacaggtatatgtaattgttgaaggtgttgaaaagaatgttggtttcgatccaagcgatccgattgttcaattggcagttgtgcttggaggttcagtgacaatagggacaacgtactggctcttcatatacggtggctattctggagacttgtcacctgaatcagcgttggagttattgaaaaatgatggcaaagccaatttgagggaaaaagatggtgttcctgatctacgccttggggctaggtctaaatatgcaagtgtagattcacctgagatcaaaggcccagttaagagtatgcttaaaggtggaagagaggttgatgacgccttactggcagctgtcattcgaaacttgaaattggtgaagggtgattcaaaggtcatagttatggattataatggagctcgatcaaaagccattgctaggttactgaagaagctcggtgtgcagagaccttaccttgttaaaggtggtttccaagcatggtcaaagaaccttcgtgtcaaagaactgaaacctgagactgcattaacgtcaataaatgaggatgttgaggaaatcctcgaacaaataaagcccaccccaactcttgtgtttggatctcttctgggcctctcagcactttcctatgctttacttgaatgggagatgactttgcaatacatcgctgttctaagcgtagggctgactatctacttgcgattctctacatacgaacgttctgaggacttggagcaagacctaaagtaa

SEQ ID NO: 11504 - protein, 535 aa, Sorghum bicolor
  misc_feature: Ceres ANNOT ID no. 6016601
  misc_feature (1)..(535): NCBI GI: 21952855 NCBI Desc: p0696g06.27 [oryza sativa (japonica cultivar-group)]
  misc_feature (1)..(535): NCBI GI: 115441603 NCBI Desc: os01g0896500 [oryza sativa (japonica cultivar-group)]
  misc_feature (2)..(487): NCBI GI: 140059217 NCBI Desc: rhodanese-like [medicago truncatula]
  misc_feature (2)..(487): NCBI GI: 140059095 NCBI Desc: rhodanese-like [medicago truncatula]
  misc_feature (185)..(462): NCBI GI: 46093489 NCBI Desc: calcium sensing receptor [chlamydomonas reinhardtii]
MLLPVCSAAPSCSPLCPVTASHVVARVPRRVDVGAALRSYADPLVAQVPDRPPLADSSILSPYTAAPDDIARAFGAPASELPPLPSADPSAGLCCTGTDQPLTAVADLAATAVVNSAPTDAAERALSDAPFPSTFPSDASEVEDSVARFIDKVGKQVFQAEDALTEAYDKLRLSAYDALGAWRKTVRDTIGGLKASVDAGKEQAAGGVTDASGALQAKVAGAGAVAVDVLRKAIVAAEDSLGSAATFVVYSYGSAKESLPPNVRDLLSSSEEKAGLVLRPIGNALQQVYVIVEGVEKNVGFDPSDPIVQLAVVLGGSVTIGTTYWLFIYGGYSGDLSPESALELLKNDGKANLREKDGVPDLRLGARSKYASVDSPEIKGPVKSMLKGGREVDDALLAAVIRNLKLVKGDSKVIVMDYNGARSKAIARLLKKLGVQRPYLVKGGFQAWSKNLRVKELKPETALTSINEDVEEILEQIKPTPTLVFGSLLGLSALSYALLEWEMTLQYIAVLSVGLTIYLRFSTYERSEDLEQDLK

SEQ ID NO: 11505 - DNA, 1809 bp, Sorghum bicolor
  misc_feature: Ceres ANNOT ID no. 6016614
  misc_feature: Encodes the peptide sequence at SEQ ID NO 11506
atgtggcgttcgcgagctcgtgcgcttctcctacttcgctcgaccattccccggtcaccgccgccacctccaccaccatatgccactcgaaccctaacccacctcccacctccccgccctctctcccgcttcctcgcctcctctccggatcccatccccgatgcctcttcctccgccgccgcggatcccttccctgaagccttctcctccccgaccgaggcctcccaagatgatgctactgaggccggggaggacaacctgagttcgatgtgggaggaagctggggacgccgacgatatcttcgtctcccccagcggcgccgacgccgtagccgacgatgaggaggtcgcccgcgtgtgcgccgccgtcgagtccactcccgaggacaagatcgcgtccaccctcgccgacatgatcgtggacttcaacgagccgctcctcgccgcagtcctccttgctgccgagcaatgctcctgtaagaagctgatttccctgttcaactatgccgcgaagaataaccccgctgccaagagcctctcgaatcttgagatcctcgtgagcaaggtagctgattctgatgagatagacaagacagacgcttatttgctttgggattcgatcaaggaaattggctctgtgccaggatcagtgagtacaccgttgttgaatgaaatgatcgccatattttggaagcttgagaagtcgaaggcagcgctggaggtgttttctaagttcgatgagtttggttgtactccggacagtgacagctattatcttgtgattgaagcagcacgaaagaagtccatgtttcgctctgtttctgaagtctgtgagaaggtgattggctctgcctgcttccctaatggtgagaagactggtaggattttaacttacctttgtgaggggaagaaggtgaagatggcacactcattataccttgcagcaaaggaaaaaaagattcagatcccaaagtcagccttggatttccttgttggtgctttggcaaggaatgatgagacgaccggtactgctctggagctgctggaagagtaccaaggggaatcgcttaagcatgcaggcaagtcctttgccacggttgtacatgctttgtgtagggtaaacaaaatggaagatgcaaatagtttgttgacgaggatggtgcagcttgaagagtaccaaggggaatctcttaagaatgcaggcaagacatttgcgacagttatacatggtttgtgtaggaaaaagaaattggaggatgcaaaaacattgttgatgaggatggtaaatgttggcccagctccaggtaatgcagtgtttaattttgtcatcacagcattgtcaaaacagagagaaatggaggatgcaaaaggtttgatgagagtgatggagggccaagggatcactcctgatatctatacttacagtgtgctcatgagtggctacattaaaggaggcatgatcagtgaagcccatgatctacttcgtgaagctaagaaagttcatccaaagctaaacagggttgcttatcatatagttatccgtggatactgcaagatggaggactttgagaaggccattgagtgcctaaaggagatgaggaaagatgggttgctgccaaatgtggacgagtatgacaaactgattcagtcattgtgtctgaaggctatggactggagaagagctgagaaactcctggaggaaatggaggatagtggtttatgcctaaggggtataagtcacagcctcatagctgcagtcaaggagttggaaggagaggaaatgcagtcaaaggcgagccaagaagcatag

SEQ ID NO: 11506 - protein, 602 aa, Sorghum bicolor
  misc_feature: Ceres ANNOT ID no. 6016614
  misc_feature (402)..(436): Pfam Id: PPR Pfam Desc: PPR repeat
  misc_feature (437)..(471): Pfam Id: PPR Pfam Desc: PPR repeat
  misc_feature (472)..(506): Pfam Id: PPR Pfam Desc: PPR repeat
  misc_feature (507)..(541): Pfam Id: PPR Pfam Desc: PPR repeat
  misc_feature (494)..(602): NCBI GI: 115441617 NCBI Desc: os01g0897500 [oryza sativa (japonica cultivar-group)]
  misc_feature (236)..(590): NCBI GI: 115446773 NCBI Desc: os02g0565400 [oryza sativa (japonica cultivar-group)]
  misc_feature (232)..(573): NCBI GI: 124360248 NCBI Desc: pentatricopeptide repeat [medicago truncatula]
  misc_feature (404)..(569): NCBI GI: 92891210 NCBI Desc: tetratricopeptide-like helical [medicago truncatula]
  misc_feature (163)..(570): NCBI GI: 22329519 NCBI Desc: helicase domain-containing protein / pentatricopeptide (ppr) repeat-containing protein [arabidopsis thaliana]
MWRSRARALLLLRSTIPRSPPPPPPPYATRTLTHLPPPRPLSRFLASSPDPIPDASSSAAADPFPEAFSSPTEASQDDATEAGEDNLSSMWEEAGDADDIFVSPSGADAVADDEEVARVCAAVESTPEDKIASTLADMIVDFNEPLLAAVLLAAEQCSCKKLISLFNYAAKNNPAAKSLSNLEILVSKVADSDEIDKTDAYLLWDSIKEIGSVPGSVSTPLLNEMIAIFWKLEKSKAALEVFSKFDEFGCTPDSDSYYLVIEAARKKSMFRSVSEVCEKVIGSACFPNGEKTGRILTYLCEGKKVKMAHSLYLAAKEKKIQIPKSALDFLVGALARNDETTGTALELLEEYQGESLKHAGKSFATVVHALCRVNKMEDANSLLTRMVQLEEYQGESLKNAGKTFATVIHGLCRKKKLEDAKTLLMRMVNVGPAPGNAVFNFVITALSKQREMEDAKGLMRVMEGQGITPDIYTYSVLMSGYIKGGMISEAHDLLREAKKVHPKLNRVAYHIVIRGYCKMEDFEKAIECLKEMRKDGLLPNVDEYDKLIQSLCLKAMDWRRAEKLLEEMEDSGLCLRGISHSLIAAVKELEGEEMQSKASQEA

SEQ ID NO: 11507 - DNA, 1863 bp, Sorghum bicolor
  misc_feature: Ceres ANNOT ID no. 6016634
  misc_feature: Encodes the peptide sequence at SEQ ID NO 11508
atgccgctctcggtgccgtcgacgccggccgtgctcaaggcactgccgcgggcgctctccctcgcggccgcggtcgtcgcggcgacaacagcgtccctgctcctcatctgcgctgttgtctccaactcccaccacgcggcgtcgtcctcgtcgccgcagcttcccccgtccgccagcgcctccaccgcggctctggccccggcgcccgcgcccgacgaacctgatcaccaccacccccaccagcaccccgcgcctcccgttcccccaagcccgcccaacgccacccacgatgtcccctgccacgagcctccttcgggcgagcgccactgccctgcgcgcccgccgcctccgccacctcacccgccgaaggatccaccgcagcaccctccgccgcctccgccgcactgccgcgtcccgccgccgcccgggtgccgcccgcccccgccgtggcccgcgcgccgtgaccgcgcgaggtacgcgaacgtggacctcccgccgccgcccccggttaaggtggcggctgggctggagcaggaccccgttcgccgtcgcggggagtggctggtgttcaccgagggggtgcgggattatgtcgagcagctggagcgcgtcgtgccgctccgtggcggcgtggtgcgcacggcgctcgacatcgggtgcggggttgcgagctttggggactatctgctcaactatggcgtactcaccatgtccattgcgccgaggaataatagacttggtccacaagtgcagctcgccttggagcgtggactgcctgcgatgatcggagcgcttgttgctcacaggctaccatatccatcgagatccttcgacatggtgcactgcgcggactgccttgttccatggactgctcatgatgggctctatattctggaaattgaccgtcttctccaacctggtggctattgggttttctctaaaccacctgtcaagtggaaatctacatacaacatttctaatcaagggaccagagacatgcagaacaatcaattagctatggattatatgttgaataagcttcattggacgagggtctctgaagagggcacaatttctgtttggagaaagccttcttgtcatctccactgtaaccaagaagcaaatgcaaagctcttaggattgccaccactctgtacaggagaagacccagatagtgcctggtatgcaaatatttcaatgtgtatgacatgtattccaagagctgaaacttttaatggctgtgctggtggtgctatggaaaaatggcctaaaagacttcatgcagtgccaccaaggataaccagtggggaaatgaaggggttgtccattcagagatataaatatgacactttgatttgggagaaaagggttaacttctatctaacatatctaaaatatttgtctaatggaacttacagaaatgtcatggacatgagtgctggttttggtggttttgctgctgctatgtccaagcatcctgtttgggtcatgaatgtggttcctgcaaatagaacagagaatactcttggtgtcatctatgagcgaggtttgattggaacatacactgactggtgtgaagccttctctacttatccacgaacatatgatctgatacatggtaatggaatcttcagctcccatattcacaagtgtgggattatcgacatcctggttgagatggatcgcgttctccggccagggggtgccgttatagttcgggacagagctgatgttgttctcaaagtcaagaaggacgccgaccgtctaaaatggagtagtcgagttgttgacactgaaaatgggcctctggatcctgagaagcttctcattgtggacaattccctcccacttcgagggagctaa

SEQ ID NO: 11508 - protein, 620 aa, Sorghum bicolor
  misc_feature: Ceres ANNOT ID no. 6016634
  misc_feature (216)..(312): Pfam Id: Methyltransf_11 Pfam Desc: Methyltransferase domain
  misc_feature (38)..(610): NCBI GI: 92886308 NCBI Desc: generic methyltransferase [medicago truncatula]
  misc_feature (136)..(611): NCBI GI: 38567915 NCBI Desc: osjnba0088i22.11 [oryza sativa (japonica cultivar-group)]
  misc_feature (136)..(611): NCBI GI: 50253255 NCBI Desc: dehydration-responsive family protein-like [oryza sativa (japonica cultivar-group)]
  misc_feature (84)..(610): NCBI GI: 55296764 NCBI Desc: dehydration-responsive protein-like [oryza sativa (japonica cultivar-group)]
  misc_feature (84)..(610): NCBI GI: 115465894 NCBI Desc: os06g0103900 [oryza sativa (japonica cultivar-group)]
  misc_feature: The sequence is a functional homolog of SEQ ID NO 560 in the 10/412,699US patent application
  misc_feature: Useful for making plants with modulated growth and phenotype characteristics
  misc_feature: The sequence is a functional homolog of SEQ ID NO 560 in the 20040045049 US patent application
MPLSVPSTPAVLKALPRALSLAAAVVAATTASLLLICAVVSNSHHAASSSSPQLPPSASASTAALAPAPAPDEPDHHHPHQHPAPPVPPSPPNATHDVPCHEPPSGERHCPARPPPPPPHPPKDPPQHPPPPPPHCRVPPPPGCRPPPPWPARRDRARYANVDLPPPPPVKVAAGLEQDPVRRRGEWLVFTEGVRDYVEQLERVVPLRGGVVRTALDIGCGVASFGDYLLNYGVLTMSIAPRNNRLGPQVQLALERGLPAMIGALVAHRLPYPSRSFDMVHCADCLVPWTAHDGLYILEIDRLLQPGGYWVFSKPPVKWKSTYNISNQGTRDMQNNQLAMDYMLNKLHWTRVSEEGTISVWRKPSCHLHCNQEANAKLLGLPPLCTGEDPDSAWYANISMCMTCIPRAETFNGCAGGAMEKWPKRLHAVPPRITSGEMKGLSIQRYKYDTLIWEKRVNFYLTYLKYLSNGTYRNVMDMSAGFGGFAAAMSKHPVWVMNVVPANRTENTLGVIYERGLIGTYTDWCEAFSTYPRTYDLIHGNGIFSSHIHKCGIIDILVEMDRVLRPGGAVIVRDRADVVLKVKKDADRLKWSSRVVDTENGPLDPEKLLIVDNSLPLRGS

SEQ ID NO: 11509 - DNA, 1377 bp, Sorghum bicolor
  misc_feature: Ceres ANNOT ID no. 6016726
  misc_feature: Encodes the peptide sequence at SEQ ID NO 11510
atggattcgcttgtgaagtgtggcaatggctacggtggctacggctacggctacggctatggttacggcaacagcaagccccagatgaactacaaccggcagaacaccgagtccgtgaccaccgtcgtcacggagatcaaccgcatgaccgtcaacgacaagcccagctgctacggcggcggcggcgacgtgcagaagcaggcctgcaaggtggaggcgttcgaggagcacgacgaagcgtacaacggcgccgtggccgtgcagaagcactccttcaaggaggagaaggaggagaggtacggcgctgccgccgtgaagaagcacgacgagtacaaggaggagaagtacggcgaagtaatcgacgcggagtacggcgcccactacggcggtggcgccgccgccttgaagaagcagcagggctacggctacaagcaggaggcgtacggggagaccgagggtgcagcagggtacggcggcgaggcgtgcggggagagcaacgccggctacggcgcgcaccacggtggtgccggtgccgccgtgcagacgtacgcctacgaccagcaggcggcgtacggcggcgccgtcggtgccgccgtgcagcagcaggcctacaagcacaaggacgccgctagtaagatgaacggctcccagcagaagatgtacgggtacggggaagccgccgtcgacgcagcaggggcggggtacggcgctcactgcggcggtggcggcgtgcagcagcagcacggctaccagaaagatgcgtacgggtacggcgccgccgccggtggcaaagtgaagaagaacggctaccagtaccaggaggcgtacggcaggagcgacgctggaggatacggcgctcactacggcggtgccggcggtggcgccgtgcagcagtacggctaccagcagaaagatgcgtacggcggagccaccgccggtggcaaagtgaagaagaccggctaccagtaccaggaggcgtacggtggaactggcgctggcgcaggagggtacggcgctcactacggtggtggcgccgccgccgttcagaagcaccacggctacatgcaggacgtgtacgagagcgagactgagagcgagagcgacgagagtgactgcgacgaggcgttcccgccgcgcggcggcgtgcagcacagctacggggcgtacaagcaggagaagcatcacggggctggcaacctcggcggcgtgcgccgctacgagtcgtacgagacccgcgaggagctcggcggcggtcgccgctatgagtcgtaccagagcagcgtccagtacacgggcggcagcggcggcggcggcggcagcggctacgccacgtgctccccgatcaagaaccgccacctccttcgctatggcgcgtag

SEQ ID NO: 11510 - protein, 458 aa, Sorghum bicolor
  misc_feature: Ceres ANNOT ID no. 6016726
  misc_feature (116)..(451): NCBI GI: 89114008 NCBI Desc: misp [uloborus diversus]
  misc_feature (153)..(354): NCBI GI: 92869575 NCBI Desc: eggshell protein [medicago truncatula]
  misc_feature (101)..(347): NCBI GI: 27228959 NCBI Desc: major ampullate gland dragline silk protein-2 [araneus ventricosus]
  misc_feature (125)..(441): NCBI GI: 89113996 NCBI Desc: fibroin 1a [deinopis spinosa]
  misc_feature (101)..(347): NCBI GI: 2605798 NCBI Desc: minor ampullate silk protein misp1 [nephila clavipes]
  misc_feature: The plant senesces significantly late compared to wild-type.
  misc_feature: Useful for making plants with modulated time to senescence
  misc_feature: GREAT-hit functional homolog of the protein sequence given in SEQ ID NO 12928
MDSLVKCGNGYGGYGYGYGYGYGNSKPQMNYNRQNTESVTTVVTEINRMTVNDKPSCYGGGGDVQKQACKVEAFEEHDEAYNGAVAVQKHSFKEEKEERYGAAAVKKHDEYKEEKYGEVIDAEYGAHYGGGAAALKKQQGYGYKQEAYGETEGAAGYGGEACGESNAGYGAHHGGAGAAVQTYAYDQQAAYGGAVGAAVQQQAYKHKDAASKMNGSQQKMYGYGEAAVDAAGAGYGAHCGGGGVQQQHGYQKDAYGYGAAAGGKVKKNGYQYQEAYGRSDAGGYGAHYGGAGGGAVQQYGYQQKDAYGGATAGGKVKKTGYQYQEAYGGTGAGAGGYGAHYGGGAAAVQKHHGYMQDVYESETESESDESDCDEAFPPRGGVQHSYGAYKQEKHHGAGNLGGVRRYESYETREELGGGRRYESYQSSVQYTGGSGGGGGSGYATCSPIKNRHLLRYGA

SEQ ID NO: 11511 - DNA, 1737 bp, Sorghum bicolor
  misc_feature: Ceres ANNOT ID no. 6016733
  misc_feature: Encodes the peptide sequence at SEQ ID NO 11512
  misc_feature: Down-regulated in root tissues in response to methyl jasmonate treatment
  misc_feature: Down-regulated in shoot tissues in response to methyl jasmonate treatment
atgaacccctacgacctccgcttcgccgacccctcatcctaccacgacaggcgcagcgacctggccgtggctcctacgttcgctccgccggctcccgtggctgcggtgaacccgaacccttacgccgccgcctacccgcccgtgccagtgcccgtgcccgcggcccccgcgggcggcgactaccagcgctacgggcagggcggcagaggccgtggtggaggcggcagaggaggcggcggtgggtatggaggtggcggtggtgggtatggaggtggcggcaggggaggtggtcgcgggagggacgggcttgactcgcttgccctccctaagccggacttccggagcctgataccgttcgagaagaacttctacgtggagtgtccctccgtccaggctatgtcggaggcggatgtggcgcagtaccgccgcctccgggatatcaccgtagagggccgggatgtgcccaagccggtccgatacttccaggaagccaacttcccagattactgcatgcaagcgattgccaaatctggatttgtggagccaactcctattcaatctcaaggttggcctatggctttgaagggtagggacctgattggtatcgctcaaacaggctcagggaaaacattatcttatctgctacctgggttggttcatgttggtgcccagcctcggctagaacaaggcgatggcccaattgtattaatcctcgcccccacaagagaactggctgttcaaatacaggaagaatctacaaaatttggatcatattcaagaactagaagcacatgtgtctatggtggtgcacctaagggtccacaaatacgtgaccttagaagaggagttgaaattgtcattgcaactcctggtcggttgattgatatgctggaagccggccacacgaacctacgtagagtgacataccttgtgctggatgaggcagaccggatgctagatatgggttttgagccccaaattcgaaaaatagttgcacagatccgcccagacaggcaaacattgtactggagtgccacatggcctagagaagttgaagccttagcaaggcagtttctgcaaaatccttataaggtaaccataggatcacctgaacttaaagctaatcattccatacaacaaattgtagaagttatttcagaccatgagaagtatccaagactcagtaagctcttgtctgatctaatggacggaagccgtatcttgatattcttccaaacaaaaaaggactgcgataagatcacacggcaacttagaatggatgggtggccggcattatctatacatggtgataaagctcaagctgaacgggactatgttcttgcagagtttaagagcggcaagagtcccataatggctgctacagatgtggcagcacgtggtcttgacgtgaaggacataaagtgtgtgataaattatgattttccaacaactcttgaagattatattcacaggataggtcgaactggccgtgctggtgctagcggaactgcatttacttttttcacacatgcaaatgctaagttctcaaggaatctagtgaagattctgcgggaagctggacaagctgtgaatcctgcactagaatccatgtccaagtcttcaaactcagggggaggaggcaatttccggtcgagaggcagaggtgggtttggtaaccggggtcatatgtctggatcaaatacctttcctttaggaggagggagaaggccatattga

SEQ ID NO: 11512 - protein, 578 aa, Sorghum bicolor
  misc_feature: Ceres ANNOT ID no. 6016733
  misc_feature (183)..(354): Pfam Id: DEAD Pfam Desc: DEAD/DEAH box helicase
  misc_feature (423)..(499): Pfam Id: Helicase_C Pfam Desc: Helicase conserved C-terminal domain
  misc_feature (1)..(578): NCBI GI: 143454263 NCBI Desc: dead-box atp-dependent rna helicase 30
  misc_feature (1)..(578): NCBI GI: 39653663 NCBI Desc: dead box rna helicase [zea mays]
  misc_feature (49)..(575): NCBI GI: 10177293 NCBI Desc: atp-dependent rna helicase-like protein [arabidopsis thaliana]
  misc_feature (101)..(559): NCBI GI: 124360402 NCBI Desc: helicase, c-terminal [medicago truncatula]
  misc_feature (87)..(560): NCBI GI: 143361556 NCBI Desc: dead-box atp-dependent rna helicase 20
  misc_feature: Down-regulated in root tissues in response to methyl jasmonate treatment
  misc_feature: Down-regulated in shoot tissues in response to methyl jasmonate treatment
MNPYDLRFADPSSYHDRRSDLAVAPTFAPPAPVAAVNPNPYAAAYPPVPVPVPAAPAGGDYQRYGQGGRGRGGGGRGGGGGYGGGGGGYGGGGRGGGRGRDGLDSLALPKPDFRSLIPFEKNFYVECPSVQAMSEADVAQYRRLRDITVEGRDVPKPVRYFQEANFPDYCMQAIAKSGFVEPTPIQSQGWPMALKGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDMLEAGHTNLRRVTYLVLDEADRMLDMGFEPQIRKIVAQIRPDRQTLYWSATWPREVEALARQFLQNPYKVTIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLDVKDIKCVINYDFPTTLEDYIHRIGRTGRAGASGTAFTFFTHANAKFSRNLVKILREAGQAVNPALESMSKSSNSGGGGNFRSRGRGGFGNRGHMSGSNTFPLGGGRRPY

SEQ ID NO: 11513 - DNA, 405 bp, Sorghum bicolor
  misc_feature: Ceres ANNOT ID no. 6016780
  misc_feature: Encodes the peptide sequence at SEQ ID NO 11514
atgaatccgccgcacccagagccggcccttccgcgccgccaccaccacctggtccatctccacctcgacccgcgccaccaccaccacgtccacatccacctctgctgctgcaaccaccaccaccaccacggcgtccacccgctcgctcccgcgccgccggcccacctccacgacaaccagcagcagcacccggctcccgtactattccccagcacctacccgagcgcggcgccctggcagccggagccgccccgcgccgccgtaagagaggacgtggaggatttggatcccgagccggagctgctgcacgcggaggaggaagacgaggagccggtgttcgtgcttacggacgagtgggcggagttcttcgccaaatctgaggccaagaggagactgggtaattga

SEQ ID NO: 11514 - protein, 134 aa, Sorghum bicolor
  misc_feature: Ceres ANNOT ID no. 6016780
  misc_feature (1)..(132): NCBI GI: 19386754 NCBI Desc: p0413c03.10 [oryza sativa (japonica cultivar-group)]
  misc_feature (11)..(83): NCBI GI: 6679833 NCBI Desc: forkhead box b2 [mus musculus]
  misc_feature (25)..(79): NCBI GI: 71854530 NCBI Desc: cg33692-pc, isoform c [drosophila melanogaster]
  misc_feature (11)..(81): NCBI GI: 55663361 NCBI Desc: otthump00000021510 [homo sapiens]
  misc_feature (2)..(78): NCBI GI: 21428982 NCBI Desc: gh28840p [drosophila melanogaster]
MNPPHPEPALPRRHHHLVHLHLDPRHHHHVHIHLCCCNHHHHHGVHPLAPAPPAHLHDNQQQHPAPVLFPSTYPSAAPWQPEPPRAAVREDVEDLDPEPELLHAEEEDEEPVFVLTDEWAEFFAKSEAKRRLGN

SEQ ID NO: 11515 - DNA, 1209 bp, Sorghum bicolor
  misc_feature: Ceres ANNOT ID no. 6016827
  misc_feature: Encodes the peptide sequence at SEQ ID NO 11516
atgacgccggtgccagattcggatggcagtagcaaccacatccctgatgacataatcttcttccaaattctcgtgctgcttcctgtcaagtgccttgtgcgcttccagtccgtatgcaagagttggcgtgccactatactcaacactcaatttatccgctaccacctggagcatttcaggactagattgtcaatggttgtcatgccccgaaggtacgaggaggaccataaaaagtttggccttgagggtgtcactttctacagttttcagcctgggcaaagcaaggttgccgagctcatcctagataagaggtgtccaagagggatgccagtgttcagcatgcctctgtattgtgatggacttattttgatcccttgcacgacaggacggatgtttctgtgtaacccggcaaccagagagtttgttgaattgccacgaggaagtcgtaatgtcgccggggaccatagggtcgcctttggtctcgacccttgtactggcaagtataaggttgctaggcacttcttccgctcctactccgaaacgttacaggcagatggagaaggcacagttctagaatacagtgctgggcatgagatcttgaccatcgatgatggactagatgcttggaaatggaaggcaaccatagacccaccttatgctatcaatgccaggactccaatttgtcttcctgggttcttctattggagtgctctccgctccatcaccggccatggaattaacaaggtcagttcacatgtcatccttcggtttagcttgcacgatgaaacgttcaccgtgcatcccaacccaccatgtcgtagttttctaagcaacaatgacacactgtgcgagcttggtggtaagttatgctatgtccactcttcctcaccatgggatgtggacatttggttagcagaggatggaccaaaccttgcttggcttcggcgttgccgtctctgcttgcccctgccaaggttgttaaccgttttcgcttgtgcttcggctgatagagacaagatatttctgtccatcgatgccggttaccttttgaaatgtgatctaagtaatggatcacttgagaaaataatcgacatggcggacttggtgtacgacaatcgggatgggacaaaattctgctcgggtgtgcaatctgctgtacactacatggttccttgtgtagaatcacttttgcgtattagaccacagtaa

SEQ ID NO: 11516 - protein, 402 aa, Sorghum bicolor
  misc_feature: Ceres ANNOT ID no. 6016827
  misc_feature (9)..(57): Pfam Id: F-box Pfam Desc: F-box domain
  misc_feature (1)..(248): NCBI GI: 115477310 NCBI Desc: os08g0518300 [oryza sativa (japonica cultivar-group)]
  misc_feature (14)..(303): NCBI GI: 38347475 NCBI Desc: osjnba0084n21.13 [oryza sativa (japonica cultivar-group)]
  misc_feature (14)..(368): NCBI GI: 115476200 NCBI Desc: os08g0382800 [oryza sativa (japonica cultivar-group)]
  misc_feature (90)..(317): NCBI GI: 108708334 NCBI Desc: f-box domain containing protein [oryza sativa (japonica cultivar-group)]
  misc_feature (40)..(323): NCBI GI: 115483534 NCBI Desc: os10g0567900 [oryza sativa (japonica cultivar-group)]
  misc_feature: The sequence is a functional homolog of SEQ ID NO. 456 in the 11/188,298 US application
MTPVPDSDGSSNHIPDDIIFFQILVLLPVKCLVRFQSVCKSWRATILNTQFIRYHLEHFRTRLSMVVMPRRYEEDHKKFGLEGVTFYSFQPGQSKVAELILDKRCPRGMPVFSMPLYCDGLILIPCTTGRMFLCNPATREFVELPRGSRNVAGDHRVAFGLDPCTGKYKVARHFFRSYSETLQADGEGTVLEYSAGHEILTIDDGLDAWKWKATIDPPYAINARTPICLPGFFYWSALRSITGHGINKVSSHVILRFSLHDETFTVHPNPPCRSFLSNNDTLCELGGKLCYVHSSSPWDVDIWLAEDGPNLAWLRRCRLCLPLPRLLTVFACASADRDKIFLSIDAGYLLKCDLSNGSLEKIIDMADLVYDNRDGTKFCSGVQSAVHYMVPCVESLLRIRPQ

SEQ ID NO: 11517 - DNA, 816 bp, Sorghum bicolor
  misc_feature: Ceres ANNOT ID no. 6016973
  misc_feature: Encodes the peptide sequence at SEQ ID NO 11518
atggacagtggcaggcatgagcggcaccacttcgtgctggtgcacggactctgccacggcgcgtggtgctggtacaaggtggccaccgcgctggaggccgccggccaccgcgtgacggcgctggacctggcggcgtcgggcgcccacccggcgcgcctgcacgaggtgcgctccttcgaggactactcgcgcccgctgctggacgcggtcgccgcggcgcccgacggcgacaggttggtcctcgtcggccacagcttcggcggccacaacctcgcgctcgccatggagaggtttccgcgcaaggtcgccgtcgccgtcttcatctctgcgcccatgccggtccccggtcgccccatgtcaacggtcttggaacagcatcttgaaggagattctacgccggattccttcttggacagcacatttggagtcatggagagaggcttagagaatccagcggagacattcctgcttggcccagaatggatgtcacagaggatgtaccagctcagccctgcagaggacctgacgcttgccaagacgctggtcaggccggcgcagatgttcctcggggacgaggccatggcaggggagaacgttctgacgtgggacaggtacggcgcggtgagccgcgtgtttgtcgtcaccgaggaagacaggacgtggccggcggaggaacagctggaggcggcggcctcttgcggccccggcgttgaggtgagggcgataagaggagctgatcacatgcccatgttctccaagccagcggagcttgcccaactcatcttggaagtagctcaagctgacaagtataattga

SEQ ID NO: 11518 - protein, 271 aa, Sorghum bicolor
  misc_feature: Ceres ANNOT ID no. 6016973
  misc_feature (36)..(263): Pfam Id: Abhydrolase_1 Pfam Desc: alpha/beta hydrolase fold
  misc_feature (10)..(271): NCBI GI: 15408791 NCBI Desc: pir7a protein (pseudomonas inducible protein) [oryza sativa (japonica cultivar-group)]
  misc_feature (10)..(271): NCBI GI: 498744 NCBI Desc: pir7a [oryza sativa]
  misc_feature (1)..(270): NCBI GI: 15408790 NCBI Desc: pir7b protein (pseudomonas inducible protein) [oryza sativa (japonica cultivar-group)]
  misc_feature (1)..(270): NCBI GI: 498745 NCBI Desc: pir7b [oryza sativa]
  misc_feature (8)..(270): NCBI GI: 498747 NCBI Desc: pir7b [oryza sativa]
MDSGRHERHHFVLVHGLCHGAWCWYKVATALEAAGHRVTALDLAASGAHPARLHEVRSFEDYSRPLLDAVAAAPDGDRLVLVGHSFGGHNLALAMERFPRKVAVAVFISAPMPVPGRPMSTVLEQHLEGDSTPDSFLDSTFGVMERGLENPAETFLLGPEWMSQRMYQLSPAEDLTLAKTLVRPAQMFLGDEAMAGENVLTWDRYGAVSRVFVVTEEDRTWPAEEQLEAAASCGPGVEVRAIRGADHMPMFSKPAELAQLILEVAQADKYN

SEQ ID NO: 11519 - DNA, 861 bp, Sorghum bicolor
  misc_feature: Ceres ANNOT ID no. 6016989
  misc_feature: Encodes the peptide sequence at SEQ ID NO 11520
atgaacagccacctaagcttcgaggagggctggaaagtcctggaacaggggattttaaaatgctcgaagattttggagtgcaccagtataaggcctactgtgaacgagtacatgaactactatgattgtgcttacaagatggctgtgcagaaacaacattactgccaagaaatgtacaatggtttcaggatgacgcttgcagaatgtgtccgcacaatggttctgccccatctcatgcacaagcaaaatgacagctttttcagagagcttgtgaaaatgtggtcaaactattgcatcatgattagatgtgtaactggcttcttcaactatttggaccgctgctttgtggagcagtacaaactaccatcacttagcgatgctgctgctactgctttctttggtccggtcttttcatacttcaatgatgaagcaagaactgctcttcttactctgatccaacgagaacgtgatggaagcatgatggattcgagcctgcacgatgttatgcatggcatatgttgttccgaagtcaaatccataatgcaaaatgcttttcttgatgaaacatatggctactactccatgagaagttccgaatggattaggcactactctttgccagattaccttgctaaggttgaggaaagtatggagacagaaaccaagaggctggcttactatctggaaatttcaagtggggacagctaccctctctgtttgcaggctgtaaatgctccattgatggaaacttatgtcaattatgtgacagagcaacaaatcagtggtcagctgatgcttgaaacgtacaagactgttgaggaggaactgcttggcagatgcaggagcttgacacttggttga

SEQ ID NO: 11520 - protein, 286 aa, Sorghum bicolor
  misc_feature: Ceres ANNOT ID no. 6016989
  misc_feature (11)..(282): Pfam Id: Cullin Pfam Desc: Cullin family
  misc_feature (5)..(262): NCBI GI: 34481801 NCBI Desc: cullin 1b [nicotiana tabacum]
  misc_feature (3)..(262): NCBI GI: 82470783 NCBI Desc: cullin 1-like protein c [petunia inflata]
  misc_feature (5)..(262): NCBI GI: 34481799 NCBI Desc: cullin 1a [nicotiana tabacum]
  misc_feature (5)..(262): NCBI GI: 33243052 NCBI Desc: cul1 [oryza sativa (japonica cultivar-group)]
  misc_feature (5)..(274): NCBI GI: 22335691 NCBI Desc: cullin-like protein1 [pisum sativum]
MNSHLSFEEGWKVLEQGILKCSKILECTSIRPTVNEYMNYYDCAYKMAVQKQHYCQEMYNGFRMTLAECVRTMVLPHLMHKQNDSFFRELVKMWSNYCIMIRCVTGFFNYLDRCFVEQYKLPSLSDAAATAFFGPVFSYFNDEARTALLTLIQRERDGSMMDSSLHDVMHGICCSEVKSIMQNAFLDETYGYYSMRSSEWIRHYSLPDYLAKVEESMETETKRLAYYLEISSGDSYPLCLQAVNAPLMETYVNYVTEQQISGQLMLETYKTVEEELLGRCRSLTLG

SEQ ID NO: 11521 - DNA, 1230 bp, Sorghum bicolor
  misc_feature: Ceres ANNOT ID no. 6017049
  misc_feature: Encodes the peptide sequence at SEQ ID NO 11522
atgcgagggctcctctcctcttcctccgctctcctccgacgagccgccgcccagctctcgcgcgcggagtgcggtagcgcctcagcatccgcgccctctcctctcccccgctctcccctccagaatgggaaaagagagacattttgttcgttttggtacaaaggtcgttcgatgtcaaccacagttgatatgcagttagactacgagagcgatcccccgcttgacggtgcaaaagctatcgagaaggagtcgtcacttaatattgctgtctctcaactcgcaagtgactttgatagagaatccaatttatgtttggagcgattttcccgtacaaggaaagcatctgtagtctctactggttctcttaagcttgacctcgcgctcggtgttggaggattaccaaagggtagaatggtggagatatatgggaaagaagcatctgggaagacaacactagcacttcatgttgtcaaggaagctcaaaagaatggaggttattgtgcttatattgatgcagagaatgcctttaacccttcatttgctgaagctattggtgtagacagtgaaaggctcttgatagcccaacctgattctgctgaaaattctttaagcattgtaaacagtcttgttggtggatctgttgctgttgttgttgtggatagtgtggcagcacttattcccaagtgtgaaattgaaggtgaaatatacacaaattctgaagacatccaatcccgtttgatgactcgggcgcttagaaaaattcagtacactctatgtcgctctgaaacacttattatttttgtgaatcaggttagaacaaagaggacctcaaaaaattttcctgggatctacaaggaggtgccttgcggtggtaatgcattagggttctattctgcagttagaatgaggacttcaagaagagaactgcgctatagtgaagacgaggctactggcataggtatatcagtgcagatcatcaagaataaattggctccagcgagcctgaaggaagccggcatcgacatcagatttggcaaagggatctgccatgaatcagaaatcctggaggtggcttcttccgtcggagttatcctgaaagatgggtgtgggtattggatcaacaatgtgttcctgacgggcaagttggaagctgagaagttcctacgtgagaacgctgcagtggcagatgagatctgcagtaccgtgagaaatgagctcttgcataggtga

SEQ ID NO: 11522 - protein, 409 aa, Sorghum bicolor
  misc_feature: Ceres ANNOT ID no. 6017049
  misc_feature (84)..(408): Pfam Id: RecA Pfam Desc: recA bacterial DNA recombination protein
  misc_feature (94)..(330): Pfam Id: Rad51 Pfam Desc: Rad51
  misc_feature (81)..(407): NCBI GI: 42569151 NCBI Desc: reca family protein [arabidopsis thaliana]
  misc_feature (81)..(408): NCBI GI: 140051849 NCBI Desc: reca bacterial dna recombination protein [medicago truncatula]
  misc_feature (79)..(403): NCBI GI: 90420927 NCBI Desc: reca [aurantimonas sp. si85-9a1]
  misc_feature (79)..(403): NCBI GI: 114707287 NCBI Desc: recombinase a [fulvimarina pelagi htcc2506]
  misc_feature (79)..(403): NCBI GI: 90818648 NCBI Desc: recombinase a [ochrobactrum anthropi]
MRGLLSSSSALLRRAAAQLSRAECGSASASAPSPLPRSPLQNGKRETFCSFWYKGRSMSTTVDMQLDYESDPPLDGAKAIEKESSLNIAVSQLASDFDRESNLCLERFSRTRKASVVSTGSLKLDLALGVGGLPKGRMVEIYGKEASGKTTLALHVVKEAQKNGGYCAYIDAENAFNPSFAEAIGVDSERLLIAQPDSAENSLSIVNSLVGGSVAVVVVDSVAALIPKCEIEGEIYTNSEDIQSRLMTRALRKIQYTLCRSETLIIFVNQVRTKRTSKNFPGIYKEVPCGGNALGFYSAVRMRTSRRELRYSEDEATGIGISVQIIKNKLAPASLKEAGIDIRFGKGICHESEILEVASSVGVILKDGCGYWINNVFLTGKLEAEKFLRENAAVADEICSTVRNELLHR

SEQ ID NO: 11523 - DNA, 1554 bp, Sorghum bicolor
  misc_feature: Ceres ANNOT ID no. 6017058
  misc_feature: Encodes the peptide sequence at SEQ ID NO 11524
atgggcaccgtcggcggcgagctgcccctcgccgacccggccgccgacgcagaccgggcgaggctgcagcagctgggatacaagcaggagctcaagcgcggcctctccgtcgtttccaacttcgccttctccttcgccatcatctccgtgctgacgggcgtgacgacgacctacaacaccggcctccgctacggcgggccggcgtccatgacgctggggtggctcgtcgtggcactcttcaacggctgcgtggcgctgtccatggcggagatctgctccgcctacccgacctccggcgggctctactactggagcgccaagctcgccggcaaggaatgggctccacttgcctcctgggtcaccggatggttcaacatcgtggggcagtgggcgtgcacggcgagcgtggacttctcgctggcgcagctgatccaggtgatcatcctgctgggcaccggcggggccaacggcggcggctacctggcctccaagtacgtcgtgctggccatctacaccgccatcctcgtcgtgcacggcctcatcaacagcctgcccatccactggctctcctggttcggccagctcggagccttctggaacgtcgccggtgtgttcgtcctcgtcatcctcgtcccgtcggtggccaagcagagggccagcgccgagttcatcttcacccacatgaacaccgacaatggcatgggcatccatagcaaggcctacatcctcgccgtcggcctgctcatgagccagtactccagcatcggctacgacacctctgctcacatgacggaggagacgaagaaggcggactggaacgggccgatggggatcgtctactccgtcgcactgtccagcgtgttcggatggatctacctgctggctctgacgtcggtggtgaccgacatcccgtacctgctggacaccggcaacgacgccggcgggtacgccattgctcaagccctgtactccactttccaccggaggtacggcaccggcgccggcggcatcgcctgcttggtcatcatcgccgtcgccgtcttcctctgcggcaccgcctgcgtcaccagcaactccaggatggggtacgccttctccagggacggggcgatgccgttctcgcacgtttggtacaaggtgaacaagcaggaggtgcccttcaacgtcgtctggctctccgtgtccgtggcgttcgtcatggccctcacgtcgctggggagccaggtggcgttccaggcaatggtgtccatcgcgacgctgggcctgtacatcgcctacgcgctgcccatcttgttccgcgtgacgacggcgaggaggtcgttcgtggcagggccgttccacctcgggagattcggcgtcgccgtcggctcggtggccgtgctctgggtggcgctagtcaccgtgctcttctgcctgccggtggcgtaccccgtcaccaaggagaccttgaactacacgccggtggccgtcggcggcgtgctggtgctcagcctcgccgcgtgggtgctccacgcccggttctggttccgagggcctatcaccaacgttggttaa

SEQ ID NO: 11524 - protein, 517 aa, Sorghum bicolor
  misc_feature: Ceres ANNOT ID no. 6017058
  misc_feature (15)..(263): NCBI GI: 115442199 NCBI Desc: os01g0945700 [oryza sativa (japonica cultivar-group)]
  misc_feature (15)..(516): NCBI GI: 15290172 NCBI Desc: p0660f12.28 [oryza sativa (japonica cultivar-group)]
  misc_feature (11)..(515): NCBI GI: 115442195 NCBI Desc: os01g0945300 [oryza sativa (japonica cultivar-group)]
  misc_feature (11)..(516): NCBI GI: 19386876 NCBI Desc: p0614d08.21 [oryza sativa (japonica cultivar-group)]
  misc_feature (136)..(515): NCBI GI: 15290170 NCBI Desc: p0660f12.26 [oryza sativa (japonica cultivar-group)]
  misc_feature: The sequence is a functional homolog of SEQ ID NO. 297 in the 11/188,298 US application
  misc_feature: The sequence is a functional homolog of SEQ ID NO. 510 in the 11/188,298 US application
MGTVGGELPLADPAADADRARLQQLGYKQELKRGLSVVSNFAFSFAIISVLTGVTTTYNTGLRYGGPASMTLGWLVVALFNGCVALSMAEICSAYPTSGGLYYWSAKLAGKEWAPLASWVTGWFNIVGQWACTASVDFSLAQLIQVIILLGTGGANGGGYLASKYVVLAIYTAILVVHGLINSLPIHWLSWFGQLGAFWNVAGVFVLVILVPSVAKQRASAEFIFTHMNTDNGMGIHSKAYILAVGLLMSQYSSIGYDTSAHMTEETKKADWNGPMGIVYSVALSSVFGWIYLLALTSVVTDIPYLLDTGNDAGGYAIAQALYSTFHRRYGTGAGGIACLVIIAVAVFLCGTACVTSNSRMGYAFSRDGAMPFSHVWYKVNKQEVPFNVVWLSVSVAFVMALTSLGSQVAFQAMVSIATLGLYIAYALPILFRVTTARRSFVAGPFHLGRFGVAVGSVAVLWVALVTVLFCLPVAYPVTKETLNYTPVAVGGVLVLSLAAWVLHARFWFRGPITNVG

SEQ ID NO: 11525 - DNA, 1026 bp, Sorghum bicolor
  misc_feature: Ceres ANNOT ID no. 6017075
  misc_feature: Encodes the peptide sequence at SEQ ID NO 11526
atggcttccaggcactcagagaacaatgcacaaggagcagcgctgttgacgactcctcacactaacatatccaggatcatccattcgttgcccctcgagaccaggtggccaacactctcggttcgccagtatgctagcttttggctggccgaggtaacattgaagacaggctttccactcgtccattcatgcttcgagccaaggcccactgacgtattccttgcaagcttccccaagtctggcaccacttggctcaaggctctcgtctttgcaacgctcaagcggtccacacatgtgccgttcgacggcgaccatccactgcgccattgcagcccccatgacatcgtcaggttccttgaaattgaattcaacacaagggatgagtttgaagcggtcccttccccgcgcgtgctggccacacaccttccctactccttgctgcctaactgcatcaccggagaggagagctcagggtgccggatcgtgtacgtctgccgggaacccaaggacgcgctggtctcctactggctgttcacgaagaaggcggcgctggcgaggggagttgacgacgtccggtcgacgttcaccatccaggaggcgttggagctgttctgcgacggccggtgtccgggcggcccgcagtggcagcatgtcctccagtactgggaggagagcttgaggaggcctgacagggtgctgttctttcggtacgaggagatgctgcttgagcctgagagtcatgtcaggaagctagcgaagttcatgggctgcgagttttctgaggaggaagaggagagcggggtggtgagcgccatcgtggagctgtgtagcctggctaagctgagggacatggaggtgaacagaaatggaagcactaggatggggatcaagaacgaaagcttcttcaggatgggagttgctggggactggagcaatcacatgacgccagagatggcgcagaggctggacaaagtcgttgaggatgcattgcaagggactggattcaccttcacgagcacagcatga

SEQ ID NO: 11526 - protein, 341 aa, Sorghum bicolor
  misc_feature: Ceres ANNOT ID no. 6017075
  misc_feature (69)..(334): Pfam Id: Sulfotransfer_1 Pfam Desc: Sulfotransferase domain
  misc_feature (29)..(339): NCBI GI: 115480589 NCBI Desc: os09g0555100 [oryza sativa (japonica cultivar-group)]
  misc_feature (22)..(339): NCBI GI: 115485385 NCBI Desc: os11g0450400 [oryza sativa (japonica cultivar-group)]
  misc_feature (27)..(340): NCBI GI: 38344441 NCBI Desc: osjnba0038o10.13 [oryza sativa (japonica cultivar-group)]
  misc_feature (167)..(336): NCBI GI: 115475467 NCBI Desc: os08g0239900 [oryza sativa (japonica cultivar-group)]
  misc_feature (42)..(333): NCBI GI: 115447957 NCBI Desc: os02g0684100 [oryza sativa (japonica cultivar-group)]
MASRHSENNAQGAALLTTPHTNISRIIHSLPLETRWPTLSVRQYASFWLAEVTLKTGFPLVHSCFEPRPTDVFLASFPKSGTTWLKALVFATLKRSTHVPFDGDHPLRHCSPHDIVRFLEIEFNTRDEFEAVPSPRVLATHLPYSLLPNCITGEESSGCRIVYVCREPKDALVSYWLFTKKAALARGVDDVRSTFTIQEALELFCDGRCPGGPQWQHVLQYWEESLRRPDRVLFFRYEEMLLEPESHVRKLAKFMGCEFSEEEEESGVVSAIVELCSLAKLRDMEVNRNGSTRMGIKNESFFRMGVAGDWSNHMTPEMAQRLDKVVEDALQGTGFTFTSTA

SEQ ID NO: 11527 - DNA, 747 bp, Sorghum bicolor
  misc_feature: Ceres ANNOT ID no. 6017115
  misc_feature: Encodes the peptide sequence at SEQ ID NO 11528
atggcagcgcctgcggcggagggggcggccgtgtcggccgcggcggcgctgcgagccgtgctggcgcgggcggggatggcggcggagcggtcggggcgcgccgcggaggcggtccgggtggtggcggtggggaagaccaagcccgtttcgatgctgcagcagctctacgacgcgggccaccgctgcttcggcgagaactacgtgcaggagttcgtcaccaaggctccccagcttccggaagatgtccggtggcactttatcgggcacctgcagagcaacaaagtgaaaccgctgttagctgctgttccaaatcttgatatggttgagggtgtagataatgaaaagattgctaaccacctagatcgagctgtcaacagtttgggaagagagcctttgaaagttctggttcaagtgaacactagtggagaagaatctaaatccggaattgatccctccaaatgtgtcgaccttgctaagcatgtgaaactagcatgcccacacctaatattttcaggtctgatgacaataggaatgaaagactactcttcaacaccagaaaattttaaggcattggtaaattgtaagcttgaagtttgcaaggcccttgacataccaacagaacagtttgaactctccatgggaatgtctggtgactttgagcaagcgatagagatgggcagcacgaatgtgaggattggatcaaccatctttggaccaagggagtatccaaacaaaaagcagaattag

SEQ ID NO: 11528 - protein, 248 aa, Sorghum bicolor
  misc_feature: Ceres ANNOT ID no. 6017115
  misc_feature (12)..(242): Pfam Id: Ala_racemase_N Pfam Desc: Alanine racemase, N-terminal domain
  misc_feature (5)..(245): NCBI GI: 115462125 NCBI Desc: os05g0150000 [oryza sativa (japonica cultivar-group)]
  misc_feature (1)..(245): NCBI GI: 18416879 NCBI Desc: alanine racemase family protein [arabidopsis thaliana]
  misc_feature (1)..(245): NCBI GI: 21436037 NCBI Desc: at1g11930/f12f1_20 [arabidopsis thaliana]
  misc_feature (1)..(158): NCBI GI: 57900473 NCBI Desc: alanine racemase-like [oryza sativa (japonica cultivar-group)]
  misc_feature (9)..(245): NCBI GI: 119583765 NCBI Desc: proline synthetase co-transcribed homolog (bacterial), isoform cra_b [homo sapiens]
MAAPAAEGAAVSAAAALRAVLARAGMAAERSGRAAEAVRVVAVGKTKPVSMLQQLYDAGHRCFGENYVQEFVTKAPQLPEDVRWHFIGHLQSNKVKPLLAAVPNLDMVEGVDNEKIANHLDRAVNSLGREPLKVLVQVNTSGEESKSGIDPSKCVDLAKHVKLACPHLIFSGLMTIGMKDYSSTPENFKALVNCKLEVCKALDIPTEQFELSMGMSGDFEQAIEMGSTNVRIGSTIFGPREYPNKKQN

SEQ ID NO: 11529 - DNA, 1707 bp, Sorghum bicolor
  misc_feature: Ceres ANNOT ID no. 6017180
  misc_feature: Encodes the peptide sequence at SEQ ID NO 11530
  misc_feature: Up-regulated in shoot tissues in response to salicylic acid treatment
atgtcgctcgacgagctcgccgacaaggagccgtcgtcctccgaggaagttcagcttgcgccgtcggattccaagttccggagcatcggccctgcgccgattccgatcccagctcctccgagcatcagatcattggtcgactcggtttctgatgagagagtaaatgtagatatcgtggcctcacatcaaagtgaaaatggatccatctccacagctagttctactggttcactagaatcagagaaggcagcatatgaatttcttgctcaaactcctgtcaggtcaactgatgcacaccttgttgagttttcagaagccatgagaactgttgcaaaagccttacgacgagtggctgaagggaaggctgctgctcaagcagaggcagcagagtggaaacgtaagtatgaattagagacagcgcacaagcagcagagtaaaatcaaaggctacaacagttgtatcagtaacgacttggacaaactggccagccaactaaccctggagacacctgcacccgatcaattaggatgttgcggtaagcatggtatatgtgcacatgaggttctccaggacgaagttcctggacctatcccaagatctaatcacaaggtggtggggagaaaggcatcatttaaactttcatggggatgtaatggggataaaaatggtcagcataagcatgattttgtgtcctttgaaaaaggtgatataacaaccgcagaaaggagcaataagcagatcttactgaaatgggaatcgccaccacaaacagtgcttttcataaccaaaccgaattccaactctgtgcgtgttctttgtgctgaaatggtcagatggcttagggagagtaaaaacataaacatctttgttgagccacgtgttagaaaggaacttctaacagaggattcctactacaacttcgtccaaacatgggataatgatgaggagataaagatgctgcacacgaaggttgatctaattgtaactttgggtggtgatggaactgttctgtgggctgcgtcgttgttcaaaggaccagttcctccagttgttgcattcgcccttggatcactgggcttcatgacgcctttcccaagcgagcaataccgtgagttgttggacaatgtgctgaatgggccatttagcatcacgctgagaaatcgtatacagtgtcatgtaatacgtgatgcggcaaaggatgaaatcatgactgaggagccattcttagtgttaaatgaagttacaattgaccgaggaatatcgtcttaccttaccaacctggaagtctactgtgacagttcttttgttacttgtgtacaaggagatggactaatcatatcaaccacatctggaagtacagcatattcattagcagccggaggatccatggttcatcctcaggtcccagggatccttttcaccccaatctgtccgcactccttgtcattcagacctttgattctgcctgaatacgtgactctgcgcgttcaagtgccatacaacagcaggggggctgcctgggcatcctttgacggcaaagatcgacagcagctatcgcccggtgacgccctgatctgcagcatttctccttggcctgtgcccacagcctgcctggtggactcgaccaccgatttcttccgcagcatccatgagggcctccactggaacttgaggaaatcccagtcatttgacggcccgcgtgattga

SEQ ID NO: 11530 - protein, 568 aa, Sorghum bicolor
  misc_feature: Ceres ANNOT ID no. 6017180
  misc_feature (257)..(538): Pfam Id: NAD_kinase Pfam Desc: ATP-NAD kinase
  misc_feature (1)..(568): NCBI GI: 115442329 NCBI Desc: os01g0957000 [oryza sativa (japonica cultivar-group)]
  misc_feature (41)..(568): NCBI GI: 75105828 NCBI Desc: probable nad kinase 1
  misc_feature (41)..(568): NCBI GI: 57900083 NCBI Desc: atp-nad kinase family protein-like [oryza sativa (japonica cultivar-group)]
  misc_feature (75)..(566): NCBI GI: 42565070 NCBI Desc: atp-nad kinase family protein [arabidopsis thaliana]
  misc_feature (66)..(260): NCBI GI: 115463657 NCBI Desc: os05g0388400 [oryza sativa (japonica cultivar-group)]
  misc_feature: Up-regulated in shoot tissues in response to salicylic acid treatment
MSLDELADKEPSSSEEVQLAPSDSKFRSIGPAPIPIPAPPSIRSLVDSVSDERVNVDIVASHQSENGSISTASSTGSLESEKAAYEFLAQTPVRSTDAHLVEFSEAMRTVAKALRRVAEGKAAAQAEAAEWKRKYELETAHKQQSKIKGYNSCISNDLDKLASQLTLETPAPDQLGCCGKHGICAHEVLQDEVPGPIPRSNHKVVGRKASFKLSWGCNGDKNGQHKHDFVSFEKGDITTAERSNKQILLKWESPPQTVLFITKPNSNSVRVLCAEMVRWLRESKNINIFVEPRVRKELLTEDSYYNFVQTWDNDEEIKMLHTKVDLIVTLGGDGTVLWAASLFKGPVPPVVAFALGSLGFMTPFPSEQYRELLDNVLNGPFSITLRNRIQCHVIRDAAKDEIMTEEPFLVLNEVTIDRGISSYLTNLEVYCDSSFVTCVQGDGLIISTTSGSTAYSLAAGGSMVHPQVPGILFTPICPHSLSFRPLILPEYVTLRVQVPYNSRGAAWASFDGKDRQQLSPGDALICSISPWPVPTACLVDSTTDFFRSIHEGLHWNLRKSQSFDGPRD

SEQ ID NO: 11531 - DNA, 1218 bp, Sorghum bicolor
  misc_feature: Ceres ANNOT ID no. 6017185
  misc_feature: Encodes the peptide sequence at SEQ ID NO 11532
atggcaagccgtatcctgtcgcgtcaaaatctgagaaagttggcttcgttcactctccagaatatatcccagaggcaactaatttctccgtaccctccagctcttagatctactattgcttctcccagcaaattcctgagccccctttacctgtctgggcattcattggctgtgagatgggcaacctatggatcagtgaatcttgttttgtctgatgatggaaaacccaagtttcaaattgaggaagtggagccctccacaaagagaaggtatttgacaaagaagcgcttgaaggttcagaggaagaaggaaaagaagaagaggaaggaggcaaataaaaatgatccacggcgcatcaggcccaagggaaagaagataaaacaaaaatttcccacaccagaagctaggctcaaatataagatcgagaaggccaaactaaaggaagttaggttggtcgaaaaactaaagaagtatgaggttgccaaagctcaaggccctatggctaaaccagatgatctcagtggcgaggaaaggttttacttgaagaaggtttcacagaaaaaatcaaattatgtccctgttggaaggcgaggagtgtttggaggcgtaattctgaacatgcatttgcattggaaaaaacatgaaactgtgaaggtcatatgtaagccctgcaaaccagggcagatccaggaatatgcaaatgagatagcacgactgagtggcggtatccctgtcaacatcattggagatgacaccatagtcttctaccgaggaaagaactatgttcagccagaagttatgtcgcctattgatacgctgtcaaagaaaaaggcacttgaaaaatcaaaatatgaacagtcgctggagacagttcggcgtttcattgcaatatctgaaaaggagcttgagctttattatcggcatgttgcactttatggaaatccacaatcccagaaagctgatcttgtttgtggtgatgatagagaaacttctttgcttaaaatgggaggattggatcaagggaaggaccaagagcctcatctggctaccaatcatttttctgatcaccacgtcagtgatgtttctgaatccgatgaagaagatagttccggtagtgaatatgatgttaatgacgatgagactgaaagcataaccagcatttctgaagactctattgtttctgatcatggcgatttagccaactggggcgaagcgtga

SEQ ID NO: 11532 - protein, 405 aa, Sorghum bicolor
  misc_feature: Ceres ANNOT ID no. 6017185
  misc_feature (173)..(257): Pfam Id: CRS1_YhbY Pfam Desc: CRS1 / YhbY domain
  misc_feature (1)..(402): NCBI GI: 57900276 NCBI Desc: group ii intron splicing factor crs1-like [oryza sativa (japonica cultivar-group)]
  misc_feature (1)..(397): NCBI GI: 57900277 NCBI Desc: group ii intron splicing factor crs1-like [oryza sativa (japonica cultivar-group)]
  misc_feature (1)..(397): NCBI GI: 57900278 NCBI Desc: group ii intron splicing factor crs1-like [oryza sativa (japonica cultivar-group)]
  misc_feature (64)..(314): NCBI GI: 89212802 NCBI Desc: cfm6 [zea mays]
  misc_feature (96)..(390): NCBI GI: 90265163 NCBI Desc: h0522a01.2 [oryza sativa (indica cultivar-group)]
MASRILSRQNLRKLASFTLQNISQRQLISPYPPALRSTIASPSKFLSPLYLSGHSLAVRWATYGSVNLVLSDDGKPKFQIEEVEPSTKRRYLTKKRLKVQRKKEKKKRKEANKNDPRRIRPKGKKIKQKFPTPEARLKYKIEKAKLKEVRLVEKLKKYEVAKAQGPMAKPDDLSGEERFYLKKVSQKKSNYVPVGRRGVFGGVILNMHLHWKKHETVKVICKPCKPGQIQEYANEIARLSGGIPVNIIGDDTIVFYRGKNYVQPEVMSPIDTLSKKKALEKSKYEQSLETVRRFIAISEKELELYYRHVALYGNPQSQKADLVCGDDRETSLLKMGGLDQGKDQEPHLATNHFSDHHVSDVSESDEEDSSGSEYDVNDDETESITSISEDSIVSDHGDLANWGEA

SEQ ID NO: 11533 - DNA, 318 bp, Sorghum bicolor
  misc_feature: Ceres ANNOT ID no. 6017323
  misc_feature: Encodes the peptide sequence at SEQ ID NO 11534
atggattcgtcgtcgtccggcggcggggacgacaggtggaagctgtccaacaaggggcggagcagatccggcaggccgcacgccatggccatggccacggacgacgcctcctccgcggtgctcagccggagctactcggccagcgtcgtcagcagcagcagcagcagcagcaggagtacacaagcacaagcagcagagtcgtcgtcgcactcgcggctgtccaagaagaaatgcgtggaggccgtcaaggagcaccgggcgcgcttctacatcgtccgccgctgcgtctccatgctcgtctgctggcgagactactag

SEQ ID NO: 11534 - protein, 105 aa, Sorghum bicolor
  misc_feature: Ceres ANNOT ID no. 6017323
  misc_feature (83)..(101): Pfam Id: DVL Pfam Desc: DVL family
  misc_feature (28)..(105): NCBI GI: 115442523 NCBI Desc: os01g0972300 [oryza sativa (japonica cultivar-group)]
  misc_feature (20)..(105): NCBI GI: 42822063 NCBI Desc: tpa: dvl15 [arabidopsis thaliana]
  misc_feature (41)..(105): NCBI GI: 42822049 NCBI Desc: tpa: dvl8 [arabidopsis thaliana]
  misc_feature (55)..(105): NCBI GI: 140068653 NCBI Desc: dvl [medicago truncatula]
  misc_feature (77)..(105): NCBI GI: 42822053 NCBI Desc: tpa: dvl10 [arabidopsis thaliana]
  misc_feature: Abnormal phyllotaxy, leaf number higher than wild-type
  misc_feature: Useful for making plants with modulated biomass
  misc_feature: Functional homolog of the protein sequence given in SEQ ID NO 13543
MDSSSSGGGDDRWKLSNKGRSRSGRPHAMAMATDDASSAVLSRSYSASVVSSSSSSSRSTQAQAAESSSHSRLSKKKCVEAVKEHRARFYIVRRCVSMLVCWRDY

SEQ ID NO: 11535 - DNA, 858 bp, Sorghum bicolor
  misc_feature: Ceres ANNOT ID no. 6017330
  misc_feature: Encodes the peptide sequence at SEQ ID NO 11536
atggagtacgacggcaagtacagcaaggaccagcagagcctcctcaacctcaagtgcgactgcctcctcttcgaccttgatgacacgctatacccattcaactctggcattgctgccgatatcatgaagaacatccaagattatatggtgcacaagctccgcgttgaggagaccataagcctggagctatgcgtcctcctctacaagcagtatggaaccaccatggctggcttgagggctgttgggtaccagtttgattacgatgactaccacagctttgtccatggaaggttgtcttatgacaaaatcaagcctgatcctgtgcttaggaacatcctcctgagcttacccattcgcaaacttgtgttcacaaacggtgacagagcccatgcttcaagggccctgaagaggctcgggatagaggattgctttgaaggagtcgtgtgctttgagacactgaacccgacatctcctccgcctgtcccagctgaggaacttcaaatctttgatataatgaagcatctgactcacccacagcctggagtggagctaccaaaatcacctatcctgtgcaaaccgtcaagggaggcgatgctgcaggctctcaaggtcgcctccattaatccacagacaactatattgttcgatgacagcttcaggaacattgaagctgcaaagcaaattggaatgcgtactgtcctggttggaacatctgagcggaaaaaaggtgctgaccacgccttggaaagcctccacaacatgaaggaagcactgcctgagctgtgggaagaagctgtgaaggatgaagatgtgaggaattcaagcaaagccggaatcgagacatccgtgattgcatga

SEQ ID NO: 11536 - protein, 285 aa, Sorghum bicolor
  misc_feature: Ceres ANNOT ID no. 6017330
  misc_feature (19)..(238): Pfam Id: Hydrolase Pfam Desc: haloacid dehalogenase-like hydrolase
  misc_feature (1)..(285): NCBI GI: 57899696 NCBI Desc: ripening-related protein-like [oryza sativa (japonica cultivar-group)]
  misc_feature (7)..(281): NCBI GI: 30697236 NCBI Desc: haloacid dehalogenase-like hydrolase family protein [arabidopsis thaliana]
  misc_feature (12)..(285): NCBI GI: 92873585 NCBI Desc: had-superfamily hydrolase subfamily ia, variant 3 [medicago truncatula]
  misc_feature (20)..(285): NCBI GI: 8885554 NCBI Desc: ripening-related protein-like; hydrolase-like [arabidopsis thaliana]
  misc_feature (20)..(285): NCBI GI: 32815949 NCBI Desc: at5g59490 [arabidopsis thaliana]
MEYDGKYSKDQQSLLNLKCDCLLFDLDDTLYPFNSGIAADIMKNIQDYMVHKLRVEETISLELCVLLYKQYGTTMAGLRAVGYQFDYDDYHSFVHGRLSYDKIKPDPVLRNILLSLPIRKLVFTNGDRAHASRALKRLGIEDCFEGVVCFETLNPTSPPPVPAEELQIFDIMKHLTHPQPGVELPKSPILCKPSREAMLQALKVASINPQTTILFDDSFRNIEAAKQIGMRTVLVGTSERKKGADHALESLHNMKEALPELWEEAVKDEDVRNSSKAGIETSVIA

SEQ ID NO: 11537 - DNA, 189 bp, Sorghum bicolor
  misc_feature: Ceres ANNOT ID no. 6017343
  misc_feature: Encodes the peptide sequence at SEQ ID NO 11538
atggcggcggtggatctgtcgaagctggtgaaggagaagcgcttctgggtggcctccttcctcgtcgtatgggcagcagcgctgcagcgccaggacgccttcaagcacaagttcggccttgacgaagcagacggacccgacgccgcggattcctcctctgcctctgcctctgcctcttcttcttcttag

SEQ ID NO: 11538 - protein, 62 aa, Sorghum bicolor
  misc_feature: Ceres ANNOT ID no. 6017343
  misc_feature: Useful for making plants with modulated heat sensitivity
  misc_feature: GREAT-hit functional homolog of the protein sequence given in SEQ ID NO 13251
  misc_feature: Useful for making plants with modulated heat sensitivity
  misc_feature: Functional homolog of the protein sequence given in SEQ ID NO 13251
MAAVDLSKLVKEKRFWVASFLVVWAAALQRQDAFKHKFGLDEADGPDAADSSSASASASSSS

SEQ ID NO: 11539 - DNA, 1365 bp, Sorghum bicolor
  misc_feature: Ceres ANNOT ID no. 6017382
  misc_feature: Encodes the peptide sequence at SEQ ID NO 11540
atgcctcgccacggccatgcgctgctcgccgcgctcctcgcgtccgcggtcgccgcggcgagcgcgcagccgagctacgatggctacggccagcaggagcacgtcagcacggccatgatcgcgctcctggccgccgtcgtcgcggtgttcgtcttcatcgccttcttcaccgtctacctccgccactgcaccggctacggggccaggtcagccgacggcgacgaccgcgccatgcgcaatttcgacgccttcatctcgcggtcgaggaggcagcggcggccgcgcgggctcgacgccgaggtggttgaggctttccccaccatgaagtacgccgaggccaaggcgctccgggtcggcaagcagggcggcggcgcgctggagtgcgcggtgtgcctcagcgagttcgaggacgaggagcggctcacgctcctgcccaagtgcagccacgccttccacccggactgcatcggcgagtggctcgccagccacgtcacctgccccgtctgccgctgcaacctcgacccaaacaagcaggataccagtagcgacgaggagctcggcagtttccctccgattccagtggcgagcagcatctccagcgaaactgcgttgtcagggcagggaccgctaccagtggccgtggtgatcgatgtgatcaccgaggcggaggaagaggtgcggaggcaggaggcactggagctgcagcagatagggacgcagcggcgagccgtgcggtcgcggtcggggcgcaagccggctccgacgcagctcgctcggtcgcactctacgggccactccctcgccgtccggctcgaccgcgacctggagcggttcacgctccggctgccggagcacgtgcgcagggagatggtcgccgcgggcgagcaccacagcatgcaattgcgtcgcgggcgaagagccggggaaggaagcagccgcggcggccgaagcgcacctctcggccggccgggcagatggcagtcgcttctggcggggacgttctccgggaagctgtccttcttttcggcgtccaggaggataacggttagctccgagctgggagaagtgtcgtcctcgtcgtccacgagggggagagggaagcgcgtggccgccgttgatgccgccgacgttccagctatagggagcgttcgccttgaccgcatcggaggcagcggcgggtccggtgcaaaagctggcgctgcgtcgcgcgaggtggcggcagcggcggacgaggagaagaaggcagcagctacgcagcaggagcagaaacgtaacctacaggcagagatgtctgaacagaagttgaattttctgctctgtatctatgcactttaccaagttgtgcattcgtgcttcacttcctag

SEQ ID NO: 11540 - protein, 454 aa, Sorghum bicolor
  misc_feature: Ceres ANNOT ID no. 6017382
  misc_feature (128)..(169): Pfam Id: zf-C3HC4 Pfam Desc: Zinc finger, C3HC4 type (RING finger)
  misc_feature (3)..(420): NCBI GI: 46392557 NCBI Desc: ring/c3hc4/phd zinc finger-like protein [oryza sativa (japonica cultivar-group)]
  misc_feature (4)..(366): NCBI GI: 47497675 NCBI Desc: ring-h2 zinc finger protein atl6-like [oryza sativa (japonica cultivar-group)]
  misc_feature (4)..(378): NCBI GI: 28558782 NCBI Desc: ring/c3hc4/phd zinc finger-like protein [cucumis melo]
  misc_feature (18)..(361): NCBI GI: 92890045 NCBI Desc: zinc finger, ring-type; ringv [medicago truncatula]
  misc_feature (7)..(364): NCBI GI: 38569180 NCBI Desc: osjnba0086b14.4 [oryza sativa (japonica cultivar-group)]
  misc_feature: The sequence is a functional homolog of SEQ ID NO 1131 in the 10/666,642US patent application
  misc_feature: The sequence is a functional homolog of SEQ ID NO 1132 in the 10/666,642US patent application
  misc_feature: The sequence is a functional homolog of SEQ ID NO 1133 in the 10/666,642US patent application
  misc_feature: The sequence is a functional homolog of SEQ ID NO 1134 in the 10/666,642US patent application
  misc_feature: The sequence is a functional homolog of SEQ ID NO 380 in the 10/666,642US patent application
  misc_feature: Useful for making plants with modulated growth and phenotype characteristics
  misc_feature: The sequence is a functional homolog of SEQ ID NO 1131 in the 20070033671 US patent application
  misc_feature: The sequence is a functional homolog of SEQ ID NO 1132 in the 20070033671 US patent application
  misc_feature: The sequence is a functional homolog of SEQ ID NO 1133 in the 20070033671 US patent application
  misc_feature: The sequence is a functional homolog of SEQ ID NO 1134 in the 20070033671 US patent application
  misc_feature: The sequence is a functional homolog of SEQ ID NO 380 in the 20070033671 US patent application
  misc_feature: The sequence is a functional homolog of SEQ ID NO 1132 in the 10/666,642 US patent application
  misc_feature: The sequence is a functional homolog of SEQ ID NO 1134 in the 10/666,642 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 468 in the 11/188,298 US application
MPRHGHALLAALLASAVAAASAQPSYDGYGQQEHVSTAMIALLAAVVAVFVFIAFFTVYLRHCTGYGARSADGDDRAMRNFDAFISRSRRQRRPRGLDAEVVEAFPTMKYAEAKALRVGKQGGGALECAVCLSEFEDEERLTLLPKCSHAFHPDCIGEWLASHVTCPVCRCNLDPNKQDTSSDEELGSFPPIPVASSISSETALSGQGPLPVAVVIDVITEAEEEVRRQEALELQQIGTQRRAVRSRSGRKPAPTQLARSHSTGHSLAVRLDRDLERFTLRLPEHVRREMVAAGEHHSMQLRRGRRAGEGSSRGGRSAPLGRPGRWQSLLAGTFSGKLSFFSASRRITVSSELGEVSSSSSTRGRGKRVAAVDAADVPAIGSVRLDRIGGSGGSGAKAGAASREVAAAADEEKKAAATQQEQKRNLQAEMSEQKLNFLLCIYALYQVVHSCFTS

SEQ ID NO: 11541 - DNA, 1821 bp, Sorghum bicolor
  misc_feature: Ceres ANNOT ID no. 6017424
  misc_feature: Encodes the peptide sequence at SEQ ID NO 11542
atggatggggcatccaacatccttgagaaatcgtcacatgaatgcatgcagtcttggtacttcaccagggaagaactagagaaattttctccatcaaggaaagatggtattactgaaaacaaggagtcagaaattcggcatttatattgttcatttatccgggatgtcggcatcaggctgaagctacctcagatgactctagcaacagcagtcatgctttgccatcgtttctatttacatcagtcccttgccaaaaatggatggcagacagttgcaacagtatgtgtatttctggcgtcgaaagttgaagatactccttgccccctggactatgtagttagagtagcctatgaaacaatgtataggcgggacactgctgcggctcaaaggatccgccagaaggatgtttttgagaagcagaaagcgctcattttgattggagagagattgcttcttacaactattcgatttgatttcaacattcagcatccttatagaccactttttgatgctatgcaaaatcttggcatcaatcaaaaagaagtgaaacaagtagcatggaactttgtgaatgactggcttaaaacaacattgtgcctacagtataaaccccagtacatagctgctggttccctttacctggctgcaaagcttcacaatatcaagcttcctttgcatggagcgcaagtttggtggcaccaatttgatgttgccccaaagccgctggaagctgtcattcatcaaatgatggagcttacggctgtgaaaaaattgatgcctgctcgtcccaatccggttaagctaaaggaaactttatgtgaagctaaactgagcttatctaatagcccagactctgtgttgaatcaatcaagcttgttaataagcagctcaagtcctgatattggcgagcctgaccaagtgcaggtggattcctgtcaatacttgataagcagtcacacgggtgattgtagagtctcaggtcctgacagcagtttgttgaatacttgtgctaatagaaatgtttcttgtaaagcacatgatgaagagagcttggatcaggccttaataaccaaacatgacaatgggatgatgtcttctagtaatcagacatcgttagatgctactataggcactgagggcagtgctatgaagcaggatgtaagccattgtaatgacttcaatatcagagtcaatgacgaaagcttgaaccaggtgtcaagaaatcagcatggtggtgtcccattacctgacgtggtatcactggatgccaaggtggacaaggaaagcagtcggtgtgtggaaccattgattgcaaactccagttgctgtactgacagtgttaatgtggatagcttatgccctgatcaaagattggctgttgctgcttcaggccctacagatgatgcaccatccgtgcttctggccaaggtggagtctgatcctttgagtgcaaagcttgaaaatattgatgttgccaggataaaaggtttattgatgaagaggaagagccggagagagatccaagagcaagccattgctttagatggcctcagtgaagaagcctggattgagagagagcttgagactgggattgttacaaaacaagaagccaattgtgctgccatctcagatgaactaagtgatgaagcctggattgagagagagctcgagtcagggattgtggtaggaccaagaaatgagcaggcaatcacttttgatggtttgagtgaaaatgattggattgagagggagcttgagtctgggatcatcgttgagccagcacctgctatcaagaagcggaggctggagtcgaggtgttag

SEQ ID NO: 11542 - protein, 606 aa, Sorghum bicolor
  misc_feature: Ceres ANNOT ID no. 6017424
  misc_feature (17)..(160): Pfam Id: Cyclin_N Pfam Desc: Cyclin, N-terminal domain
  misc_feature (1)..(599): NCBI GI: 46805809 NCBI Desc: cyclin k-like [oryza sativa (japonica cultivar-group)]
  misc_feature (166)..(599): NCBI GI: 46805810 NCBI Desc: cyclin t2-like protein [oryza sativa (japonica cultivar-group)]
  misc_feature (90)..(362): NCBI GI: 115444041 NCBI Desc: os02g0133000 [oryza sativa (japonica cultivar-group)]
  misc_feature (10)..(252): NCBI GI: 30694715 NCBI Desc: cyclin family protein [arabidopsis thaliana]
  misc_feature (4)..(252): NCBI GI: 145340421 NCBI Desc: cyclin-dependent protein kinase [arabidopsis thaliana]
  misc_feature: The sequence is a functional homolog of SEQ ID NO. 511 in the 11/188,298 US application
MDGASNILEKSSHECMQSWYFTREELEKFSPSRKDGITENKESEIRHLYCSFIRDVGIRLKLPQMTLATAVMLCHRFYLHQSLAKNGWQTVATVCVFLASKVEDTPCPLDYVVRVAYETMYRRDTAAAQRIRQKDVFEKQKALILIGERLLLTTIRFDFNIQHPYRPLFDAMQNLGINQKEVKQVAWNFVNDWLKTTLCLQYKPQYIAAGSLYLAAKLHNIKLPLHGAQVWWHQFDVAPKPLEAVIHQMMELTAVKKLMPARPNPVKLKETLCEAKLSLSNSPDSVLNQSSLLISSSSPDIGEPDQVQVDSCQYLISSHTGDCRVSGPDSSLLNTCANRNVSCKAHDEESLDQALITKHDNGMMSSSNQTSLDATIGTEGSAMKQDVSHCNDFNIRVNDESLNQVSRNQHGGVPLPDVVSLDAKVDKESSRCVEPLIANSSCCTDSVNVDSLCPDQRLAVAASGPTDDAPSVLLAKVESDPLSAKLENIDVARIKGLLMKRKSRREIQEQAIALDGLSEEAWIERELETGIVTKQEANCAAISDELSDEAWIERELESGIVVGPRNEQAITFDGLSENDWIERELESGIIVEPAPAIKKRRLESRC

SEQ ID NO: 11543 - DNA, 1317 bp, Sorghum bicolor
  misc_feature: Ceres ANNOT ID no. 6017457
  misc_feature: Encodes the peptide sequence at SEQ ID NO 11544
atggccgccgccgtccccacgccatccccattcctcgcttcaacccgccgcttcggcttcgcccctcgcctccgctccctcctccccgccgctgccatgtcttccgccgcggtatccgcctccgccctaagccccagttccggcactggggaagaggcgcaggcggccccgctcccgcactcgaccctcgagatcgcgggggcgcgccggggcctcctctccggcttcagcagcctccgcgccccgtaccgtgccttccccgtactcgcgtccaaccgacacgtcgagaccatcttcgctgcgttcacgcggtcgctccccgccgttaagctgcggcgcgagtgcctccgcgcccctgacgacggagccatcgcgctcgactgggtctctggcgacgaccgcgcgcttccgatggatgctccggtgcttatactcttgcctggtcttacaggtggaagtgatgatacatatgtaaggcatatgcttttgagagctcgaagcaagggatggcgtgttgtggtgtttaatagccgtggatgtgcagacagtcctgtgactacacccaagttctattctgcttcatttacaggggatctccgccaagttattggtcatattttaggacgttatccccagtctaatgtctatgctgctggttggtctcttggagcgaatattcttgtgcgctaccttggcgaggaaactgataaatgccctctatctggagcagtctccttgtgcaatccttttaatttggtaattgcagatgaagatttccacaaaggatttaacaacgtttatgatagagcattggctagggctttgacgactatatttaagaagcatgctctccttttcgaaggattggagggtgaatatgatatacccaaggcagcgaatgcaagaactgttagagattttgatgaggggctaacccgagtttcgtttggtttcaagtcagtggatgattattactcaaattcaagcagctcggattctatcaagaatgtttgcatacccttactgtgcatacaggctgataatgacccaattgcaccatccaggggaattcctagagatgatatcaaggcaaataagaactgtctacttatagtaacaccacagggtggccatcttggatgggtagcaggtgacgaagctccattcggatgtccttggacagacccaatagtgatggaatatctggaatatctccaaaatgagaaggactctagtacaaaaattaacatatcctatgagcaacagggtgtttcagaggcatcagtaccccatctaactgtgcatggccagagatag

SEQ ID NO: 11544 - protein, 438 aa, Sorghum bicolor
  misc_feature: Ceres ANNOT ID no. 6017457
  misc_feature (170)..(407): Pfam Id: Abhydrolase_1 Pfam Desc: alpha/beta hydrolase fold
  misc_feature (3)..(370): NCBI GI: 115447607 NCBI Desc: os02g0649400 [oryza sativa (japonica cultivar-group)]
  misc_feature (9)..(409): NCBI GI: 1350545 NCBI Desc: emb8 [picea glauca]
  misc_feature (96)..(384): NCBI GI: 18203711 NCBI Desc: alpha/beta hydrolase domain containing protein 3 [homo sapiens]
  misc_feature (96)..(384): NCBI GI: 23397663 NCBI Desc: alpha/beta hydrolase domain containing protein 3 [homo sapiens]
  misc_feature (95)..(384): NCBI GI: 52218984 NCBI Desc: zgc:92800 [danio rerio]
MAAAVPTPSPFLASTRRFGFAPRLRSLLPAAAMSSAAVSASALSPSSGTGEEAQAAPLPHSTLEIAGARRGLLSGFSSLRAPYRAFPVLASNRHVETIFAAFTRSLPAVKLRRECLRAPDDGAIALDWVSGDDRALPMDAPVLILLPGLTGGSDDTYVRHMLLRARSKGWRVVVFNSRGCADSPVTTPKFYSASFTGDLRQVIGHILGRYPQSNVYAAGWSLGANILVRYLGEETDKCPLSGAVSLCNPFNLVIADEDFHKGFNNVYDRALARALTTIFKKHALLFEGLEGEYDIPKAANARTVRDFDEGLTRVSFGFKSVDDYYSNSSSSDSIKNVCIPLLCIQADNDPIAPSRGIPRDDIKANKNCLLIVTPQGGHLGWVAGDEAPFGCPWTDPIVMEYLEYLQNEKDSSTKINISYEQQGVSEASVPHLTVHGQR

SEQ ID NO: 11545 - DNA, 1809 bp, Sorghum bicolor
  misc_feature: Ceres ANNOT ID no. 6017506
  misc_feature: Encodes the peptide sequence at SEQ ID NO 11546
atgacgcaagagccgacgtcactccgctcgatctgggcgcggacgccaaggacgcgacgacccaagtcgcgacgccaccagctccccatctcctcagacgccatggaggaagcccacggccacaggccctcctccaccgccggccgccccttcctctctggcctctgcgccgcggcgctccgccggaagcccctcggcgcccacggctccgccgccgccgccgccaccggcgagggcctcgtgcggcagctcggcgtccttgagctcgttctgctcgggatcggtgcgtccatcggcgccggcatattcgtcgtcactggcaccgtcgcccgcgacgccggcccaggtgttacaatcagttttgttcttgccggagctgcgtgtgtgctcaatgcattgtggtacgctgaactcgcatctcggttccctgctgtggttgggggagcatatttgtacacatatgcagcattcaatgagatcaccgccttcttggtcttcactcagttgatggtggattaccatatcggtgcagcaagcattgctcgtagcttagcaagctactttatccaattcttggagctaatcccgttcttgaagggccaaattccaagctggataggtcatggggaggagttttttggtggtgtcatatcaattaatatattggcccccattcttctcatcatcttaacagcgattctctgccgtggtgtcaaagagtcatcagcagtgaacacgtttatgacaacattgaagataatcattgttatagtcgttgtatttgctggtgtgtttgaggtggatgtatcaaactggtcaccatttatgccaaatggtttcaaatctgtagtgactggagccacagtagtcttttttgcatatgttggatttgatgcggttgctaattctgctgaggaagccaaaaggccacagagggacttgcccatcggtatactaggaagccttctagcatgtgtgttgttatatgttgctgtatgcttggtcattactggaatggttccatatacattactcggtgaagatgctcctttggctgaggcttttgctgccaagggcctgaaatttattactgtattgatcagcattggagctgttgctggacttactacaacacttcttgttggcttgtatgttcagtcacgtctgtatcttggacttggaagggatgggcttctaccttcagtatttgctaaagtacacccaacgaggcacactcctctgcaatctcagatttgggttggttgtgttgcagcagtcatggcaggcctctttaatgtgtctatgctctctcatattctttccgttggcactctgactggttattcagttgtatcagcttgtgtggtcactctaagatggaatgacaaaggaactagtcgtcgctcccttggaagtatgtcaatctggcaagagggtgttctatgtcttgtcatagttgctctttgtggttttatagtgggaatttgctatcgctttaactatgctatagcctttatggtagtggcttttgtgatagctgttgctgccagttttgctctccagtttcgtcaggtctatgtggatccacctggcttttcatgtcctggggtaccgttgcttcccattatctctgttttcttcaacatggtcctttttgctcagctacatgaagaagcttggtatagatttgtcatccttagtctcatcgctttgggagtttatgctggctatggtcagtacaatgctgttccttccagctcagaaaactctactattggttaccacggcattcctactgaggccccatga

SEQ ID NO: 11546 - protein, 602 aa, Sorghum bicolor
  misc_feature: Ceres ANNOT ID no. 6017506
  misc_feature (88)..(527): Pfam Id: AA_permease Pfam Desc: Amino acid permease
  misc_feature (1)..(602): NCBI GI: 49388207 NCBI Desc: amino acid permease-like [oryza sativa (japonica cultivar-group)]
  misc_feature (109)..(585): NCBI GI: 8810458 NCBI Desc: contains similarity to an amino acid transporter cationic 1 (atrc1) from mus musculus gi6671596 and contains an amino acid permease pf00324 domain. ests gbai995600, gbav566914,
  misc_feature (109)..(585): NCBI GI: 8810458 (continued) gbav531134 come from this gene. [arabidopsis thaliana]
  misc_feature (60)..(487): NCBI GI: 118036405 NCBI Desc: amino acid permease-associated region [burkholderia phytofirmans psjn]
  misc_feature (80)..(459): NCBI GI: 118475991 NCBI Desc: amino acid permease [bacillus thuringiensis str. al hakam]
  misc_feature (80)..(459): NCBI GI: 47567480 NCBI Desc: amino acid permease [bacillus cereus g9241]
  misc_feature: The sequence is a functional homolog of SEQ ID NO. 297 in the 11/188,298 US application
MTQEPTSLRSIWARTPRTRRPKSRRHQLPISSDAMEEAHGHRPSSTAGRPFLSGLCAAALRRKPLGAHGSAAAAATGEGLVRQLGVLELVLLGIGASIGAGIFVVTGTVARDAGPGVTISFVLAGAACVLNALWYAELASRFPAVVGGAYLYTYAAFNEITAFLVFTQLMVDYHIGAASIARSLASYFIQFLELIPFLKGQIPSWIGHGEEFFGGVISINILAPILLIILTAILCRGVKESSAVNTFMTTLKIIIVIVVVFAGVFEVDVSNWSPFMPNGFKSVVTGATVVFFAYVGFDAVANSAEEAKRPQRDLPIGILGSLLACVLLYVAVCLVITGMVPYTLLGEDAPLAEAFAAKGLKFITVLISIGAVAGLTTTLLVGLYVQSRLYLGLGRDGLLPSVFAKVHPTRHTPLQSQIWVGCVAAVMAGLFNVSMLSHILSVGTLTGYSVVSACVVTLRWNDKGTSRRSLGSMSIWQEGVLCLVIVALCGFIVGICYRFNYAIAFMVVAFVIAVAASFALQFRQVYVDPPGFSCPGVPLLPIISVFFNMVLFAQLHEEAWYRFVILSLIALGVYAGYGQYNAVPSSSENSTIGYHGIPTEAP

SEQ ID NO: 11547 - DNA, 1842 bp, Sorghum bicolor
  misc_feature: Ceres ANNOT ID no. 6017513
  misc_feature: Encodes the peptide sequence at SEQ ID NO 11548
atgcaggacggcggcgaggtgctgttcctggacggcgtcggggacgtcgccgtcaccgtcggccgcaacggcctctctgtacagcccctccacccggaactggtctcttcatgttggtcatccattacactgcagcctaaattagacagccaaatcaagttttcagatctttatgccatagagatgcttgataagggtcctatttgtgggccttggagtacaaggactactattcaaggcaagaaaaatatcgaggttatggcattccttctgatgcaccgctttgttgtacatggtattaccagaagaaggaaacacccttctccatgggtaccttgtgaatatatttttggtcacaaagacttgaagatatgcacagattggtttgagcgtctcatttcatgcataaacaatgaaggcggtagaccaaagaacctaatggtatttgttcatccattatgtggaaaaggtagaggggtcaggaactgggaaacagtgtctccattatttattagagcgaaaataaaaacaaaggtgatagtgacacagagagcagggcatgcatatgacacactatcatcattatcagatatagaattgaaggcatttgatggtgttgttgcagtgggtggtgacggtctatttaatgaaattctgaatgggatacttagttcgaggcacaaggtttcttatcccccaactcctgaggggtttggatatgttcggggcaatgataactgtgaagaacagacaagaaaatggataaactctagtatacccacaccagattctgggaatgccatgtttccagggaatgcaagtaaatctgatgaccaagaacctcttctttcaacttcaaatcctacaggactagagataccatcattaaattctactaaagaaccatgcattggagatcaggataacttagttgccttcccaaatgattggtttaggcttggcataattccttctggctcaactgatgctattgttctcagcacaactggggagagagatcctgtgacctctgctctgcttattattctcggcagaagggtgccactcgatatagctcaagtagtcagatggaaaagtagcccaacagctgaggtcttgcctactgtacgctatgctgcttcatttgcaggatatggcttttatggagaagttatcagggagagcgaaaagtaccggtggatgggtcctgcacgctatgacttttctggaacaatggtctttctgaagcataggtcatacgaggcaaaggttgcttttctcgagactccatacactcattcacttacagcatcagcagaggatgatgtaactggagcacaaccactacaatctctttggaacaaacctcgcaaaataatctgcagaacaaattgctctgtatgcaaagaggcttcaacatctggacaaaattcagaagatgtttcagacaactccagaacattatgcaagaaccagaagtgggtctggtccgaaggacgtttcctcagcgttggtgcagctatcatttcatgtcgtaatgaaagagcccctgatggcctggtagctgacgcacacctttcggatgggtttcttcatcttctgctcataagagactgccctcttcccctttacttgtggcatctaacacaatttaccaagaagggtttggatcctctgagcttcaagtttgttgagcatcacaagacaccagcatttacctttatctcatcacatgatgaaagtatctggaacttggacggagagatgtttcaggcgagtgaggtatctgtccaagcttgccggggccttgtcaacctgtttgcttcggggccagaggtgtag

SEQ ID NO: 11548 - protein, 613 aa, Sorghum bicolor
  misc_feature: Ceres ANNOT ID no. 6017513
  misc_feature (145)..(364): Pfam Id: DAGK_cat Pfam Desc: Diacylglycerol kinase catalytic domain
  misc_feature (1)..(612): NCBI GI: 115447687 NCBI Desc: os02g0656200 [oryza sativa (japonica cultivar-group)]
  misc_feature (257)..(613): NCBI GI: 34223322 NCBI Desc: ceramide kinase [arabidopsis thaliana]
  misc_feature (319)..(426): NCBI GI: 49257665 NCBI Desc: mgc84197 protein [xenopus laevis]
  misc_feature (319)..(432): NCBI GI: 30172874 NCBI Desc: ceramide kinase (acylsphingosine kinase) (mcerk)
  misc_feature (319)..(432): NCBI GI: 37360496 NCBI Desc: mkiaa1646 protein [mus musculus]
MQDGGEVLFLDGVGDVAVTVGRNGLSVQPLHPELVSSCWSSITLQPKLDSQIKFSDLYAIEMLDKGPICGPWSTRTTIQGKKNIEVMAFLLMHRFVVHGITRRRKHPSPWVPCEYIFGHKDLKICTDWFERLISCINNEGGRPKNLMVFVHPLCGKGRGVRNWETVSPLFIRAKIKTKVIVTQRAGHAYDTLSSLSDIELKAFDGVVAVGGDGLFNEILNGILSSRHKVSYPPTPEGFGYVRGNDNCEEQTRKWINSSIPTPDSGNAMFPGNASKSDDQEPLLSTSNPTGLEIPSLNSTKEPCIGDQDNLVAFPNDWFRLGIIPSGSTDAIVLSTTGERDPVTSALLIILGRRVPLDIAQVVRWKSSPTAEVLPTVRYAASFAGYGFYGEVIRESEKYRWMGPARYDFSGTMVFLKHRSYEAKVAFLETPYTHSLTASAEDDVTGAQPLQSLWNKPRKIICRTNCSVCKEASTSGQNSEDVSDNSRTLCKNQKWVWSEGRFLSVGAAIISCRNERAPDGLVADAHLSDGFLHLLLIRDCPLPLYLWHLTQFTKKGLDPLSFKFVEHHKTPAFTFISSHDESIWNLDGEMFQASEVSVQACRGLVNLFASGPEV

SEQ ID NO: 11549 - DNA, 1245 bp, Sorghum bicolor
  misc_feature: Ceres ANNOT ID no. 6017529
  misc_feature: Encodes the peptide sequence at SEQ ID NO 11550
atggccgccgctgccgctgctgctgccgctgccgccgtcctggacggcgtctcctcctgcgggagcaccaacatgcgccgcgccgaccaccacctccctcagctcccgatcccgctgccctgcatgggcgagcccaccgccgcctcccgcgtctcgccgggctcctccccggcccgctccgaggcctcgcggggcgcccctggctacaacgccgacgccgaggcggacccggagcccgaggccgaggcctccgtggggcggagcacgcagatgctgctcgcgatggccgccatgggcgggcgcggcgggccctacggccgccgcccggcctcgtcctacggcagctgcgccgcgtggagcgccgggtcgctcaccaggcaccgccccgcgtcgccgtccccgatctgcagccccgtgaacagcaacgacggcggcggcggcggggaggaggaggaccgcgaaccgcacggcggtgatgacgcctcctcgttcgtcacgccacggatgacacccaggcacccttctctgctggataggagagctgaattaggggccaatcaaatgcctccaagattcattcacaagaccacaccagctagatttatgcgccgagttcgctcctcacataatttccgtcagcgcgtgggtgcactagatgctatcaatgaaaggagactgcccaaagtcagtgaaggggatgacgagggcggtgatcaaaaagactggcaggctgatactgtgtcatctcgtatatcctcagctcgtgattggaattttgagtctgatggagcctatgagggtagcaatcacagcgattgtgcatttggcgattcatatggtgagaaccgtccagttgaagtgcaaaggatggagaggcggatcccgagctctgtgttaaaaccccaaggcaatttagtccatgccaaattggttgcctggaaggatgagcagattgcaaagctcatagaaaagctgaaaagcaaagaagccgatattgatgattggcagaggaagaagatcgcaaaggccaagcagaagatgagaagtgctgagttgaagttggagaagaagagagcggaagcggcagaaaagatgcaaaggtcgataaagcatgcacaaaaaaaagctgataagaagaaagtcaaggagcaggcagccactaaagttcagatagatggtgttgagagagcattggataagatgtcaaggacaggaagactcccctggtcactagcttttttgtga

SEQ ID NO: 11550 - protein, 414 aa, Sorghum bicolor
  misc_feature: Ceres ANNOT ID no. 6017529
  misc_feature (301)..(412): Pfam Id: Remorin_C Pfam Desc: Remorin, C-terminal region
  misc_feature (306)..(413): NCBI GI: 124360195 NCBI Desc: remorin, c-terminal region [medicago truncatula]
  misc_feature (294)..(413): NCBI GI: 102140033 NCBI Desc: remorin-related [musa acuminata]
  misc_feature (308)..(408): NCBI GI: 79458120 NCBI Desc: dna binding [arabidopsis thaliana]
  misc_feature (312)..(414): NCBI GI: 4883530 NCBI Desc: remorin 2 [lycopersicon esculentum]
  misc_feature (312)..(411): NCBI GI: 42573455 NCBI Desc: remorin family protein [arabidopsis thaliana]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 496 in the 11/435,388US patent application
  misc_feature: Useful for making plants with modulated growth and phenotype characteristics
  misc_feature: The sequence is a functional homolog of SEQ ID NO 496 in the 20060272060 US patent application
  misc_feature: The sequence is a functional homolog of SEQ ID NO 104 in the 20070033671 US patent application
  misc_feature: The sequence is a functional homolog of SEQ ID NO 1040 in the 20070033671 US patent application
MAAAAAAAAAAAVLDGVSSCGSTNMRRADHHLPQLPIPLPCMGEPTAASRVSPGSSPARSEASRGAPGYNADAEADPEPEAEASVGRSTQMLLAMAAMGGRGGPYGRRPASSYGSCAAWSAGSLTRHRPASPSPICSPVNSNDGGGGGEEEDREPHGGDDASSFVTPRMTPRHPSLLDRRAELGANQMPPRFIHKTTPARFMRRVRSSHNFRQRVGALDAINERRLPKVSEGDDEGGDQKDWQADTVSSRISSARDWNFESDGAYEGSNHSDCAFGDSYGENRPVEVQRMERRIPSSVLKPQGNLVHAKLVAWKDEQIAKLIEKLKSKEADIDDWQRKKIAKAKQKMRSAELKLEKKRAEAAEKMQRSIKHAQKKADKKKVKEQAATKVQIDGVERALDKMSRTGRLPWSLAFL

SEQ ID NO: 11551 - DNA, 1488 bp, Sorghum bicolor
  misc_feature: Ceres ANNOT ID no. 6017530
  misc_feature: Encodes the peptide sequence at SEQ ID NO 11552
atgcctgagcccggcctcggcgacctcggtcagcgccagctgctcaagggctggcctgacctgtggctggtgggggacaacaagcccggtggcctccgcgcgcgctccatggcggccgcgccgccttcgccgccgctcgagcccgaccaaaccctagcgctcccggacgcgctgctcctccgcgtcctcgcctgcctcccggagccccacctcacgggcgccgcctcgctggtctgcaggcggtggacgcgcctcgcgggccgcctgcgccgccgcctcgccgtgcgggactgggccttcgtcgcgcaccgcctgccctaccgcttccccaacctcaccgacctcgacctgttcccggcctccatcgccgcgcccaccgccgcggcgccacacgcctccccgctcctcacctgcggcgccgtctcgctaaccctagacgccagcgcggacccgccgctcggcgcctgccgcttcgtcgacgacgacgcgctcgaccgggggctcgccgccgtcgccgcgagcttccccaacctccgccgtctctcggccaccgccgcctcctccgagtccggcgggctcatggccatcgccggcgggtgcccgacgctgcaggagctcgagctccaccgctgcaccgacctcgccctccgcccggtctccgccttcgcgcacctccagatcctccgcattgtcgcggcggcacccgcgctctacggccccgccgagggcggcggcgtcacggacatcggcctcaccatcctcgcccacggatgcaagcggctcgtcaagctggagcttcagggttgcgaggggagctacgacggtatcgcggccgtggggcgctgctgtgcgatgcttgaggagcttaccatcgtggaccacaggatggacggcgggtggcttgccgccctagccttctgtgggaacctcaagaccctgcggctgcagagttgccgcaggatcgatgacgaccctggcccggcggaacaccttggtgcttgcctcacgctcgagagcctgcagctgcaccggtgccagctgcgtgaccgtagcgccctccacgccctctttttggtctgcgagggagcccgtgagatacaggtccagaattgctggggccttgaagatgatatgtttgccttggctggcctatgcaggagagtaaaattcctgttgttagaagggtgctcactattaacaactcgaggtctagaatcagtgataacctcatggagcgacctccagagtctggaagttgttacctgcaacaaaatcaaggatgaggaaataactcctgccctttcagagctgttctccaatctcaaagagctgaagtggcggcccgacaacaagtcacttcttgctgcgagcctcgttggcactgggatgggaaagaagggcagggtatttttcaaaaggcagatcttacccgcccatcaacggatcaaagggaaggtgcgcaactattcagcaggtgttgctgcttag

SEQ ID NO: 11552 - protein, 495 aa, Sorghum bicolor
  misc_feature: Ceres ANNOT ID no. 6017530
  misc_feature (1)..(386): NCBI GI: 49388621 NCBI Desc: f-box protein-like [oryza sativa (japonica cultivar-group)]
  misc_feature (45)..(382): NCBI GI: 42568460 NCBI Desc: f-box family protein [arabidopsis thaliana]
  misc_feature (54)..(445): NCBI GI: 21536497 NCBI Desc: f-box protein family, atfbl4 [arabidopsis thaliana]
  misc_feature (165)..(422): NCBI GI: 6164729 NCBI Desc: f-box protein fbl7 [homo sapiens]
  misc_feature (165)..(422): NCBI GI: 119628434 NCBI Desc: f-box and leucine-rich repeat protein 7, isoform cra_b [homo sapiens]
MPEPGLGDLGQRQLLKGWPDLWLVGDNKPGGLRARSMAAAPPSPPLEPDQTLALPDALLLRVLACLPEPHLTGAASLVCRRWTRLAGRLRRRLAVRDWAFVAHRLPYRFPNLTDLDLFPASIAAPTAAAPHASPLLTCGAVSLTLDASADPPLGACRFVDDDALDRGLAAVAASFPNLRRLSATAASSESGGLMAIAGGCPTLQELELHRCTDLALRPVSAFAHLQILRIVAAAPALYGPAEGGGVTDIGLTILAHGCKRLVKLELQGCEGSYDGIAAVGRCCAMLEELTIVDHRMDGGWLAALAFCGNLKTLRLQSCRRIDDDPGPAEHLGACLTLESLQLHRCQLRDRSALHALFLVCEGAREIQVQNCWGLEDDMFALAGLCRRVKFLLLEGCSLLTTRGLESVITSWSDLQSLEVVTCNKIKDEEITPALSELFSNLKELKWRPDNKSLLAASLVGTGMGKKGRVFFKRQILPAHQRIKGKVRNYSAGVAA

SEQ ID NO: 11553 - DNA, 312 bp, Sorghum bicolor
  misc_feature: Ceres ANNOT ID no. 6017631
  misc_feature: Encodes the peptide sequence at SEQ ID NO 11554
atggaagcgaagtttttccgtttcctgaagctcgttggggtcggcttcaaagcaaggtcagagagccaaggccgtgagctgttcctgaaactgggattcagccatgaggtgcagttcaccgctcccccagctgtccgtgtcttctgcttcaaacccaacataatttgctgcaccggcatcgataaggacagggtgcaccagttcgccggtgctgtccggagctgtaaacctccagaggtgtacaaggggaaggggatcctgtacattgacgaggttatcaagactaagcccggaaagaagcaaaagaagtga

SEQ ID NO: 11554 - protein, 103 aa, Sorghum bicolor
  misc_feature: Ceres ANNOT ID no. 6017631
  misc_feature (12)..(89): Pfam Id: Ribosomal_L6 Pfam Desc: Ribosomal protein L6
  misc_feature (1)..(101): NCBI GI: 786209 NCBI Desc: rpl6 [marchantia polymorpha]
  misc_feature (1)..(101): NCBI GI: 91208877 NCBI Desc: ribosomal protein l6 [physcomitrella patens]
  misc_feature (1)..(101): NCBI GI: 32966605 NCBI Desc: ribosomal protein l6 [chara vulgaris]
  misc_feature (1)..(101): NCBI GI: 22417017 NCBI Desc: ribosomal protein l6 [chaetosphaeridium globosum]
  misc_feature (5)..(101): NCBI GI: 77165772 NCBI Desc: ribosomal protein l6 [nitrosococcus oceani atcc 19707]
MEAKFFRFLKLVGVGFKARSESQGRELFLKLGFSHEVQFTAPPAVRVFCFKPNIICCTGIDKDRVHQFAGAVRSCKPPEVYKGKGILYIDEVIKTKPGKKQKK

SEQ ID NO: 11555 - DNA, 312 bp, Sorghum bicolor
  misc_feature: Ceres ANNOT ID no. 6017906
  misc_feature: Encodes the peptide sequence at SEQ ID NO 11556
atggcgggagcggtgcccctggccacggcgccggcactcgcggcggcggggagcctgtacgaggcgctgcgggtaggccgcgccgcgacgcaggtggagatcaaggtcgcctaccgcgccatggccaagcgcctccaccccgacacctcccgctcgtcccgaactgcggcggcgttcctggagatccagcgcgcctacgagacgctgtcgaacccggacgcccgagcgcactacgaccgctcgctcggcccgcggccgggcgccggcggcggcatgcgggtgcgtcggtgggaaacggaccagtgctggtag

SEQ ID NO: 11556 - protein, 103 aa, Sorghum bicolor
  misc_feature: Ceres ANNOT ID no. 6017906
  misc_feature (18)..(79): Pfam Id: DnaJ Pfam Desc: DnaJ domain
  misc_feature (8)..(103): NCBI GI: 115469980 NCBI Desc: os06g0716100 [oryza sativa (japonica cultivar-group)]
  misc_feature (9)..(103): NCBI GI: 124294789 NCBI Desc: dnaj-like protein [solanum lycopersicum]
  misc_feature (14)..(103): NCBI GI: 1684851 NCBI Desc: dnaj-like protein [phaseolus vulgaris]
  misc_feature (7)..(103): NCBI GI: 42408733 NCBI Desc: dnaj protein homolog-like [oryza sativa (japonica cultivar-group)]
  misc_feature (7)..(103): NCBI GI: 9843641 NCBI Desc: j11 protein [arabidopsis thaliana]
  misc_feature: Useful for making plants with modulated heat sensitivity
  misc_feature: Functional homolog of the protein sequence given in SEQ ID NO 13502
MAGAVPLATAPALAAAGSLYEALRVGRAATQVEIKVAYRAMAKRLHPDTSRSSRTAAAFLEIQRAYETLSNPDARAHYDRSLGPRPGAGGGMRVRRWETDQCW

SEQ ID NO: 11557 - DNA, 1551 bp, Sorghum bicolor
  misc_feature: Ceres ANNOT ID no. 6018309
  misc_feature: Encodes the peptide sequence at SEQ ID NO 11558
atggcattcacctcccaatccctaatcttccgggcagccgcctcgcctccttgtccccgcatagccccgtcgcccggtcgcgtcaccctccgggaccaccgggccgccttcccgcccctcgcggcggcctccacctcgatggcgtcctcggagagcgaagataagagggaagccaagctgtggggcgggcggttcgaggagggcgtcaccgacgccgtggagcgcttcacggagtccatatcctacgactggcaactctacaagtacgacatcatgggcagcaaggcccacgcctccatgctcgccggccagggtttgataacagctactgatagggatatcatcttagaggggcttgatcagatagagaggctgatccaagaaggcaaatttgaatggaggaaggaccgggaggacgtgcatatgaacattgaagcggctctgattgagagggttggtgagccagccaagaagttgcatactgctaggagccgcaatgaccaaattgtgacagatctaaggctatggtgccgtgatgctattgacaagattttgattcgtatcaagcagcttcaggtgtctttggttattttggcttcaaaatatgttgacttaatagtcccgggttatactcatctgcaaagggcacagcctgttctgctgccacatcttctcttatcatatgttgaacagttggagcgtgatgctggtcggctggtcaactgcagggagcgagtgaatttctgccctcttggtgcttgtgctttggctggaactggacttcccattgataggttccaaactgctaaagatttgaaatttacggctccaatgaagaatagcattgatgcagtatcagaccgtgactttgtactagagtttcttgccgccaattcaattgctgctgttcatctttcgcgaattggtgaagaatgggttctttgggcatcagaggaatttgggttcctgacaccaagtgacaaagtttcaacaggaagcagcattatgccccagaagaaaaatccagatccaatggagcttgttcgtgggaaatctgctagagttgttggagacctcatgactgttctaaccctctgtaaaggccttccacaagcctacaaccgtgaccttcaggaagacaaggaacccttgtttgatagtgtgaaagccgtattaggaatgcttgaagtatgcacggagtttgctcaaaatatctcatttaattcgaaaagaatacaaagttcccttccagctggttatctggatgcaacgacgctggcggattatcttgtgaagaagggaattcctttcagaacttctcacgagatagttggaaggtctgttgctctatgcgtctacaagcagtgtcagctagccgagcttgaattggatgacctaaaatctgtccatcctgtatttgagggcgacgtctatgaatacctgggggttgaaaacgccgtaaacaagttcatatcctatggctctactggttcagaacaagtaaagaagcagcttgaggattggcgcatccagctcgggatcagctcataa

SEQ ID NO: 11558 - protein, 516 aa, Sorghum bicolor
  misc_feature: Ceres ANNOT ID no. 6018309
  misc_feature (63)..(357): Pfam Id: Lyase_1 Pfam Desc: Lyase
  misc_feature (5)..(516): NCBI GI: 2252472 NCBI Desc: argininosuccinate lyase [arabidopsis thaliana]
  misc_feature (59)..(512): NCBI GI: 91202263 NCBI Desc: strongly similar to argininosuccinate lyase argh [candidatus kuenenia stuttgartiensis]
  misc_feature (52)..(506): NCBI GI: 93452935 NCBI Desc: argininosuccinate lyase [delta proteobacterium mlms-1]
  misc_feature (52)..(506): NCBI GI: 93454079 NCBI Desc: argininosuccinate lyase [delta proteobacterium mlms-1]
  misc_feature (53)..(505): NCBI GI: 109940294 NCBI Desc: argininosuccinate lyase (arginosuccinase) (asal)
  misc_feature (53)..(505): SWISSPROT Homolog: EC 4.3.2.1 Argininosuccinate lyase
  misc_feature: Useful for making plants with modulated salt sensitivity
  misc_feature: Useful for making plants with modulated salt sensitivity
  misc_feature: GREAT-hit functional homolog of the protein sequence given in SEQ ID NO 13289
  misc_feature: Useful for making plants with modulated salt sensitivity
  misc_feature: Functional homolog of the protein sequence given in SEQ ID NO 13289
MAFTSQSLIFRAAASPPCPRIAPSPGRVTLRDHRAAFPPLAAASTSMASSESEDKREAKLWGGRFEEGVTDAVERFTESISYDWQLYKYDIMGSKAHASMLAGQGLITATDRDIILEGLDQIERLIQEGKFEWRKDREDVHMNIEAALIERVGEPAKKLHTARSRNDQIVTDLRLWCRDAIDKILIRIKQLQVSLVILASKYVDLIVPGYTHLQRAQPVLLPHLLLSYVEQLERDAGRLVNCRERVNFCPLGACALAGTGLPIDRFQTAKDLKFTAPMKNSIDAVSDRDFVLEFLAANSIAAVHLSRIGEEWVLWASEEFGFLTPSDKVSTGSSIMPQKKNPDPMELVRGKSARVVGDLMTVLTLCKGLPQAYNRDLQEDKEPLFDSVKAVLGMLEVCTEFAQNISFNSKRIQSSLPAGYLDATTLADYLVKKGIPFRTSHEIVGRSVALCVYKQCQLAELELDDLKSVHPVFEGDVYEYLGVENAVNKFISYGSTGSEQVKKQLEDWRIQLGISS

SEQ ID NO: 11559 - DNA, 852 bp, Sorghum bicolor
  misc_feature: Ceres ANNOT ID no. 6018327
  misc_feature: Encodes the peptide sequence at SEQ ID NO 11560
  misc_feature: Down-regulated in root tissues in response to salicylic acid treatment
atggcgaccgccaccgctacctcttcctcctcgctgaccactcctctcctccgcccgaaccccaataccaaccccgctcccagatctctccaactcctcaggagcaggaggtgcgctcgtgccgtgactgccgccgtagccggaggcccggtgccttacggggctgctccgaggcgcgggatttggtcgatcagggatgacttggtggtgccgaggtcgccctacttcccagtggagtctgcggcggggcaggagcgtgggccgtcacccatggtgatggagcggttccagagcgtcgttagtcagcttttccagcataggattatccggtgtggtggccctgttgaggatgatatggccaacatcattgtagcacagctgctctacctcgatgctattgatcccactaaggatatcattatgtatgtgaattcaccaggagggtcagtgacagctggaatggctatattcgatacaatgaagcatatcaggcctgatgtatccactgtttgtatcggactagctgcaagtatgggagcttttctacttagtgctgggaccaaaggaaagcgatacagcttaccaaactcgaggataatgatccatcaacctcttggaggggcccaaggacaggagactgatcttgaaattcaggctaatgagatgttgcaccacaaggctaacttaaatggataccttgcataccacactgggcagcccctggataagatcaatgtagatactgaccgtgactactttatgagcgcgaaagaagcaaaggagtatggccttattgatggagtaatcatgaatcctctcaaggcccttcaaccacttccagcttccagttag

SEQ ID NO: 11560 - protein, 283 aa, Sorghum bicolor
  misc_feature: Ceres ANNOT ID no. 6018327
  misc_feature (91)..(272): Pfam Id: CLP_protease Pfam Desc: Clp protease
  misc_feature (1)..(283): NCBI GI: 115452603 NCBI Desc: os03g0308100 [oryza sativa (japonica cultivar-group)]
  misc_feature (7)..(283): NCBI GI: 15485610 NCBI Desc: clp protease 2 proteolytic subunit [lycopersicon esculentum]
  misc_feature (1)..(282): NCBI GI: 21536639 NCBI Desc: atp-dependent clp protease proteolytic subunit clpp5 [arabidopsis thaliana]
  misc_feature (84)..(272): NCBI GI: 145342132 NCBI Desc: chloroplast clp protease, subunit of clpp peptidase complex [ostreococcus lucimarinus cce9901]
  misc_feature (84)..(272): NCBI GI: 119358863 NCBI Desc: clpp1 clp protease proteolytic subunit clpp (ic) [ostreococcus tauri]
  misc_feature (94)..(269): SWISSPROT Homolog: EC 3.4.21.92 ATP-dependent Clp protease proteolytic subunit 1
  misc_feature: Useful for making plants with modulated biomass
  misc_feature: Functional homolog of the protein sequence given in SEQ ID NO 13114
  misc_feature: Down-regulated in root tissues in response to salicylic acid treatment
MATATATSSSSLTTPLLRPNPNTNPAPRSLQLLRSRRCARAVTAAVAGGPVPYGAAPRRGIWSIRDDLVVPRSPYFPVESAAGQERGPSPMVMERFQSVVSQLFQHRIIRCGGPVEDDMANIIVAQLLYLDAIDPTKDIIMYVNSPGGSVTAGMAIFDTMKHIRPDVSTVCIGLAASMGAFLLSAGTKGKRYSLPNSRIMIHQPLGGAQGQETDLEIQANEMLHHKANLNGYLAYHTGQPLDKINVDTDRDYFMSAKEAKEYGLIDGVIMNPLKALQPLPASS

SEQ ID NO: 11561 - DNA, 2124 bp, Sorghum bicolor
  misc_feature: Ceres ANNOT ID no. 6018345
  misc_feature: Encodes the peptide sequence at SEQ ID NO 11562
atgccgtcgatcaccggaggtggacgcgggggcctcttctcggtgcaccagggcgcgctctggtggctccgccgttgccacagcccgctcttctcgtcactagccggcggaggaggccggggcgacgcgccgcatcttcccgtactcatcgtcggagctggtccagttgggctcgtcctctccttcctcctgaccaaattcgggatcaaatgcacggtgatagagaagaatgtggaattcactaggcacccccgagcacacttcatcaacaaccgcacaatggagatcttccgcaagttggatggtttggctggggacattgagaggtcccagccaccggtagatttgtggaggaagttcgtctactgtacttcactctccggttccgtccttggatcggttgatcacatgaaacaggaagattttgacaaggtcattagtcctatttccgttgcacatttctcgcagtacaagttagtcgatttgctactcaagaagcttgaaggaattggtttccagacatgctttcctggtgatactggcaactcaacgcaagatctggtactggaaagcaagatattgatgggacacgagtgcacatcccttcagcagactgatgagggcattctggttggagtgtcagttaacaatggggggaggataattgagagaaagctgcactgtggtcttcttctagggacagatggcgcaagaagtacagtgcgtgaattggcaggtatatcgatggaaggtgaaagggacttgcagaaactggtcagtgtgcattttcttagcaaagatctaggcaggtatttgtccagtcagaggccagggatgctgttctttgtttttaatccaggtgcaattggtgtactagttgcacatgacctggagaatggggaatttgtattgcagatgtttgaagatttcagcgctaaggtatgtgagcaaattattgtcaagttagttggatgggagccagcagatgttcatgttttagacataaaaccatgggcaatgcatgctgaagttgcagagaagtacatctgctgcaacaatcgagtaatcctttctggtgatgctgctcatcggtttcctcctgccggtggttttggaatgaacactggtgtccaggatgcacataatttggcgtggaaattgggcttgctgctgaatggtgccgcctctccatcaatattacaaagttatgagtcagagcgccggcctgttgcaattttcaatacaaaacttagtgtggagaacttcaaggcagctatgtctattcctgcgacccttggccttgatccaactattgcaaactcagtgcatcaagttataaatagaagcctgggatcaatcattccgagaaatgtacagaaggcagttctggaaggattgttttcccttggtcgggcacaagtctcagactatatcctgaatgagaaaaatccccttgggtccttgagactatcaagattgagaagtattcttgatgaaggcaaaagtcttcagctgcagttccctgcagaggatcttggcttcgtctatgaagaaggtgcccttgttcctgaagctagttatgagaagactcaggaaggaggaaaactacagcattctaagagggcatcaagagagtacatcccatctgctaaggttggttcgcggcttccccacatgctagtaagaggactgcctgcttcaagtgagggtatgttctcaacgctggacctagtgagtggggataaactcgagtttgttctcatcattgcaccagtgaaagagtcatatgagattgctcgtgccaccctcaagatagcagatgagcttaagctatcagccaaagtatgcgtaatgtggccaagaggttcgactggtgctgaagtggaagagagcaggtctgagttggcgccctggacaaactacatcgatgttgaggaagtacctagggtgtctggtagttcatggtgggagatgtgtcggattagtaggaaaaatgtccttttggttaggcctgatgagcacatagcatggcgaacagaatcggacagggtcagggatgctgaatcagaaattaggagagtattctctcatgttctgtgcctaaataggtgtaagaatttgtaa

SEQ ID NO: 11562 - protein, 707 aa, Sorghum bicolor
  misc_feature: Ceres ANNOT ID no. 6018345
  misc_feature (45)..(418): Pfam Id: FAD_binding_3 Pfam Desc: FAD binding domain
  misc_feature (156)..(701): NCBI GI: 20161609 NCBI Desc: b1065g12.11 [oryza sativa (japonica cultivar-group)]
  misc_feature (410)..(701): NCBI GI: 115441665 NCBI Desc: os01g0901700 [oryza sativa (japonica cultivar-group)]
  misc_feature (48)..(439): NCBI GI: 118760981 NCBI Desc: monooxygenase, fad-binding [sphingomonas wittichii rw1]
  misc_feature (46)..(436): NCBI GI: 111017560 NCBI Desc: aromatic ring hydroxylase [rhodococcus sp. rha1]
  misc_feature (46)..(465): NCBI GI: 42782569 NCBI Desc: fad-binding monooxygenase, phea/tfdb family [bacillus cereus atcc 10987]
MPSITGGGRGGLFSVHQGALWWLRRCHSPLFSSLAGGGGRGDAPHLPVLIVGAGPVGLVLSFLLTKFGIKCTVIEKNVEFTRHPRAHFINNRTMEIFRKLDGLAGDIERSQPPVDLWRKFVYCTSLSGSVLGSVDHMKQEDFDKVISPISVAHFSQYKLVDLLLKKLEGIGFQTCFPGDTGNSTQDLVLESKILMGHECTSLQQTDEGILVGVSVNNGGRIIERKLHCGLLLGTDGARSTVRELAGISMEGERDLQKLVSVHFLSKDLGRYLSSQRPGMLFFVFNPGAIGVLVAHDLENGEFVLQMFEDFSAKVCEQIIVKLVGWEPADVHVLDIKPWAMHAEVAEKYICCNNRVILSGDAAHRFPPAGGFGMNTGVQDAHNLAWKLGLLLNGAASPSILQSYESERRPVAIFNTKLSVENFKAAMSIPATLGLDPTIANSVHQVINRSLGSIIPRNVQKAVLEGLFSLGRAQVSDYILNEKNPLGSLRLSRLRSILDEGKSLQLQFPAEDLGFVYEEGALVPEASYEKTQEGGKLQHSKRASREYIPSAKVGSRLPHMLVRGLPASSEGMFSTLDLVSGDKLEFVLIIAPVKESYEIARATLKIADELKLSAKVCVMWPRGSTGAEVEESRSELAPWTNYIDVEEVPRVSGSSWWEMCRISRKNVLLVRPDEHIAWRTESDRVRDAESEIRRVFSHVLCLNRCKNL

SEQ ID NO: 11563 - DNA, 1350 bp, Sorghum bicolor
  misc_feature: Ceres ANNOT ID no. 6018351
  misc_feature: Encodes the peptide sequence at SEQ ID NO 11564
atggcgcggcacctcgcgccttcgtctggaagcctccaccgcctcctcgcttctcgcaactacccgcccacttcccaggcgccgcctccccgcccgctcctcctcccgaagacccgatcggcggctatgcagctcccgcgacgcgggcggcgcgacgtcgtcgccgctgcagctgcctccgcaccgtcgccctcttctccggggaccgaggtggcggagggagcggcctgggggaaggtctccgccgtgctcttcgatatggacggcgtgctctgcgacagcgaggagccctcgcgacaggccggcgtcgatgtcttcgccgagatgggcgtcgaggtcaccgtggatgacttcgtccccttcatgggcactggtgaggccaatttccttggaggtgtcgcaagagctaaaggagtaaaaggtttcaatcctgaaagtgccaagaagaggttttttgagatatatcttgacaagtacgcaaagccaaattctggcatcggattccctggggctctggagctcatcatggagtgcaaaaattctggtcttaaggttgctgttgcatccagtgccgacaggattaaggtggatgccaatctggctgctgctggtttgcctgtgtctctatttgatgctattgtttctgctgacgcgtttgaaaatttgaagcccgctccggacatatttctggcagcatcaaagaacttaggtgttgacacaaacaagtgcattgtgatagaagatgcacttgctggtgttcaagctgcaaaagctgcggaaatgagatgtatcgctgtgacgactactctagaggaagttgcgttacaacaaggcagtccctcactcatacgaaagaatattggagacatttcaattaacgacattttgtatggtggttctaatgctcgccacaatgaaggggcagaaaatactgagaatagtagttcggtacgaaatgctttgcctgagagtctgaacggaacaactggtgctggactttctgacacaaaaggttctccaacctcaaaaaatgaagggctgttgggttctcgacgcgaaatattgagatatgggagtctgggaatagccctttcctgtttttttgttgcagtcagaaattggaaggcaatgcagtttgcatctcccaaagggctgctgaatttcttcatgggtggaaatagttcagtttttgccagaaatgaaggagaatctttgtcatcaagagttcaacaaataaagaaatatctagctgagtttgaatctgggggttctgccacatatgttcctgagtttccaagaaagcttgactggttgaatacagctccacttcagtttggacgagtaatttag

SEQ ID NO: 11564 - protein, 449 aa, Sorghum bicolor
  misc_feature: Ceres ANNOT ID no. 6018351
  misc_feature (80)..(269): Pfam Id: Hydrolase Pfam Desc: haloacid dehalogenase-like hydrolase
  misc_feature (340)..(447): NCBI GI: 115452641 NCBI Desc: os03g0311300 [oryza sativa (japonica cultivar-group)]
  misc_feature (79)..(269): NCBI GI: 21672855 NCBI Desc: hydrolase, haloacid dehalogenase-like family [chlorobium tepidum tls]
  misc_feature (80)..(264): NCBI GI: 76795752 NCBI Desc: had-superfamily hydrolase, subfamily ia, variant 3:had-superfamily hydrolase, subfamily ia, variant 1 [thermoanaerobacter ethanolicus atcc 33223]
  misc_feature (80)..(264): NCBI GI: 114844345 NCBI Desc: had-superfamily hydrolase subfamily ia, variant 3 [thermoanaerobacter ethanolicus x514]
  misc_feature (80)..(290): NCBI GI: 76258902 NCBI Desc: had-superfamily hydrolase subfamily ia, variant 3:had-superfamily hydrolase, subfamily ia, variant 1 [chloroflexus aurantiacus j-10-fl]
MARHLAPSSGSLHRLLASRNYPPTSQAPPPRPLLLPKTRSAAMQLPRRGRRDVVAAAAASAPSPSSPGTEVAEGAAWGKVSAVLFDMDGVLCDSEEPSRQAGVDVFAEMGVEVTVDDFVPFMGTGEANFLGGVARAKGVKGFNPESAKKRFFEIYLDKYAKPNSGIGFPGALELIMECKNSGLKVAVASSADRIKVDANLAAAGLPVSLFDAIVSADAFENLKPAPDIFLAASKNLGVDTNKCIVIEDALAGVQAAKAAEMRCIAVTTTLEEVALQQGSPSLIRKNIGDISINDILYGGSNARHNEGAENTENSSSVRNALPESLNGTTGAGLSDTKGSPTSKNEGLLGSRREILRYGSLGIALSCFFVAVRNWKAMQFASPKGLLNFFMGGNSSVFARNEGESLSSRVQQIKKYLAEFESGGSATYVPEFPRKLDWLNTAPLQFGRVI

SEQ ID NO: 11565 - DNA, 237 bp, Sorghum bicolor
  misc_feature: Ceres ANNOT ID no. 6018492
  misc_feature: Encodes the peptide sequence at SEQ ID NO 11566
atgggcctgtggacgttgctggagggctttttgcttctggcaaatgcgttggctatattgaatgaagaccgctttcttgctcccaggggatggagcatgcctgaagtatcaggaaatgggcaaacaaagtcgttgaagggccagatcgtggggcttatctatgctacacaatttctgaggatgcccttaatagcactcaatgttctgatcattgttgtgaaactggtgtctggctga

SEQ ID NO: 11566 - protein, 78 aa, Sorghum bicolor
  misc_feature: Ceres ANNOT ID no. 6018492
  misc_feature (3)..(78): Pfam Id: Yos1 Pfam Desc: Yos1-like
  misc_feature (1)..(78): NCBI GI: 115452825 NCBI Desc: os03g0331900 [oryza sativa (japonica cultivar-group)]
  misc_feature (3)..(78): NCBI GI: 68051651 NCBI Desc: ip03767p [drosophila melanogaster]
  misc_feature (3)..(78): NCBI GI: 62858905 NCBI Desc: ier3ip1 [xenopus tropicalis]
  misc_feature (3)..(78): NCBI GI: 74735295 NCBI Desc: immediate early response 3-interacting protein 1
  misc_feature (3)..(78): NCBI GI: 123987075 NCBI Desc: immediate early response 3 interacting protein 1 [synthetic construct]
MGLWTLLEGFLLLANALAILNEDRFLAPRGWSMPEVSGNGQTKSLKGQIVGLIYATQFLRMPLIALNVLIIVVKLVSG

SEQ ID NO: 11567 - DNA, 1647 bp, Sorghum bicolor
  misc_feature: Ceres ANNOT ID no. 6018580
  misc_feature: Encodes the peptide sequence at SEQ ID NO 11568
atgccattgcccagcgaccctggtcctcgtcctgctgcgcccgccatggcgaagcagttcaaggtcctgcttcctcctttccacaagctgcgcatctccgacgagctcgccgggtgcttcgacgccggcgaaggcgaaggggcggcagagcggacggccctcgtggtctctccgttcggcaaggtgtggcgcgtggaggtgggccgggacggcgacggtgcgttcctggggcgcggctgggcggagttcttggccgcgcacggcgtcggcctcggttggttcgtcgtgctccggcacgagggcggcggcgcgctcaccgtcaaggtgttcgacaccagcttgtgcatcaaggagttcggcgctccggcggcagttatgacatccagaaccagcaaaggtgttatctgtaagccacagttcatcaggatttttcatccatatctctcggaaaagatgatattgcctgctaggtttgtgaaaaattacgtcacagaagagtgcctaaacagcaagacggccgtcattctcagcccccttggcaaattttggcatattgagcttaagaatgataaatcaggcatgttcttcacaggtggctggtcacagtttctggagttccatggaatatgtaatggtgacgttttgctcttgagatatgaagggaacatggttttcaaattcaaagcatttggacttggtggatgccagaaagatttcaggcaccagaacgctgggattcaactaaatacggaaaaacgacaggaaacacattcttccatcaggaaacgtaaaagcaatgataataagtcaagcagtgaagaaaacaagaggccaaaaagttcagtgacttccccatcactgaaactgcaagaaccctatcagatggggacaacatcttggataaagaaaaagatcaatacctatgcacttgagcgccttctttcgttgtcaaagaagttctgcaactggattgggttccggttttcttgcacaatcacccttaagacagaaatagacagcaccagatcatggctagtgcgtggtgctgcatacaagggctcttgctatattcttggagagggctggaagagcttctgccaggataataggctcaaggcaggcgacctgtgcaccttcaacatcatcgaaaccacactgtggcatgtcactatcacgcgctcaacattagcagatacttttaagcaaaaaaagtcaccttgttcatccagtagggaccacaagaccaataagggtagttcaagtagtgaagaagcaaaggagccaaaaatctccatgacttctttgagcaaggttcgatcattcacaagatgtgtctatgacattgggccgccatcttggatacagaaggagatgaataccaactcaatagcaaggcgactttctttggcaccggccttttgcaaaaagattggattacggcaacgctgcacgatcacactcaagacctcaatcaatagcagtaattcttggcgggttggtggtcactggcaaaaggatggtaattatactattgagctgggatggcaaaagttctgcagggagaacgaactgaaggttggtgatgtctgcaccttcaatgtcatcgaaaccaagctgtggcatgtcgtcatcacacatcgtcactaa

SEQ ID NO: 11568 - protein, 548 aa, Sorghum bicolor
  misc_feature: Ceres ANNOT ID no. 6018580
  misc_feature (18)..(115): Pfam Id: B3 Pfam Desc: B3 DNA binding domain
  misc_feature (148)..(235): Pfam Id: B3 Pfam Desc: B3 DNA binding domain
  misc_feature (300)..(396): Pfam Id: B3 Pfam Desc: B3 DNA binding domain
  misc_feature (453)..(549): Pfam Id: B3 Pfam Desc: B3 DNA binding domain
  misc_feature (15)..(271): NCBI GI: 38346491 NCBI Desc: osjnba0020i02.5 [oryza sativa (japonica cultivar-group)]
  misc_feature (60)..(444): NCBI GI: 30689588 NCBI Desc: transcriptional factor b3 family protein [arabidopsis thaliana]
  misc_feature (129)..(319): NCBI GI: 92872626 NCBI Desc: transcriptional factor b3; cupredoxin; tonb box, n-terminal [medicago truncatula]
  misc_feature (16)..(535): NCBI GI: 42566182 NCBI Desc: transcriptional factor b3 family protein [arabidopsis thaliana]
  misc_feature (137)..(322): NCBI GI: 124359884 NCBI Desc: transcriptional factor b3 [medicago truncatula]
  misc_feature: The sequence is a functional homolog of SEQ ID NO. 467 in the 11/188,298 US application
MPLPSDPGPRPAAPAMAKQFKVLLPPFHKLRISDELAGCFDAGEGEGAAERTALVVSPFGKVWRVEVGRDGDGAFLGRGWAEFLAAHGVGLGWFVVLRHEGGGALTVKVFDTSLCIKEFGAPAAVMTSRTSKGVICKPQFIRIFHPYLSEKMILPARFVKNYVTEECLNSKTAVILSPLGKFWHIELKNDKSGMFFTGGWSQFLEFHGICNGDVLLLRYEGNMVFKFKAFGLGGCQKDFRHQNAGIQLNTEKRQETHSSIRKRKSNDNKSSSEENKRPKSSVTSPSLKLQEPYQMGTTSWIKKKINTYALERLLSLSKKFCNWIGFRFSCTITLKTEIDSTRSWLVRGAAYKGSCYILGEGWKSFCQDNRLKAGDLCTFNIIETTLWHVTITRSTLADTFKQKKSPCSSSRDHKTNKGSSSSEEAKEPKISMTSLSKVRSFTRCVYDIGPPSWIQKEMNTNSIARRLSLAPAFCKKIGLRQRCTITLKTSINSSNSWRVGGHWQKDGNYTIELGWQKFCRENELKVGDVCTFNVIETKLWHVVITHRH

SEQ ID NO: 11569 - DNA, 1116 bp, Sorghum bicolor
  misc_feature: Ceres ANNOT ID no. 6018668
  misc_feature: Encodes the peptide sequence at SEQ ID NO 11570
atggagacgggatgcggcgccggacagaagctggaggaggaggaagcgccagcggcgcagagggagcgggagcgggagtgggaggaggccgccgaggcggtggcgtacgactcgtgcacctggccgccgcccgtcgtggcggtgtgcggaccggggaacagcggcaagtccgccttctcccgtcttctgctcaacactctcatcgacaggtacaagaaggttggatacctggatattgatgttggtcagcctgagttcacccctccagggtttgtgtcgcttcatgtttttgaggaaaagcctaaagatttgacaattttatacctgcgcaatccaaagaggtgcttcttttttggcgatatttgtgcaaaaaggaacccgaaacttctcttgacctacatatttggccttcatgattatttccttcaagagttctattgccttggtgaggttggaaaccccaagaaatcagctataccacttgttattaatacttcaggatgggtaaaaggtactgggcttcaggttctaacagacatgttgaaatatgtgtccccatctcatgtaattcgagtatccacgatagtagagcgtaaaaatttaccaggtggaatgttttggatgaatgaaggcgaaggagattcatcagtgaatgtagttgaaattcctgcagcacagaactctcctcgtcatatgttagcaaagaaagaggcacgtattatgcgtgacctgaggctgatcgcttacttcaggcagtgcttaccaagagagttccctgttttctgttttgatgatttggttcaaggctttggttctatacatccatttcggcttcctctgtcaaaaatacatgttattgatctgcactgccagcgcttcttgaatggcacaattgttggtgtggcaacaaatgaccctcctcctttgtcaactgaatgttccactccttgttgcattggactgggtttcatcaaagccatacatatttcggaagactgtattcatttgataacacctgtttctcacaagcttatggaaaaggtcgacatccttcttctgagctctattgctgttcctagttgcctcttgcaggagggactaagttttggtacctag

SEQ ID NO: 11570 - protein, 371 aa, Sorghum bicolor
  misc_feature: Ceres ANNOT ID no. 6018668
  misc_feature (238)..(363): Pfam Id: NUC156 Pfam Desc: NUC156 domain
  misc_feature (20)..(364): NCBI GI: 115436470 NCBI Desc: os01g0354700 [oryza sativa (japonica cultivar-group)]
  misc_feature (26)..(331): NCBI GI: 15724270 NCBI Desc: at5g11010/t30n20_280 [arabidopsis thaliana]
  misc_feature (44)..(191): NCBI GI: 39795264 NCBI Desc: flj23323 protein [homo sapiens]
  misc_feature (44)..(191): NCBI GI: 39644857 NCBI Desc: flj23323 protein [homo sapiens]
  misc_feature (44)..(191): NCBI GI: 73921242 NCBI Desc: nucleolar protein 9
METGCGAGQKLEEEEAPAAQREREREWEEAAEAVAYDSCTWPPPVVAVCGPGNSGKSAFSRLLLNTLIDRYKKVGYLDIDVGQPEFTPPGFVSLHVFEEKPKDLTILYLRNPKRCFFFGDICAKRNPKLLLTYIFGLHDYFLQEFYCLGEVGNPKKSAIPLVINTSGWVKGTGLQVLTDMLKYVSPSHVIRVSTIVERKNLPGGMFWMNEGEGDSSVNVVEIPAAQNSPRHMLAKKEARIMRDLRLIAYFRQCLPREFPVFCFDDLVQGFGSIHPFRLPLSKIHVIDLHCQRFLNGTIVGVATNDPPPLSTECSTPCCIGLGFIKAIHISEDCIHLITPVSHKLMEKVDILLLSSIAVPSCLLQEGLSFGT

SEQ ID NO: 11571 - DNA, 540 bp, Sorghum bicolor
  misc_feature: Ceres ANNOT ID no. 6018808
  misc_feature: Encodes the peptide sequence at SEQ ID NO 11572
atgcgcctccgcggccgggcaatcttccccctcgtccgcaccaccaccaccacgtcggccgcgtcttcgccgccgggggtgctgagcgtcggccacgcgctgcgcgagcgccggcgcttcacggaggacgacgtggcggcgtacgcggcggtcagcggcgaccgcaacccggtgcacctcgacgacgccgtcgcccgggagctgggcgggttccaccgaggccgcgtcgtgcacggcatgctcgtcgcgtccctcttcccttccatcatcgccgccagcttccctggcgcggtgtacgccagccagacgctcaagtttgcggcgccggtgtacgtcggatatgaggtggttgctcaagtccaggcactcaacatcaggacgacaggggcggcgaacagcggcgcggcaagccgatacgttgtcaagttcgcaaccaaatgcttcatggacgaagaggagggctctgttgcaattgaaggggaagcaatggctgtcctgcctacactggagctcagctctcagtcaactagcaagcagtag

SEQ ID NO: 11572 - protein, 179 aa, Sorghum bicolor
  misc_feature: Ceres ANNOT ID no. 6018808
  misc_feature (27)..(139): Pfam Id: MaoC_dehydratas Pfam Desc: MaoC like domain
  misc_feature (6)..(178): NCBI GI: 15239296 NCBI Desc: maoc-like dehydratase domain-containing protein [arabidopsis thaliana]
  misc_feature (22)..(170): NCBI GI: 92897716 NCBI Desc: maoc-like dehydratase [medicago truncatula]
  misc_feature (29)..(168): NCBI GI: 113941379 NCBI Desc: maoc-like dehydratase [herpetosiphon aurantiacus atcc 23779]
  misc_feature (28)..(167): NCBI GI: 50442693 NCBI Desc: enoyl-coa hydratase [aeromonas hydrophila]
  misc_feature (28)..(167): NCBI GI: 28948377 NCBI Desc: chain b, (r)-hydratase from a. caviae involved in pha biosynthesis
MRLRGRAIFPLVRTTTTTSAASSPPGVLSVGHALRERRRFTEDDVAAYAAVSGDRNPVHLDDAVARELGGFHRGRVVHGMLVASLFPSIIAASFPGAVYASQTLKFAAPVYVGYEVVAQVQALNIRTTGAANSGAASRYVVKFATKCFMDEEEGSVAIEGEAMAVLPTLELSSQSTSKQ

SEQ ID NO: 11573 - DNA, 753 bp, Sorghum bicolor
  misc_feature: Ceres ANNOT ID no. 6019533
  misc_feature: Encodes the peptide sequence at SEQ ID NO 11574
atggctcgtcccccaccgtcgcacgggcacgggaacgggaacgggagcgggagcgggagcgccaccaccagagacgccctcgcctacctcaaggccgtcaaggacaggttccaggaaaagccccacatgtacgagcagttcatcgaggtcatgcgtgatttcaagaccaacaggctcgacagcgccggcgtcatcgcccgtgtcaagaccctcttccacggctacccggacctaatcctgggcttcaacgccttcctgcccaagggacactccatcaggcgtcaggacatcctccacaaggacaaggagcccgtcgattatcccagggccatcacccttgtcaacaggattaagagccgattccagcagcaggaacatgtctacaagtcattcctgtggatcctcaatatgtaccgcatgcataacaagcccatacaagatgtttacgacgaggtcaccctgctgctccatgaccatcctgatttactcgaggagttcattcatttcttgcctgatacccacacgcctcctaccaaggcagccactacctctaaactcaggcatgatgacaagaatgctgttatgcattctgctacaagacctcataccgttcaggtaaatcaacaaattatacaatcacccgtgttcagttccaaatgcttcttcaattgctatgttttatactcccccttatactcttcagtttttaggacagtctccacaatttcccaaattgcgataacatcaagataa

SEQ ID NO: 11574 - protein, 250 aa, Sorghum bicolor
  misc_feature: Ceres ANNOT ID no. 6019533
  misc_feature (41)..(87): Pfam Id: PAH Pfam Desc: Paired amphipathic helix repeat
  misc_feature (125)..(171): Pfam Id: PAH Pfam Desc: Paired amphipathic helix repeat
  misc_feature (4)..(205): NCBI GI: 115461547 NCBI Desc: os05g0100500 [oryza sativa (japonica cultivar-group)]
  misc_feature (16)..(195): NCBI GI: 102139907 NCBI Desc: paired amphipathic helix repeat-containing protein / transcription regulator-related [musa acuminata]
  misc_feature (16)..(198): NCBI GI: 102140002 NCBI Desc: transcriptional repressor protein-related [musa acuminata]
  misc_feature (7)..(172): NCBI GI: 42562817 NCBI Desc: paired amphipathic helix repeat-containing protein [arabidopsis thaliana]
  misc_feature (15)..(173): NCBI GI: 42563096 NCBI Desc: paired amphipathic helix repeat-containing protein [arabidopsis thaliana]
MARPPPSHGHGNGNGSGSGSATTRDALAYLKAVKDRFQEKPHMYEQFIEVMRDFKTNRLDSAGVIARVKTLFHGYPDLILGFNAFLPKGHSIRRQDILHKDKEPVDYPRAITLVNRIKSRFQQQEHVYKSFLWILNMYRMHNKPIQDVYDEVTLLLHDHPDLLEEFIHFLPDTHTPPTKAATTSKLRHDDKNAVMHSATRPHTVQVNQQIIQSPVFSSKCFFNCYVLYSPLYSSVFRTVSTISQIAITSR

SEQ ID NO: 11575 - DNA, 939 bp, Sorghum bicolor
  misc_feature: Ceres ANNOT ID no. 6019552
  misc_feature: Encodes the peptide sequence at SEQ ID NO 11576
atgagagagatcgtcttcttcgacgtagagacgacggctccgacgccggcggggcggtggtggctgctggagttcggcgccatcctggtgtgccccaggaagctggtggaggtggctagctacgacaccctcatccgcccgggcgacctctccgtcgctgtcaccaagcgattcagcgacgtcgaggccatcgcgtcggcgccgcccttcaaggacgtggccgacaagatattcgagatcctggacggccgcgtgtgggctgggcacaacatccagcgcttcgactgcccccgcatccgggaggcgttcgccgacatcggccgccccgcgccggagcccgccggcgtcatcgactccctcaacgtcctggccgccgacttcggacgccgcgcgggggacctcaagatggccacgctcgccacctacttcggcatcggcaagcagaagcacaggagcctggacgacgcgcgcatgaacctcgaggtgctcaagcactgcgccaccgtcctgctgctcgagtccagcctgccacacgtcctggggggcacgcagctgcagctgcaggctcgacaagcccacggcgcaccagtcacaaggaggatggcggcgaaggcgcaggcgacgtccttctcctcttccacgacaccgccgccgccgccgcctaaacatgttgtacaccaccaccgccccggcgtcgtcttgtcgcagaccaagctgccgtttacacctgcacctgcggccaccccgtgcggcaagaggaatagcctgggcaaggtggtgccgagggccgtcgtccaccaagctgctgctgctgccgctgctgctccattgagtagcacaagcacaggcacaagcaggcgccccgtgacggcgacggcgacagggaagacgacgcccttccacatgatcctcaggcactccagggccatcctcagatga

SEQ ID NO: 11576 - protein, 312 aa, Sorghum bicolor
  misc_feature: Ceres ANNOT ID no. 6019552
  misc_feature (4)..(163): Pfam Id: Exonuc_X-T Pfam Desc: Exonuclease
  misc_feature (3)..(178): NCBI GI: 9759593 NCBI Desc: exonuclease-like protein [arabidopsis thaliana]
  misc_feature (3)..(180): NCBI GI: 42568689 NCBI Desc: exonuclease family protein [arabidopsis thaliana]
  misc_feature (3)..(176): NCBI GI: 9757860 NCBI Desc: exonuclease-like protein [arabidopsis thaliana]
  misc_feature (5)..(163): NCBI GI: 86741790 NCBI Desc: dna polymerase iii, epsilon subunit [frankia sp. cci3]
  misc_feature (5)..(209): NCBI GI: 108805769 NCBI Desc: dna polymerase iii, epsilon subunit [rubrobacter xylanophilus dsm 9941]
MREIVFFDVETTAPTPAGRWWLLEFGAILVCPRKLVEVASYDTLIRPGDLSVAVTKRFSDVEAIASAPPFKDVADKIFEILDGRVWAGHNIQRFDCPRIREAFADIGRPAPEPAGVIDSLNVLAADFGRRAGDLKMATLATYFGIGKQKHRSLDDARMNLEVLKHCATVLLLESSLPHVLGGTQLQLQARQAHGAPVTRRMAAKAQATSFSSSTTPPPPPPKHVVHHHRPGVVLSQTKLPFTPAPAATPCGKRNSLGKVVPRAVVHQAAAAAAAAPLSSTSTGTSRRPVTATATGKTTPFHMILRHSRAILR

SEQ ID NO: 11577 - DNA, 837 bp, Sorghum bicolor
  misc_feature: Ceres ANNOT ID no. 6019576
  misc_feature: Encodes the peptide sequence at SEQ ID NO 11578
atggcggcgggccgggacggcgtggctcaccaggcggagctccgccggatcgagggcaacgtctgcttcaagaaggcccgcctcggtgccgccatcgactgctacaccgaggcaattgcgctctgccccgacgtcgccgtctactggatgaatcgagccctatgccatttcaagcgcaaggagtgggccaaggtcgaagaggacagcaggaaggctctcgcgcttgatcacactttggtcaaggggcactatctgctggggtgtgcactgctcgagaaggaagagtctgctcttgctatcaaggaattcgaaaaggctctgattctcttgaagtccgcgaattcaacggatgtaatggccgaggaaatttggcaggtccttgcgaaggcaaaatacttagattgggagaagcattccactgaacgactatggaggatgcaaagtctgaaggaagcctgtgaaagtgctctgcaggagcatcactttcttactggtacatttgaggaagactccaatgggtcaagcaatgagtgttcagagcatatcaaactgctatcggaggtcttcagccaagcaacaattgccgatacaccagcggatgtgcccgattacctttgctgtcagataactttcgagattttccgagatccagtgatcacacccagtggtgtaacatatgagagggctacacttgttgaacatctccacaaggttggcaattttgacccggtgacgcgaaatcctttgaaagagcatcagctggttccgaatctagccatcaaggaagcagtgcaagcctacctgaaggagcacagctgggcttacaagctgaactga

SEQ ID NO: 11578 - protein, 278 aa, Sorghum bicolor
  misc_feature: Ceres ANNOT ID no. 6019576
  misc_feature (200)..(274): Pfam Id: U-box Pfam Desc: U-box domain
  misc_feature (46)..(79): Pfam Id: TPR_1 Pfam Desc: Tetratricopeptide repeat
  misc_feature (18)..(274): NCBI GI: 54645729 NCBI Desc: ga18734-pa [drosophila pseudoobscura]
  misc_feature (18)..(274): NCBI GI: 17137692 NCBI Desc: cg5203-pa [drosophila melanogaster]
  misc_feature (1)..(273): NCBI GI: 41054441 NCBI Desc: stip1 homology and u-box containing protein 1 [danio rerio]
  misc_feature (180)..(274): NCBI GI: 29841090 NCBI Desc: similar to genbank accession number af129085 carboxy terminus of hsp70-interacting protein in homo sapiens [schistosoma japonicum]
  misc_feature (13)..(273): NCBI GI: 119606164 NCBI Desc: stip1 homology and u-box containing protein 1, isoform cra_c [homo sapiens]
  misc_feature: The sequence is a functional homolog of SEQ ID NO. 308 in the 11/188,298 US application
  misc_feature: The sequence is a functional homolog of SEQ ID NO. 528 in the 11/188,298 US application
  misc_feature: The sequence is a functional homolog of SEQ ID NO. 309 in the 11/188,298 US application
MAAGRDGVAHQAELRRIEGNVCFKKARLGAAIDCYTEAIALCPDVAVYWMNRALCHFKRKEWAKVEEDSRKALALDHTLVKGHYLLGCALLEKEESALAIKEFEKALILLKSANSTDVMAEEIWQVLAKAKYLDWEKHSTERLWRMQSLKEACESALQEHHFLTGTFEEDSNGSSNECSEHIKLLSEVFSQATIADTPADVPDYLCCQITFEIFRDPVITPSGVTYERATLVEHLHKVGNFDPVTRNPLKEHQLVPNLAIKEAVQAYLKEHSWAYKLN

SEQ ID NO: 11579 - DNA, 1356 bp, Sorghum bicolor
  misc_feature: Ceres ANNOT ID no. 6019611
  misc_feature: Encodes the peptide sequence at SEQ ID NO 11580
atggacattgaactcgagttgcttgaaaaaattacaaacaagttttcagaggaccaaaaagttggcagtggtgggtatggagatgtttaccggggcgtgtataatggggaagtgattgctgtgaagaagcttcacccgctccaagggctagatgataaatcgtttgagagggaattccgtaaccttagggggattgaccatgaaaatgtcgtgaggctacttggctactgctatgcattaaaaatgaagtttgttacgcacaacggagagttagtccgtgctaaagaaatggagcgcgttctctgctttgaatatatgcaaggtggaagccttgataaacatatttcagatgaatcttgtgatcttgactggccgacatgttacaaaattattaaagggacctgtgagggcttaaaccacctgcataacgcacggggaaaacctattttccatctggacttaaaacctgctaatatattgcttgatcagaataagacgccaaaaatcggagatctcggtttgtccagacttgttacttcatcagatacccataaaacagagactatcacaggaacacaggggtacatgccacctgaatacatgaaggagggttttatatcgatgaagtttgacgtgttcagcttgggagtcataatcctgaaaataatggccggaaatataggctacccccgctgttataatttgcctcacgaagagtttgttgagcttggcagatcggggagttcatcacaagaaataaacatcctacgactgaaggcttgtcttgatatagcactaagatgtgtacgtgatgaccgaaagaagcggccttctgtaaatgacattgtcaaagaactggaacaactagaatctaagatcaaggaaatcttactctcttctgatcagtcaaaaaacctaattggccagcaacagatcaggagccctgctgactccaacattcttgccgtcgatccgaccctggagctgcgctttgcattcgagccaaaaaaggacatatcgtgctgtctgcagttgacaaacctaactgaagcctccattgcatttaacataaagactaacagaaccaagtactacacagagcccagcaaagggattatgccaccatgttccaaacgctatgtcttggtgacgttgccagcacaggaggaggtaccgccgtccaacgacatgcaatgccatgacatgttccttgtgcagagtgttcatgtcagcaaggaactaacatctgatgacgagatcaccggagacttgtttgaagaagccatgacggagaaggtggtggatgtggtcaaactgccgattgtttatgttgcacgagctcagtttacacagtaa

SEQ ID NO: 11580 - protein, 451 aa, Sorghum bicolor
  misc_feature: Ceres ANNOT ID no. 6019611
  misc_feature (15)..(286): Pfam Id: Pkinase Pfam Desc: Protein kinase domain
  misc_feature (15)..(286): Pfam Id: Pkinase_Tyr Pfam Desc: Protein tyrosine kinase
  misc_feature (320)..(430): Pfam Id: Motile_Sperm Pfam Desc: MSP (Major sperm protein) domain
  misc_feature (1)..(445): NCBI GI: 38344667 NCBI Desc: osjnbb0042i07.2 [oryza sativa (japonica cultivar-group)]
  misc_feature (1)..(445): NCBI GI: 116309270 NCBI Desc: h0607f01.7 [oryza sativa (indica cultivar-group)]
  misc_feature (65)..(314): NCBI GI: 115485071 NCBI Desc: os11g0274100 [oryza sativa (japonica cultivar-group)]
  misc_feature (2)..(290): NCBI GI: 94410816 NCBI Desc: serine/threonine kinase-like protein abc1037 [hordeum vulgare subsp. vulgare]
  misc_feature (2)..(290): NCBI GI: 117621924 NCBI Desc: rpg1 [hordeum vulgare subsp. vulgare]
  misc_feature: The sequence is a functional homolog of SEQ ID NO. 495 in the 11/188,298 US application
  misc_feature: The sequence is a functional homolog of SEQ ID NO. 312 in the 11/188,298 US application
  misc_feature: The sequence is a functional homolog of SEQ ID NO. 391 in the 11/188,298 US application
  misc_feature: The sequence is a functional homolog of SEQ ID NO. 323 in the 11/188,298 US application
  misc_feature: The sequence is a functional homolog of SEQ ID NO. 446 in the 11/188,298 US application
  misc_feature: The sequence is a functional homolog of SEQ ID NO. 520 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 498 in the 11/188,298 US application
  misc_feature: The sequence is a functional homolog of SEQ ID NO. 310 in the 11/188,298 US application
  misc_feature: The sequence is a functional homolog of SEQ ID NO. 399 in the 11/188,298 US application
  misc_feature: The sequence is a functional homolog of SEQ ID NO. 340 in the 11/188,298 US application
  misc_feature: The sequence is a functional homolog of SEQ ID NO. 464 in the 11/188,298 US application
  misc_feature: The sequence is a functional homolog of SEQ ID NO. 356 in the 11/188,298 US application
  misc_feature: The sequence is a functional homolog of SEQ ID NO. 366 in the 11/188,298 US application
MDIELELLEKITNKFSEDQKVGSGGYGDVYRGVYNGEVIAVKKLHPLQGLDDKSFEREFRNLRGIDHENVVRLLGYCYALKMKFVTHNGELVRAKEMERVLCFEYMQGGSLDKHISDESCDLDWPTCYKIIKGTCEGLNHLHNARGKPIFHLDLKPANILLDQNKTPKIGDLGLSRLVTSSDTHKTETITGTQGYMPPEYMKEGFISMKFDVFSLGVIILKIMAGNIGYPRCYNLPHEEFVELGRSGSSSQEINILRLKACLDIALRCVRDDRKKRPSVNDIVKELEQLESKIKEILLSSDQSKNLIGQQQIRSPADSNILAVDPTLELRFAFEPKKDISCCLQLTNLTEASIAFNIKTNRTKYYTEPSKGIMPPCSKRYVLVTLPAQEEVPPSNDMQCHDMFLVQSVHVSKELTSDDEITGDLFEEAMTEKVVDVVKLPIVYVARAQFTQ

SEQ ID NO: 11581 - DNA, 1026 bp, Sorghum bicolor
  misc_feature: Ceres ANNOT ID no. 6019865
  misc_feature: Encodes the peptide sequence at SEQ ID NO 11582
atggctgcgccttccggtaccatgcgcgccgtgcagtacgacagatacggcggaggagcacaagggctcaagcaagtggaggtgccgatcccgtcgccgaagaaaggcgaggtgctcatcaggatggaggccaccagcatcaacgtcgtcgactgcaggtttaagaacggcatcgcgcggcccttcatgccctggaagttcccgtttatctctggtttcgatctagcaggcgaagtcgtggcgttgggcgctgcagtgagcggcttcaagccaggggacaaggttattgccatcaacttcccgaacggcggagggctcgctgagtacgcggtcgtgtcggcgtctcgcacagtcgcaaggccgcccgaggtgtcggccgtcgatggcgtctgcgtaccgatggccgcagtcaccgcgctcctggcactgcggagagccggggtcagcgtcagcctggacactactactactactactacgagacccaagaacgtgctggtcaccgcggcctccggcgccgtcggccacttcgccgtgcagctggcaaggatgggcggccacagcgtcacggccacctgcggcgcgcgcaacctcggcctggtccggagcctcggcgccgacgaggcgctggactacaagacccccgacggcgccaagctgcggagcccctccggcagggagtacgacgcggtggtgcactgcgccacggggttcccctggtcggtgttcaggcccgtgctcgccgccaagggcacggtcgtggacatcacgcccgggttcgtgtccggcgtcaccgcgatcctccagatgctcaccttctccaagaagaggctggtgccgctcttggcggcgtccaagaaggaggacatggagctgctgctgggcatgctggagcaggggaggctcaagccggtcatcgattcacggcatccgctgggcagtgctcacgaaggctgggccaagagcatgagcggccacgccaccggcaaggtcgtcgtagaaatcggagccgcgcagccagaatag

SEQ ID NO: 11582 - protein, 341 aa, Sorghum bicolor
  misc_feature: Ceres ANNOT ID no. 6019865
  misc_feature (35)..(120): Pfam Id: ADH_N Pfam Desc: Alcohol dehydrogenase GroES-like domain
  misc_feature (161)..(298): Pfam Id: ADH_zinc_N Pfam Desc: Zinc-binding dehydrogenase
  misc_feature (1)..(339): NCBI GI: 115479987 NCBI Desc: os09g0502500 [oryza sativa (japonica cultivar-group)]
  misc_feature (2)..(339): NCBI GI: 115479997 NCBI Desc: os09g0503100 [oryza sativa (japonica cultivar-group)]
  misc_feature (8)..(334): NCBI GI: 12484050 NCBI Desc: quinone-oxidoreductase qr1 [triphysaria versicolor]
  misc_feature (8)..(334): NCBI GI: 77416923 NCBI Desc: ripening regulated protein-like [solanum tuberosum]
  misc_feature (8)..(334): NCBI GI: 92869323 NCBI Desc: alcohol dehydrogenase superfamily, zinc-containing [medicago truncatula]
MAAPSGTMRAVQYDRYGGGAQGLKQVEVPIPSPKKGEVLIRMEATSINVVDCRFKNGIARPFMPWKFPFISGFDLAGEVVALGAAVSGFKPGDKVIAINFPNGGGLAEYAVVSASRTVARPPEVSAVDGVCVPMAAVTALLALRRAGVSVSLDTTTTTTTRPKNVLVTAASGAVGHFAVQLARMGGHSVTATCGARNLGLVRSLGADEALDYKTPDGAKLRSPSGREYDAVVHCATGFPWSVFRPVLAAKGTVVDITPGFVSGVTAILQMLTFSKKRLVPLLAASKKEDMELLLGMLEQGRLKPVIDSRHPLGSAHEGWAKSMSGHATGKVVVEIGAAQPE

SEQ ID NO: 11583 - DNA, 477 bp, Sorghum bicolor
  misc_feature: Ceres ANNOT ID no. 6019922
  misc_feature: Encodes the peptide sequence at SEQ ID NO 11584
atggcctattgcgaaatggctccttgtgcgctagctcaacattctgagcttacgatgactctatacacaaacaaggaggtgtattctggaccagaccaaaatgcagcaacaaacacagaagggtcaacaataatgggcagaacccaggtctactcgtggcctgtagccgatggggcaactcctgatgcaaacatcgtcggccatctccagggcactagtgttcaagtagccaaatctcccgccgcggtgtatcactactccctgggtttagtgttctcggatgaaaggttcaaagggtctacactccaaatacaagggacttcccaaataaatggtgagtgggccattgttggagggacaggagaacttactatggcaacgggtactgtcaaacgcacaacagttgtagagaaagactataccaggatctcagaactcaaaatacatgcctatttatttcgctccagtgaagcctag

SEQ ID NO: 11584 - protein, 158 aa, Sorghum bicolor
  misc_feature: Ceres ANNOT ID no. 6019922
  misc_feature (8)..(152): Pfam Id: Dirigent Pfam Desc: Dirigent-like protein
  misc_feature (14)..(158): NCBI GI: 20160673 NCBI Desc: beta-glucosidase aggregating factor precursor-like protein [oryza sativa (japonica cultivar-group)]
  misc_feature (1)..(151): NCBI GI: 55416171 NCBI Desc: dirigent-like protein [saccharum hybrid cultivar]
  misc_feature (11)..(151): NCBI GI: 115481556 NCBI Desc: os10g0335000 [oryza sativa (japonica cultivar-group)]
  misc_feature (1)..(151): NCBI GI: 37700483 NCBI Desc: dirigent [saccharum hybrid cultivar]
  misc_feature (1)..(151): NCBI GI: 38455904 NCBI Desc: jasmonate-induced protein [triticum aestivum]
MAYCEMAPCALAQHSELTMTLYTNKEVYSGPDQNAATNTEGSTIMGRTQVYSWPVADGATPDANIVGHLQGTSVQVAKSPAAVYHYSLGLVFSDERFKGSTLQIQGTSQINGEWAIVGGTGELTMATGTVKRTTVVEKDYTRISELKIHAYLFRSSEA

SEQ ID NO: 11585 - DNA, 243 bp, Sorghum bicolor
  misc_feature: Ceres ANNOT ID no. 6020136
  misc_feature: Encodes the peptide sequence at SEQ ID NO 11586
atggagaaggaggagcaggaggaaggaagccaccgtcggcttcaggttcagctgcaggaggaagaagcagagcctgctgcggccgcggactctcccggtcgacgacgacaacgacggctgcggcggtcggtgtccatgtccatggggagccggctggcgagcgcggcgcgggagcagagggctcgcctctacatcatgcgccgctgcgtctccatgctcgtgcgctggaagcacgacgactag

SEQ ID NO: 11586 - protein, 80 aa, Sorghum bicolor
  misc_feature: Ceres ANNOT ID no. 6020136
  misc_feature (57)..(75): Pfam Id: DVL Pfam Desc: DVL family
  misc_feature (26)..(77): NCBI GI: 115442523 NCBI Desc: os01g0972300 [oryza sativa (japonica cultivar-group)]
  misc_feature (40)..(77): NCBI GI: 42822045 NCBI Desc: tpa: dvl6 [arabidopsis thaliana]
  misc_feature (49)..(79): NCBI GI: 42822053 NCBI Desc: tpa: dvl10 [arabidopsis thaliana]
  misc_feature (15)..(76): NCBI GI: 42822049 NCBI Desc: tpa: dvl8 [arabidopsis thaliana]
  misc_feature: Abnormal phyllotaxy, leaf number higher than wild-type
  misc_feature: Useful for making plants with modulated biomass
  misc_feature: Functional homolog of the protein sequence given in SEQ ID NO 13543
MEKEEQEEGSHRRLQVQLQEEEAEPAAAADSPGRRRQRRLRRSVSMSMGSRLASAAREQRARLYIMRRCVSMLVRWKHDD

SEQ ID NO: 11587 - DNA, 1179 bp, Sorghum bicolor
  misc_feature: Ceres ANNOT ID no. 6020207
  misc_feature: Encodes the peptide sequence at SEQ ID NO 11588
atggagaagccatcgcaacaccaaacgattgaggaggaggaggaccatatcagcaagctgccagatgacgttctcgtccacatcctgtccttgtgcccctacaggattctcatgccaacggtgtcggtttcaaagaggtgggcgcgcctcctctcccaactcccggacctgaccttctgcctgtcgatgcttgtggacacgccgagcgaggagcgcgtccagagcatggcgcggacgctccgccgccggtgcgcagaccaccaccacaccatcaagatgcttcgtctggtttacaggaaggacgtggccatggaatgccggtacgcagacgacatgatcgctctcgccaacgccacgaagctggttctcacaccccacatgggcaagaagttctcacatgacacggacgccggcgcctggtccctccagctgccgcccgccacgatcgagctgcagttgctgccgttctcgttcgccgtgctgccgccgcgcatccacggcgccggcgccggcacccttcgctccctgacgctgctgggggcgaccgtggtgcgccacgacttcccgctcgccgccaccgtgctcccgtcgctggaggacctgcacatcggcgagtgcgcgctcgctgccagtatcagcgtcacgtcggacaccatgcctcgcctcaaacacctccgcttcaccgaagtcagcgtgaaggcggatgtcgccatcaccgtgctcgccgacgacctgaggacgctccgcatgtcatgccgcaggtatagcaggacggaatcgccgtcggagccgctctcgtacttgtgtcacgggggcttcctagccgtcttcaccaaatactcgctgttccgcttgcgcgcacccaagctgacggtgttcgagtggcgatgctgctatgcggacgaggtgcgcatcgacgccgtcggccgcctcaccgacgtcgccatcgaggttgccgccggtaggacgccgacgccgatgccgattggcacggaacccaagtacgtgacaacacaacaacgtgacaaacttgtgaccgacatccttcaaggacttatgcctgggctgcagccgcgcacttggaaagatgtaaccaggaaatgcaagcaacgtgatgacaggtggttgtgctttgaagacacaacaacaacaacaagtgcttaccctgctgccgaatga

SEQ ID NO: 11588 - protein, 392 aa, Sorghum bicolor
  misc_feature: Ceres ANNOT ID no. 6020207
  misc_feature (15)..(62): Pfam Id: F-box Pfam Desc: F-box domain
  misc_feature (6)..(50): NCBI GI: 140040036 NCBI Desc: cyclin-like f-box [medicago truncatula]
  misc_feature (11)..(67): NCBI GI: 87241248 NCBI Desc: cyclin-like f-box [medicago truncatula]
  misc_feature (8)..(75): NCBI GI: 140055237 NCBI Desc: cyclin-like f-box [medicago truncatula]
MEKPSQHQTIEEEEDHISKLPDDVLVHILSLCPYRILMPTVSVSKRWARLLSQLPDLTFCLSMLVDTPSEERVQSMARTLRRRCADHHHTIKMLRLVYRKDVAMECRYADDMIALANATKLVLTPHMGKKFSHDTDAGAWSLQLPPATIELQLLPFSFAVLPPRIHGAGAGTLRSLTLLGATVVRHDFPLAATVLPSLEDLHIGECALAASISVTSDTMPRLKHLRFTEVSVKADVAITVLADDLRTLRMSCRRYSRTESPSEPLSYLCHGGFLAVFTKYSLFRLRAPKLTVFEWRCCYADEVRIDAVGRLTDVAIEVAAGRTPTPMPIGTEPKYVTTQQRDKLVTDILQGLMPGLQPRTWKDVTRKCKQRDDRWLCFEDTTTTTSAYPAAE

SEQ ID NO: 11589 - DNA, 1008 bp, Sorghum bicolor
  misc_feature: Ceres ANNOT ID no. 6020213
  misc_feature: Encodes the peptide sequence at SEQ ID NO 11590
atggccgccgcgggcccggcctcttcctacttcgccggctcggccatcctgccgtcgcagcgcgccgccgcggcgcccgacaattccgccgtcgtcacctcttctccggccaagcagtcgcgtgacccccgcttctccggatgcgcccccaccaccgtgcgtcacatcgcccgctccttcgccgccgccgatgccactggtggcggggaccctgtcatctacatcgacggcgtcgacgccaccaacgtttggattctggggagggtggtgagcgtggtgaacatggaggctggcgtgtcattcacgctggacgatggcaccgggaggatcccgcttgtgcggtggatcactgacgatattgatgctaaggaagtgtctttcgtccagaatggtttatacctcaaggttcaagttactctcgtagggtttcgagctaagcagcatggttttgctcgctctattaggcctgttaccaatttcaatgaagtggtgctgcacttcattgagtctatgtatgtgcatttggtaaatgtctggccaaagacgcaaggtcaattccctcgcactgttcaagcaaatgcgtctactcacgagatgcaagctcaagtcgctcacacagttcaaacaaatgcacctgcttatatgcccttctctggtggagtaagagagcaccaagttggttttggtcctgatgtaaaccaagggcgattcccttcatcagttcaaacaaacacatctactcatgtacccttttctggtggagttagagaacaacaagttcactttactcctcaaccaaaccaattttcagcttacccaggtactggtggacaacagcatgatctacagaatatggttttggaggttatgcaacaaccagatatacttgcacttgaaaatggagtacatgttgatgaagtggcaaggagacttggaatgtcaagagcacaaattatgtatataactctcccctcatgtatttcatcacaagcatatgaactatgctaa

SEQ ID NO: 11590 - protein, 335 aa, Sorghum bicolor
  misc_feature: Ceres ANNOT ID no. 6020213
  misc_feature (83)..(157): Pfam Id: tRNA_anti Pfam Desc: OB-fold nucleic acid binding domain
  misc_feature (7)..(268): NCBI GI: 115469668 NCBI Desc: os06g0693300 [oryza sativa (japonica cultivar-group)]
  misc_feature (9)..(249): NCBI GI: 48716324 NCBI Desc: replication protein a2 [oryza sativa (japonica cultivar-group)]
  misc_feature (9)..(249): NCBI GI: 9801268 NCBI Desc: replication protein a2 [oryza sativa]
  misc_feature (9)..(249): NCBI GI: 13516746 NCBI Desc: replication protein a 30kda [oryza sativa (japonica cultivar-group)]
  misc_feature (28)..(218): NCBI GI: 31790111 NCBI Desc: rpa 32kda [pisum sativum]
MAAAGPASSYFAGSAILPSQRAAAAPDNSAVVTSSPAKQSRDPRFSGCAPTTVRHIARSFAAADATGGGDPVIYIDGVDATNVWILGRVVSVVNMEAGVSFTLDDGTGRIPLVRWITDDIDAKEVSFVQNGLYLKVQVTLVGFRAKQHGFARSIRPVTNFNEVVLHFIESMYVHLVNVWPKTQGQFPRTVQANASTHEMQAQVAHTVQTNAPAYMPFSGGVREHQVGFGPDVNQGRFPSSVQTNTSTHVPFSGGVREQQVHFTPQPNQFSAYPGTGGQQHDLQNMVLEVMQQPDILALENGVHVDEVARRLGMSRAQIMYITLPSCISSQAYELC

SEQ ID NO: 11591 - DNA, 1089 bp, Sorghum bicolor
  misc_feature: Ceres ANNOT ID no. 6020232
  misc_feature: Encodes the peptide sequence at SEQ ID NO 11592
atggccttctccaccgatccggcagcggtcgaagagaaggtggaagcggaggacgaagccctccccacggccgtcgccggcgccggcgccggggattggggtgatgtgagccacgaggagtggcggcgctggggcacctcctcgccgctcccggccgcggtggccggtgtaatccacgagctgctcgagatggaggccgccgccggcgagaagatgcgcttcggcggcgtcggctccaagctaaagggcaatttcaaggacgtggaggacaagaagcacagggctgtctacgagaggctcgctgactccgaccagaagctgcagtatttctccgcgcggcagattggctgtcgtttgctagggtgcagagggtatctgtgccagaagtgctggctaccaactgaagactgtatgtgcacaaatattgttccttgcaatctttggaaggggatgaaattctggctatatatgcacccaaaggactttttgcgccagaataacacaggaaagttactctggcaagtatttggcatccaagctgcgcagttatgcctctttggtatccaagagcatgaggatatcatgtgggatgcatttcagagttcaggaaaggggaagatctcagttctatatccaaacaagagtaccacccccaagtcagttaaagaccttgaatttgatggtttgtccttgacagctgaccttcatgaggatgaacctttcaattttgtgttgcttgatggtacctggagtaattctgctgcactgtacagaaggctgaaggagagatggactgcaatatggggagatgaagatataccttgtatctcactatctacacttagtgcctcagtgatgcataaactacgaccgcagcctgcgtgggatcgcacctgcaccgcggcagctgcagctggcctcctctgggagctgaacctgcggcctgagctcagcgcttttgagttcgaaaagcaagctgaggcagtggagtgctcgttggatatcttgctggatgctctcactgccaggcgagttcgtctgggccgttcaattactcgaaaacagagacataatagaaactgcatatag

SEQ ID NO: 11592 - protein, 362 aa, Sorghum bicolor
  misc_feature: Ceres ANNOT ID no. 6020232
  misc_feature (123)..(349): Pfam Id: DTW Pfam Desc: DTW domain
  misc_feature (160)..(357): NCBI GI: 9280650 NCBI Desc: f21b7.29 [arabidopsis thaliana]
  misc_feature (32)..(290): NCBI GI: 124300982 NCBI Desc: at1g03687 [arabidopsis thaliana]
  misc_feature (1)..(129): NCBI GI: 54290952 NCBI Desc: dtw domain-containing protein-like [oryza sativa (japonica cultivar-group)]
  misc_feature (118)..(259): NCBI GI: 77972410 NCBI Desc: cog3148: uncharacterized conserved protein [yersinia frederiksenii atcc 33641]
  misc_feature (127)..(308): NCBI GI: 118069902 NCBI Desc: dtw domain containing protein [serratia proteamaculans 568]
MAFSTDPAAVEEKVEAEDEALPTAVAGAGAGDWGDVSHEEWRRWGTSSPLPAAVAGVIHELLEMEAAAGEKMRFGGVGSKLKGNFKDVEDKKHRAVYERLADSDQKLQYFSARQIGCRLLGCRGYLCQKCWLPTEDCMCTNIVPCNLWKGMKFWLYMHPKDFLRQNNTGKLLWQVFGIQAAQLCLFGIQEHEDIMWDAFQSSGKGKISVLYPNKSTTPKSVKDLEFDGLSLTADLHEDEPFNFVLLDGTWSNSAALYRRLKERWTAIWGDEDIPCISLSTLSASVMHKLRPQPAWDRTCTAAAAAGLLWELNLRPELSAFEFEKQAEAVECSLDILLDALTARRVRLGRSITRKQRHNRNCI

SEQ ID NO: 11593 - DNA, 711 bp, Sorghum bicolor
  misc_feature: Ceres ANNOT ID no. 6020268
  misc_feature: Encodes the peptide sequence at SEQ ID NO 11594
atgtcgtatagcactcgtgccatggaggaagaggggttcgggaagtcatggcttggcctggggataggcggcggcgatctgatgaagcggagccggtcaccggcgccggtgcagttcgacctgatgctgttcccgcggagtgtcaaggaagaagctgccgcgaccgcgagcaagaaagcggagaaaggtgcacggaagaggtcgaagacgaccatcaccgacgacgatgggcagtcgtcgcatggcggtccgagccccagtgacgacgacgttgctgtcggcgcgggcgcgaggaagaagctccggctcaccaaggagcagtccacgctgctcgaagacaccttccgcgcccacaacatactctcccacgctcagaagcaggagctcgcgcggcaggtgaatctaagcacaagacaggtggaagtgtggttccagaataggagggcaagaacaaagctgaagcaaacggaggtggactgcgagatactgaagcgctgctgcgagagcctgacgggagagaaccagcggctgaggctggagctcgcgcagctgcagcggtcggcggcggcggcggctgggctctacgtccagtcgttcccggcgccggccacggccatggcgagcgccatctgcccgtcctgcgacaaggtcaccgtgacgagcggcggcggcgagacaagcggcaagagctccaccagctactcctcctga

SEQ ID NO: 11594 - protein, 236 aa, Sorghum bicolor
  misc_feature: Ceres ANNOT ID no. 6020268
  misc_feature (99)..(153): Pfam Id: Homeobox Pfam Desc: Homeobox domain
  misc_feature (154)..(198): Pfam Id: HALZ Pfam Desc: Homeobox associated leucine zipper
  misc_feature (64)..(227): NCBI GI: 32490154 NCBI Desc: osjnba0065h10.13 [oryza sativa (japonica cultivar-group)]
  misc_feature (63)..(236): NCBI GI: 22326632 NCBI Desc: homeobox-leucine zipper protein 14 (hat14) / hd-zip protein 14 [arabidopsis thaliana]
  misc_feature (49)..(227): NCBI GI: 30984526 NCBI Desc: at3g60390 [arabidopsis thaliana]
  misc_feature (63)..(236): NCBI GI: 29028870 NCBI Desc: at5g06710 [arabidopsis thaliana]
  misc_feature (79)..(233): NCBI GI: 2344893 NCBI Desc: homeodomain transcription factor (athb-4) [arabidopsis thaliana]
  misc_feature: The sequence is a functional homolog of SEQ ID NO 110 in the 10/412,699US patent application
  misc_feature: The sequence is a functional homolog of SEQ ID NO 1674 in the 10/374,780US patent application
  misc_feature: The sequence is a functional homolog of SEQ ID NO 254 in the 10/412,699US patent application
  misc_feature: The sequence is a functional homolog of SEQ ID NO 259 in the 11/479,226US patent application
  misc_feature: The sequence is a functional homolog of SEQ ID NO 550 in the 11/479,226US patent application
  misc_feature: Useful for making plants with modulated growth and phenotype characteristics
  misc_feature: The sequence is a functional homolog of SEQ ID NO 110 in the 20040045049 US patent application
  misc_feature: The sequence is a functional homolog of SEQ ID NO 254 in the 20040045049 US patent application
  misc_feature: The sequence is a functional homolog of SEQ ID NO 1674 in the 20060162006 US patent application
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13544
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: The sequence is a functional homolog of SEQ ID NO 542 in the 11/479,226 US patent application
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: The sequence is a functional homolog of SEQ ID NO 568 in the 11/479,226 US patent application
  misc_feature: Useful for making plants with altered alkaloid content
  misc_feature: Functional homolog of the protein sequence given in SEQ ID NO 13109
  misc_feature: Useful for making plants with altered lignin content
  misc_feature: Functional homolog of the protein sequence given in SEQ ID NO 12880
MSYSTRAMEEEGFGKSWLGLGIGGGDLMKRSRSPAPVQFDLMLFPRSVKEEAAATASKKAEKGARKRSKTTITDDDGQSSHGGPSPSDDDVAVGAGARKKLRLTKEQSTLLEDTFRAHNILSHAQKQELARQVNLSTRQVEVWFQNRRARTKLKQTEVDCEILKRCCESLTGENQRLRLELAQLQRSAAAAAGLYVQSFPAPATAMASAICPSCDKVTVTSGGGETSGKSSTSYSS

SEQ ID NO: 11595 - DNA, 1317 bp, Sorghum bicolor
  misc_feature: Ceres ANNOT ID no. 6020360
  misc_feature: Encodes the peptide sequence at SEQ ID NO 11596
atgggttctttcgggatgaactggaatcagaagaactccatggtgtgggattgggaacatctagtgccatctgtctcgaatgcagttacaaggcatggatctgctaattcatctggtggtactcttacttctagctcagagctagggcatggttcatccaagagctctatttcagcatccattgattcaccatctggagtagggaacagcttagagttcaattttgccgctgttcaaaggcatgttaagaacacgggcaccaatggcagagtcgatgactcagggaattctccatcgtcaatgatagccttcagccaaggagagccactgatcagcctcaagcttggaaaaagggcttacttcgaaaatgtctgtggaggacaggaggccaaggtttctgcaccttcagatgttacttctgcagtcaccgtggtcaagaagactaaggtgtctcagcagaatgcaaagaactggtactgtcaggttgaaggttgcaaagttgacctgtcttctgctaaagattacaaccgcaagcacaaagtctgtgtagctcattctaaagctcccaaggtggttgttgctggtctagagcgccggttttgccaacagtgtagccggtttcatggtttggcggagtttgatcagaacaaacgaagctgtcgtaggcgtcttactcatcataatgcacgaaggaggaagccacaggcagatgcaatttcattcaattcatcacggctctcgtcaatgttttatgatacaagccaccggacaaatcttttctttagtcaacctctctatggccaagtgagaagcaatgcagtatctccgtgggataactcgggaggcttcaaatttatggaaacaaaacatctgtcagtgcagccaacaaaaacagtaggcctggatgagctgcatttctcaaccccccagatatcaactagtgttgtggcgcacactggacatcatcataacttcgataggttcatgccattcaagggaactaacacaaaggttcttaaccaaggtgtggaagcttcggcgaccgcttccaactctaataacggagccccagaacctgggcgtgctctctctcttctgtcagacggttcttggggctcaaattcagccgtcatccagcagcctccttctcacgcagatgctggtgcattgccgcccctcgccaccgttgctgtctccaacaccgccgccaggcatcctcttgacccgtccctgggaaggttctggcaagacgatcatcccccactcgacggacctgcacctcagattcaggaactggcgcacctccgaacatggtga

SEQ ID NO: 11596 - protein, 438 aa, Sorghum bicolor
  misc_feature: Ceres ANNOT ID no. 6020360
  misc_feature (159)..(237): Pfam Id: SBP Pfam Desc: SBP domain
  misc_feature (28)..(434): NCBI GI: 53791916 NCBI Desc: squamosa promoter binding protein 2-like [oryza sativa (japonica cultivar-group)]
  misc_feature (43)..(381): NCBI GI: 10177389 NCBI Desc: squamosa promoter binding protein-like 2 [arabidopsis thaliana]
  misc_feature (39)..(389): NCBI GI: 5931647 NCBI Desc: squamosa promoter binding protein-like 2 [arabidopsis thaliana]
  misc_feature (9)..(382): NCBI GI: 67461575 NCBI Desc: squamosa-promoter binding-like protein 10
  misc_feature (9)..(382): NCBI GI: 9802546 NCBI Desc: f17l21.15 [arabidopsis thaliana]
  misc_feature: Useful for making plants with altered alkaloid content
  misc_feature: Functional homolog of the protein sequence given in SEQ ID NO 13177
  misc_feature: The sequence is a functional homolog of SEQ ID NO. 452 in the 11/188,298 US application
MGSFGMNWNQKNSMVWDWEHLVPSVSNAVTRHGSANSSGGTLTSSSELGHGSSKSSISASIDSPSGVGNSLEFNFAAVQRHVKNTGTNGRVDDSGNSPSSMIAFSQGEPLISLKLGKRAYFENVCGGQEAKVSAPSDVTSAVTVVKKTKVSQQNAKNWYCQVEGCKVDLSSAKDYNRKHKVCVAHSKAPKVVVAGLERRFCQQCSRFHGLAEFDQNKRSCRRRLTHHNARRRKPQADAISFNSSRLSSMFYDTSHRTNLFFSQPLYGQVRSNAVSPWDNSGGFKFMETKHLSVQPTKTVGLDELHFSTPQISTSVVAHTGHHHNFDRFMPFKGTNTKVLNQGVEASATASNSNNGAPEPGRALSLLSDGSWGSNSAVIQQPPSHADAGALPPLATVAVSNTAARHPLDPSLGRFWQDDHPPLDGPAPQIQELAHLRTW

SEQ ID NO: 11597 - DNA, 210 bp, Sorghum bicolor
  misc_feature: Ceres ANNOT ID no. 6020728
  misc_feature: Encodes the peptide sequence at SEQ ID NO 11598
atgtttgataagtacggcaatatgtggcaccacagcagggtgcgaaaatatctgacatctgaagactttccggagactgaaactgatttcagaccatggcatggacttgtattgctgctaagaaagtaccctgagcattttgtgatcaacattaggaaaggtgggggcttgagcactgagtttgtctctttggtctcactacaatcttga

SEQ ID NO: 11598 - protein, 69 aa, Sorghum bicolor
  misc_feature: Ceres ANNOT ID no. 6020728
  misc_feature (1)..(68): NCBI GI: 115485445 NCBI Desc: os11g0463600 [oryza sativa (japonica cultivar-group)]
  misc_feature (1)..(69): NCBI GI: 115477441 NCBI Desc: os08g0528900 [oryza sativa (japonica cultivar-group)]
  misc_feature: Useful for making plants with altered alkaloid content
  misc_feature: Useful for making plants with altered lignin content
  misc_feature: Functional homolog of the protein sequence given in SEQ ID NO 13680
  misc_feature: The sequence is a functional homolog of SEQ ID NO. 380 in the 11/188,298 US application
MFDKYGNMWHHSRVRKYLTSEDFPETETDFRPWHGLVLLLRKYPEHFVINIRKGGGLSTEFVSLVSLQS

SEQ ID NO: 11599 - DNA, 675 bp, Sorghum bicolor
  misc_feature: Ceres ANNOT ID no. 6022610
  misc_feature: Encodes the peptide sequence at SEQ ID NO 11600
atggaggccgccaccgtgcccagatccgccgcgggctgccgcgcggcgcccctgctcccggccgcccgggccgccgcgcgccacctggccctgccccggcgcgcgttctgcgcgtccgtcgcggcggcaccggcgccgcgcagcctcctcgccgctcgccgcgctgcggatggcgacagtgtggagacggcgccggaggcggtccccatcgagaaaaggttccctcccttcccgagcgtcatggacatcaaccagatccgcgagatcctcccccacaggttcccattccttttggttgatagagtaattgaatacaaggctggagaatatgcggtggggatcaagaatgttaccataaatgataacttcttcccaggacattttcctgaacgccccataatgcctggtgtcctcatggtcgaggctatggcccaggttgggggtctggtgatgctgcaacctgaagttggtggatctcgagacaacttcttttttgccgggattgacaaagttaggttcaggaagccagtgattgctggggatacattgatcatgaggatgacactgacaaagtatcagaagaggtttggactcgcaaagatggaaggaaaagcttatgttggtggtgacctagtttgtgaaggggagttcctgctggtcagcgcaactgagtag

SEQ ID NO: 11600 - protein, 224 aa, Sorghum bicolor
  misc_feature: Ceres ANNOT ID no. 6022610
  misc_feature (90)..(216): Pfam Id: FabA Pfam Desc: FabA-like domain
  misc_feature (39)..(224): NCBI GI: 72255615 NCBI Desc: 117m18_14 [brassica rapa]
  misc_feature (39)..(224): NCBI GI: 72384436 NCBI Desc: 52o08_29 [brassica rapa subsp. pekinensis]
  misc_feature (29)..(224): NCBI GI: 72384415 NCBI Desc: 4d11_17 [brassica rapa subsp. pekinensis]
  misc_feature (54)..(219): NCBI GI: 75706918 NCBI Desc: beta-hydroxyacyl-acp dehydratase [picea mariana]
  misc_feature (54)..(219): NCBI GI: 75706919 NCBI Desc: beta-hydroxyacyl-acp dehydratase b [picea mariana]
MEAATVPRSAAGCRAAPLLPAARAAARHLALPRRAFCASVAAAPAPRSLLAARRAADGDSVETAPEAVPIEKRFPPFPSVMDINQIREILPHRFPFLLVDRVIEYKAGEYAVGIKNVTINDNFFPGHFPERPIMPGVLMVEAMAQVGGLVMLQPEVGGSRDNFFFAGIDKVRFRKPVIAGDTLIMRMTLTKYQKRFGLAKMEGKAYVGGDLVCEGEFLLVSATE

SEQ ID NO: 11601 - DNA, 738 bp, Sorghum bicolor
  misc_feature: Ceres ANNOT ID no. 6022855
  misc_feature: Encodes the peptide sequence at SEQ ID NO 11602
atgtcggcggcggaggcgaaggcggcggtggtcccggagtctgtgctgcggaagcgcaagcgggaggagcagtgggcagcggacaagaaggagaaggcgctcgcggacaggaagaaggcgctcgagagccgcaagatcatcttctcccgcgccaagcagtacgcccaggagtacgacgcccaggagaaggagcttgtgcagctcaagcgtgaggcccggctgaagggtgggttctatgtaagcccagaggccaagcttctgtttgtggtccgcatccgtggtatcaatgccatgcaccccaagacccgcaagatcttgcagctcctgcgtttgaggcagatcttcaatggtgtcttcctcaaggttaacaaggcaaccattaacatgctgcgcagggtggagccatatgttgcgtatggatacccgaacctgaagagtgttagggagttgatctacaagagaggttatgggaagctgaacaagcagaggattccacttagcaacaacaatgtcatcgaggagggccttgggaagcacaatatcatctgcattgaggaccttgtgcatgagatcatgacagttggcccacacttcaaggaggccaacaacttcctctggccatttaagctgaaggcgcccctgggtggcctcaagaagaagaggaaccactatgtggagggtggtgatgccggcaaccgtgagaactacatcaatgagctcatcaagaggatgaactag

SEQ ID NO: 11602 - protein, 245 aa, Sorghum bicolor
  misc_feature: Ceres ANNOT ID no. 6022855
  misc_feature (14)..(84): Pfam Id: Ribosomal_L30_N Pfam Desc: Ribosomal L30 N-terminal domain
  misc_feature (86)..(137): Pfam Id: Ribosomal_L30 Pfam Desc: Ribosomal protein L30p/L7e
  misc_feature (3)..(245): NCBI GI: 115460394 NCBI Desc: os04g0605900 [oryza sativa (japonica cultivar-group)]
  misc_feature (3)..(245): NCBI GI: 57471716 NCBI Desc: ribosomal protein l7 [triticum aestivum]
  misc_feature (1)..(245): NCBI GI: 11994560 NCBI Desc: 60s ribosomal protein l7 [arabidopsis thaliana]
  misc_feature (4)..(245): NCBI GI: 3212879 NCBI Desc: 60s ribosomal protein l7 [arabidopsis thaliana]
  misc_feature (4)..(245): NCBI GI: 21593176 NCBI Desc: 60s ribosomal protein l7 [arabidopsis thaliana]
MSAAEAKAAVVPESVLRKRKREEQWAADKKEKALADRKKALESRKIIFSRAKQYAQEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNNVIEEGLGKHNIICIEDLVHEIMTVGPHFKEANNFLWPFKLKAPLGGLKKKRNHYVEGGDAGNRENYINELIKRMN

SEQ ID NO: 11603 - DNA, 936 bp, Sorghum bicolor
  misc_feature: Ceres ANNOT ID no. 6023073
  misc_feature: Encodes the peptide sequence at SEQ ID NO 11604
  misc_feature: Up-regulated in shoot tissues in response to salicylic acid treatment
atggctgcgcgctgcccctacttcgccgtggaggagtcctcccgcggcatccgctcgggggagtccccggccgcggcgctccgccggatcctcgcgacgcccggtgcgcaccaggcgccctgctgctacgacgcgctcggcgcgcgcctcgtcgagcgtgcggggttccagattgggttcatgggcggtttctgtgtttctgccgctcgacttggcttgcctgatgtcggcctcatttcctatggagaaatgatagaccaagggtgtctcatcaatgaagctgtttcaatcccagtgattggtgatggagacaatggttatggaaactctatgaatatcaagagaaccataaaagggtatatcaatgctggttttgctggaattatgcttgaggatcaggtggcacctaaagcatgtggacatactgaaggaaggaaagttatatcaagggaggaagctatcatgcacataaaagctgctgtagatgctaggaaggagagtggctctgacattgttattgtagcaaggtcagatgctcgccaagcaatttctcttgatgaagcattatggagggtgaaagcatttgctgatgctggagcagatgttctgtttattgatgcccttgcttcagtagaagagatgaaagcattttgtgctgttgcaccagaagttccaaagatggcaaacatgttagaaggtggtggtaaaactcccatattgagccctgctgaacttgcagaaattggtttcaggcttgcagtctatcctttatccttagttggggtatcaatgcgtgccatgcaggatgctctagttgcgataaaagacggcggtgtacctccacctagcatcttgccatcttttcaggagatcaaggatacattgggtttcaaccgctattataaagaagagaaacaataccaagtggtgagttag

SEQ ID NO: 11604 - protein, 311 aa, Sorghum bicolor
  misc_feature: Ceres ANNOT ID no. 6023073
  misc_feature (1)..(310): NCBI GI: 116309504 NCBI Desc: osigba0148p16.5 [oryza sativa (indica cultivar-group)]
  misc_feature (19)..(309): NCBI GI: 32490267 NCBI Desc: osjnbb0116k07.9 [oryza sativa (japonica cultivar-group)]
  misc_feature (17)..(307): NCBI GI: 124360683 NCBI Desc: isocitrate lyase and phosphorylmutase [medicago truncatula]
  misc_feature (22)..(308): NCBI GI: 118591427 NCBI Desc: carboxyphosphonoenolpyruvate phosphonomutase [stappia aggregata iam 12614]
  misc_feature (17)..(307): NCBI GI: 118736282 NCBI Desc: carboxyphosphonoenolpyruvate mutase pfam: icl-like [dinoroseobacter shibae dfl 12]
  misc_feature: Up-regulated in shoot tissues in response to salicylic acid treatment
MAARCPYFAVEESSRGIRSGESPAAALRRILATPGAHQAPCCYDALGARLVERAGFQIGFMGGFCVSAARLGLPDVGLISYGEMIDQGCLINEAVSIPVIGDGDNGYGNSMNIKRTIKGYINAGFAGIMLEDQVAPKACGHTEGRKVISREEAIMHIKAAVDARKESGSDIVIVARSDARQAISLDEALWRVKAFADAGADVLFIDALASVEEMKAFCAVAPEVPKMANMLEGGGKTPILSPAELAEIGFRLAVYPLSLVGVSMRAMQDALVAIKDGGVPPPSILPSFQEIKDTLGFNRYYKEEKQYQVVS

SEQ ID NO: 11605 - DNA, 1287 bp, Sorghum bicolor
  misc_feature: Ceres ANNOT ID no. 6023189
  misc_feature: Encodes the peptide sequence at SEQ ID NO 11606
atggccagtggcggcggcaacgcggcggcggcggcgaccgccaaggacgtcgtggacgcggaggtcgtcatcgtgggcggcggcatcgcggggctggcgtcggcgctggcgctccggcgggcgggcgcggcggcgcgccgcgtgctggtgctggagcgccacgcggggctgcgcgccaccggcgccgcgctcaccgtcttccccaacggctggttcgcgctccgcgcgctcggcgtcgcgcacaagctcgcctcccgctacgacgcctacgaaacatccaaggtgacgaatcttgagaccggggcgacgcaggtgtttcgcttcgccgggaacaagaacaagaaggcgctgctggaggcgctcgcggaggagctgccgccgggcaccgtccgcttctcgtccaagctcgtctccatcgacaccgagcgtgcagccggcgcctcgtcggagaccgtcgtccttggattggacgacggcacggtgatccgagccaaggtcttgatcgggtgcgacggcgtgcactcgatggtggcgcggtggctgggcctgtcggagccggcgagctcgggccgctccgccgtccgcgggctctccgtcttccctgacgggcacggcgtaaagcgggagctccggcagttcctctcggagggtctcagagccggcatggtgcccatcagcgacaccgatgtctactggttcctcgtcaacaacagcatccctgcagaggaagaagccgccggggacccggtgaagacgctgcgcgaggtgacggacaacctggccgggcacatgccggccgagtacctggacgtggtgcgccgctccgaccacggcaacctctcgtgggcgccgctcctgtaccggaacccggtgtccgtgctcctgggcgcggcggcgcgcgggcccgtgacggtggccggcgacgcgttccaccccatgacgcccgacatggcgcagggcgggtgctccgcgctggaggacgcggtggtgctcgcccgggcgctgtcgcgcgcggcgacgccggccgagggcgtcgccgcgtacgtggcgcggcggcggtggcgcgcggcatggctggtcgccggggcctacctgtctgggtgggtccagcagggcgggactaacgtcggcggcgtgcgcgggtggatggtgaaggtgttccgggactggatcttctacaggttcgtgtttccccggctcgccgacaccatgtggttcgactgcggcgacctcacgccgtcgccggtgccgccgcccacggtcggcaagaaccaccacaccgagtga

SEQ ID NO: 11606 - protein, 428 aa, Sorghum bicolor
  misc_feature: Ceres ANNOT ID no. 6023189
  misc_feature (19)..(363): Pfam Id: FAD_binding_3 Pfam Desc: FAD binding domain
  misc_feature (21)..(352): Pfam Id: DAO Pfam Desc: FAD dependent oxidoreductase
  misc_feature (4)..(251): NCBI GI: 38605914 NCBI Desc: osjnbb0088c09.8 [oryza sativa (japonica cultivar-group)]
  misc_feature (19)..(411): NCBI GI: 115450797 NCBI Desc: os03g0153500 [oryza sativa (japonica cultivar-group)]
  misc_feature (21)..(396): NCBI GI: 21537119 NCBI Desc: monooxygenase [arabidopsis thaliana]
  misc_feature (18)..(338): NCBI GI: 4164578 NCBI Desc: ctf2b [arabidopsis thaliana]
  misc_feature (19)..(371): NCBI GI: 4164576 NCBI Desc: ctf2a [arabidopsis thaliana]
MASGGGNAAAAATAKDVVDAEVVIVGGGIAGLASALALRRAGAAARRVLVLERHAGLRATGAALTVFPNGWFALRALGVAHKLASRYDAYETSKVTNLETGATQVFRFAGNKNKKALLEALAEELPPGTVRFSSKLVSIDTERAAGASSETVVLGLDDGTVIRAKVLIGCDGVHSMVARWLGLSEPASSGRSAVRGLSVFPDGHGVKRELRQFLSEGLRAGMVPISDTDVYWFLVNNSIPAEEEAAGDPVKTLREVTDNLAGHMPAEYLDVVRRSDHGNLSWAPLLYRNPVSVLLGAAARGPVTVAGDAFHPMTPDMAQGGCSALEDAVVLARALSRAATPAEGVAAYVARRRWRAAWLVAGAYLSGWVQQGGTNVGGVRGWMVKVFRDWIFYRFVFPRLADTMWFDCGDLTPSPVPPPTVGKNHHTE

SEQ ID NO: 11607 - DNA, 957 bp, Sorghum bicolor
  misc_feature: Ceres ANNOT ID no. 6023351
  misc_feature: Encodes the peptide sequence at SEQ ID NO 11608
atggcggtggacctgatgtcgtcctgcggcggccgggccggggcgtacgagcagctggcgttccaggaggcggccgcggcggggctgcgcagcctggagctgctggcttcgtcgctgtcgtccccgtgcggagcggggcagcgggccgagtcgccgccgctcgggcagatcgcggaccaggccgtgtcccgcttccgccgcgtcatcaacctgctggaccgcacggggcacgcccgcttccgccgcgcgcccgtcgccgcggtggagacggagacgacgctccaggccgcggtggaggagccgcagccgcctcagaagaaggccgccctgacgctggacttcaccaagccggtcccggtcccggcggcggcggcgaccaagccggcagcgccggcgccggcgccggccgtgtccggtacctcgacctcgttcctgtcgtccgtgaccgcgggcggcggcggcgaagggagcgtgtccaaggggtgcagtctggccgtgtcctccggcaagcctcccctcccgaagcgcaagctcccgtgccccgcctccgctccccagcaggcgcaggcgcaccagcaccagcaccagcaccagcacctcgcggagtcgtccgccgggcgttgccactgctcgaagaagaagcggagccgtcagggcctgtcccggcgcacggtgcgcgtgcccgcggcagccgcggccgcaggagcgccggggtcccacgtgccggcgtcgtcggacatccccgccgacgactactcgtggcgcaagtacgggcagaagcccatcaaggggtccccttacccgcgcggctactaccgctgcagcagcgccaagggctgccccgcgcggaagcacgtggagcgcgccgccgacgacccggccatgctcgtcgtcacctacgagggcgaccaccgccacgacgccgccgccgccgccgtccgcgcccgcgcggcctga

SEQ ID NO: 11608 - protein, 318 aa, Sorghum bicolor
  misc_feature: Ceres ANNOT ID no. 6023351
  misc_feature (248)..(308): Pfam Id: WRKY Pfam Desc: WRKY DNA -binding domain
  misc_feature (1)..(306): NCBI GI: 125491389 NCBI Desc: wrky transcription factor [triticum aestivum]
  misc_feature (1)..(311): NCBI GI: 115457562 NCBI Desc: os04g0287400 [oryza sativa (japonica cultivar-group)]
  misc_feature (3)..(311): NCBI GI: 38568048 NCBI Desc: osjnba0065j03.18 [oryza sativa (japonica cultivar-group)]
  misc_feature (1)..(311): NCBI GI: 46394354 NCBI Desc: tpa: wrky transcription factor 51 [oryza sativa (indica cultivar-group)]
  misc_feature (1)..(306): NCBI GI: 83630935 NCBI Desc: wrky65 [glycine max]
  misc_feature: The plants are small.
  misc_feature: The sequence is a functional homolog of SEQ ID NO 10 in the 10/412,699US patent application
  misc_feature: The sequence is a functional homolog of SEQ ID NO 1020 in the 10/412,699US patent application
  misc_feature: The sequence is a functional homolog of SEQ ID NO 1024 in the 10/412,699US patent application
  misc_feature: The sequence is a functional homolog of SEQ ID NO 1026 in the 10/412,699US patent application
  misc_feature: The sequence is a functional homolog of SEQ ID NO 124 in the 11/479,226US patent application
  misc_feature: The sequence is a functional homolog of SEQ ID NO 1277 in the 11/479,226US patent application
  misc_feature: The sequence is a functional homolog of SEQ ID NO 2442 in the 10/374,780US patent application
  misc_feature: The sequence is a functional homolog of SEQ ID NO 28 in the 10/374,780US patent application
  misc_feature: The sequence is a functional homolog of SEQ ID NO 290 in the 10/374,780US patent application
  misc_feature: The sequence is a functional homolog of SEQ ID NO 476 in the 11/435,388US patent application
  misc_feature: The sequence is a functional homolog of SEQ ID NO 48 in the 11/375,241US patent application
  misc_feature: The sequence is a functional homolog of SEQ ID NO 525 in the 10/374,780US patent application
  misc_feature: The sequence is a functional homolog of SEQ ID NO 530 in the 10/374,780US patent application
  misc_feature: The sequence is a functional homolog of SEQ ID NO 534 in the 10/374,780US patent application
  misc_feature: The sequence is a functional homolog of SEQ ID NO 590 in the 10/412,699US patent application
  misc_feature: The sequence is a functional homolog of SEQ ID NO 6 in the 10/225,066US patent application
  misc_feature: The sequence is a functional homolog of SEQ ID NO 632 in the 11/435,388US patent application
  misc_feature: The sequence is a functional homolog of SEQ ID NO 678 in the 10/225,066US patent application
  misc_feature: The sequence is a functional homolog of SEQ ID NO 886 in the 10/666,642US patent application
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1020 in the 20040045049 US patent application
  misc_feature: The sequence is a functional homolog of SEQ ID NO 1024 in the 20040045049 US patent application
  misc_feature: The sequence is a functional homolog of SEQ ID NO 1026 in the 20040045049 US patent application
  misc_feature: The sequence is a functional homolog of SEQ ID NO 590 in the 20040045049 US patent application
  misc_feature: The sequence is a functional homolog of SEQ ID NO 6 in the 20050160493 US patent application
  misc_feature: The sequence is a functional homolog of SEQ ID NO 678 in the 20050160493 US patent application
  misc_feature: The sequence is a functional homolog of SEQ ID NO 886 in the 20070033671 US patent application
  misc_feature: Functional homolog of the protein sequence given in SEQ ID NO 13583
MAVDLMSSCGGRAGAYEQLAFQEAAAAGLRSLELLASSLSSPCGAGQRAESPPLGQIADQAVSRFRRVINLLDRTGHARFRRAPVAAVETETTLQAAVEEPQPPQKKAALTLDFTKPVPVPAAAATKPAAPAPAPAVSGTSTSFLSSVTAGGGGEGSVSKGCSLAVSSGKPPLPKRKLPCPASAPQQAQAHQHQHQHQHLAESSAGRCHCSKKKRSRQGLSRRTVRVPAAAAAAGAPGSHVPASSDIPADDYSWRKYGQKPIKGSPYPRGYYRCSSAKGCPARKHVERAADDPAMLVVTYEGDHRHDAAAAAVRARAA

SEQ ID NO: 11609 - DNA, 2454 bp, Sorghum bicolor
  misc_feature: Ceres ANNOT ID no. 6023760
  misc_feature: Encodes the peptide sequence at SEQ ID NO 11610
atggcctccaagctgagtttcaagaggacagacagtctcgcggaaagcatgcccgatgcgttaaggcagagccggtaccagatgaagaaatgtttccagaggtatgtttccaagggaaggaggctcttgaagaaccagcagctcatagaggagctggagaaatcactggatgacaaagtcgagaaggaaaagcttgttgaaggcttcctaggttacattatttgttccacgcaggaagcagtggtgctaccaccttatgttgcatttgctgtcaggatgaatcctggcatctgggagtatgtcaaagttcattctgaggatctgtcggtcgaaggaatcacaccatctgagtacctcaagttcaaggagacattatatgatgagaactgggccaaggatgacaactcactggaagtcgatttcggtgctcttgacctctcaacaccccatctgacactgccatcgtccataggaaacgggctccagtttgtgtccaaatttatgtcttcaaagctgggcgacaagcctgaaattagcatgaaaccgttgctggactatttgctttcactgaactatcgtggcgagaagctgatggttaacgacaccatcgatacggttaacaagcttcagacagcactgctacttgcagaggtatttgttagtggtttgccaagatacacgccattcctgaagtttgaacagagatttcaagagtggggattggagaaagggtggggtgacactgctgaaaggtgcaaggagacgctgaattgcctctctgaggtgctacaagcgccagaccctatcaacatggagaagttcttcagcagagttccatccacattcaatatagtcatcttctccatccacggttactttggccaagagaaggttcttggcttgccagacaccggtggccaggtggtctacatcctggaccaagtcagagcccttgaagaggagttgctgcaaagaatcaagctgcagggtctgaacgtgacaccaaagattcttgtgctcactaggctgataccagatgccaagggtacaaaatgcaatgtggagctcgaaccagttgaaaatacaaaacattcccacatacttcgtgtgccattcaagactgaagacggcaaggagttgcgccagtgggtgtcccggtttgacatctacccttacctagagagatatgcccaggattcgtgtgccaaaattcttgacattttggagggcaagccagacctgatcatcggcaactataccgatggcaacttagtggcgtctctcatgtcaagcaagctaggtgtcactcaggggacaatcgcgcacgctctagagaagacaaagtatgaagattcagatgtcaagtggagagatctggaccagaagtaccatttctcctgccaattcactgcagatatgattgccatgaacaccagtgacttcatcatcactagcacataccaagaaattgctggaagcaaagagaagcctggccaatatgagcaccactacgcattcacaatgccggggctctgtcgctacgccacaggcatcaatgtctttgatccaaagttcaacattgccgcacccggtgcagaccagtccatctacttccccttcacacagaaacagaagcggctgacagatttgcacccacagattgaggagttgctctacagcaagcaagacaccaatgaacacatagggtatctggcagacagaaacaagccaatcatcttctcgatggcaaggctggacaagtccaaggaccgggaagagattgaagaaatcaacaaaatgcatagcctgatcgacatgtatcagctgaaaggacagattcgctggatcaaggcacagactgaccgtgtccgcaacggtgagctgtaccgttgcatagcagatacaaagggtgcatttgttcagcctgcactttatgaagcattcgggctgacggtcattgaagcgatgaactgcggattgacaacctttgcgacaaatcagggagggccagcagagatcattgtggacggtgtctccggtttccacataaacccaatgaatggcagggaggcaagcaacaagattgccgatttcttccaaaagtgcaaggaagacccaagctattggaacaaggtgtccactgctgggctccagcgcatctacgaatgctacacatggaagatttatgcaactaaagtcctgaatatgggttcaacatatggcttctggaagactttgaacaaggaggagagactagccaaacagcgctacctgcagatgttctacaatcttcagttcaggaatctggcaaagactgtccctaggttatttgaacatcctccgcaagccctagcagggcctagtacaatgaccgtaacgaggcccaaagaaaggcaaatggatggtgtaaagagagtggaagtgtacatgattacaattgataataatatatga

SEQ ID NO: 11610 - protein, 817 aa, Sorghum bicolor
  misc_feature: Ceres ANNOT ID no. 6023760
  misc_feature (8)..(560): Pfam Id: Sucrose_synth Pfam Desc: Sucrose synthase
  misc_feature (563)..(719): Pfam Id: Glycos_transf_1 Pfam Desc: Glycosyl transferases group 1
  misc_feature (1)..(610): NCBI GI: 115457664 NCBI Desc: os04g0309600 [oryza sativa (japonica cultivar-group)]
  misc_feature (1)..(611): NCBI GI: 116309540 NCBI Desc: h0211a12.6 [oryza sativa (indica cultivar-group)]
  misc_feature (1)..(611): NCBI GI: 38567939 NCBI Desc: osjnba0033h08.16 [oryza sativa (japonica cultivar-group)]
  misc_feature (1)..(611): NCBI GI: 38346957 NCBI Desc: osjnbb0026i12.4 [oryza sativa (japonica cultivar-group)]
  misc_feature (1)..(628): NCBI GI: 140067659 NCBI Desc: sucrose synthase; n-6 adenine-specific dna methylase [medicago truncatula]
  misc_feature (1)..(622): SWISSPROT Homolog: EC 2.4.1.13 Sucrose synthase 2
  misc_feature: Useful for making plants with altered cell wall content and/or composition
  misc_feature: GREAT-hit functional homolog of the protein sequence encoded by LOCUS at1g73370
  misc_feature: Functional homolog of the protein sequence encoded by LOCUS at5g37180
  misc_feature: Useful for making plants with altered carbohydrate content
  misc_feature: Functional homolog of the protein sequence given in SEQ ID NO 13681
  misc_feature: Useful for making plants with altered cell wall content and/or composition
  misc_feature: Functional homolog of the protein sequence given in SEQ ID NO 13682
  misc_feature: The sequence is a functional homolog of SEQ ID NO 12 in US patent 7091398
  misc_feature: The sequence is a functional homolog of SEQ ID NO 2 in US patent 7091398
MASKLSFKRTDSLAESMPDALRQSRYQMKKCFQRYVSKGRRLLKNQQLIEELEKSLDDKVEKEKLVEGFLGYIICSTQEAVVLPPYVAFAVRMNPGIWEYVKVHSEDLSVEGITPSEYLKFKETLYDENWAKDDNSLEVDFGALDLSTPHLTLPSSIGNGLQFVSKFMSSKLGDKPEISMKPLLDYLLSLNYRGEKLMVNDTIDTVNKLQTALLLAEVFVSGLPRYTPFLKFEQRFQEWGLEKGWGDTAERCKETLNCLSEVLQAPDPINMEKFFSRVPSTFNIVIFSIHGYFGQEKVLGLPDTGGQVVYILDQVRALEEELLQRIKLQGLNVTPKILVLTRLIPDAKGTKCNVELEPVENTKHSHILRVPFKTEDGKELRQWVSRFDIYPYLERYAQDSCAKILDILEGKPDLIIGNYTDGNLVASLMSSKLGVTQGTIAHALEKTKYEDSDVKWRDLDQKYHFSCQFTADMIAMNTSDFIITSTYQEIAGSKEKPGQYEHHYAFTMPGLCRYATGINVFDPKFNIAAPGADQSIYFPFTQKQKRLTDLHPQIEELLYSKQDTNEHIGYLADRNKPIIFSMARLDKSKDREEIEEINKMHSLIDMYQLKGQIRWIKAQTDRVRNGELYRCIADTKGAFVQPALYEAFGLTVIEAMNCGLTTFATNQGGPAEIIVDGVSGFHINPMNGREASNKIADFFQKCKEDPSYWNKVSTAGLQRIYECYTWKIYATKVLNMGSTYGFWKTLNKEERLAKQRYLQMFYNLQFRNLAKTVPRLFEHPPQALAGPSTMTVTRPKERQMDGVKRVEVYMITIDNNI

SEQ ID NO: 11611 - DNA, 2385 bp, Sorghum bicolor
  misc_feature: Ceres ANNOT ID no. 6023823
  misc_feature: Encodes the peptide sequence at SEQ ID NO 11612
atgaggagaggaacggaaggtgttgtgagcgcgctgctcgtggtggtggtggttgctgggctgttgctgtcgtcgtcgtcttcatcgtcgccggcggcggcgacggaggaatacggcgttggtatccaccggcgttcgctccaccagccgtttttccccatcgattccacgccgccgccggggttcgatgactcgatcgtgccaccgccgccgccaccggcggcgggggccgcgtcggcgtcggcgtccaagggaggcgggcggtcctcgaccggtctcaccaacaccatcgcgatcgcgctcgccacgggcctcgtcgtgctcgcggtggcgttctactcgtgcttcctcctttggcgccgacgctccgacggaggaggcgggggcggcaacggtctccgcgccgtgaagtcggcgccgccaggatccgtcgccgtgagggtccccagcgacgtggggagcagcgcgcggcaccagcggtcgccgccgccgagctcgacggcgtccgacgcgatatacctcgacccgctcacgacgatggtggaggtgagccggcaccggccgccgagtccggaccttcgcccgctcgcgctcgtgaagcagccgagccccgacctccgcccgctgccgccgctgaagcggccggcgcagcaacccccgcctccgccggcgtccacgccgccggcgaccaccacgggggattcctccgacgaggacgaccaggccacgtactacaccgcgcccaagaccgccaagtcctggttcagccggagcactagccagcgcagcaccctggagcaaacagtggctgtggctcaaccacccgcgcctgctcccgtgcccacgccgacgccgacgcaagctaaccccccacggcctgctcgtccgccgccgcccccaccgccaccgaggcaaaggttgctgcgaccgatgcccgaggagtccccacccccggccgtcctcgccagtttggcgctaaccaattccgcagacccctctgttcaggacaggggaggcgagaacccggatggcgacggcgggagagcgcggccgccgaagccaccaagcctgaagccgctgcactgggacaagctccgcgccatttccggccgcaccaccgtctgggaccaggtcaacaattccgactcgttccgcgtgaacgaagcggcgatggagagcttgttcctgaacaactccggcggcgcggggaattcggatcaggcggcgaggaggggaagcgccgggaagcaggagagccggctgctcgacccgaagaggcttcagaatgtcgcgatcatgctcaaagtgctcaatgtgacatcggctgatgtgattggagcactcatgcacggaaatggagatttggggtctgagttctacgaaacactagctaagatggcaccgacaaaagaagaagaactgaaattaaaagattataatggggatatatcaaaacttgatccagcagagcgctttctgaaagacgtacttgatgttccttttgccttcaaaagagtagacgcaatgttgtacagagcaaactttggcactgaagcgaattatttaaagaaatcttttggaacgctagaggcagcctgtacagatttaagaagcagcaagctattcttgaagttgctagatgcagttctcaagactgggaaccgcatgaacgatggaactaatcgaggcgaggcgagggccttcaaacttgacacccttctaaagcttgcagacatcaagtcgacagacggaaaaacgacagtgctgcatttcgtagttcaagagatcatccgatctgaaggctttggttcagatcaaacagcagcatcgaatcccggcagcaccagcaaggaacagttcaagaaggatggcctgaaagtgcttgcagggctcagcagtgagctctcaaacgtgaagagtgcagccactttggagatggacacgctggtcggcagcgtctcgaggctcgaaaccgacctcgagaaggtgaagctggtctctcagctcaaccagacatgtcccggtcaggtctcaagcgagaagttcttcgaggcgatcgacgcgttcctcggacatgctcaggcggagattgacacagtgaaggcagccggcgagagcgcgctgcagcatgtcaaggagaccacggagtacttccacggcgacgccatcaaggaggagcctcacccgctgaggatcttcatggtggtgagcgatttcctcgcgacgctggaccgcgtgtgccgggacgtcggcaggacgccggagagggtgatgatggggtccggcaagtcgttccgcgtctcggccggcacctccctgccgcagcgccggaacgagcagcggagggatctcagctcctctgacgaggatagctcttctgactag

SEQ ID NO: 11612 - protein, 794 aa, Sorghum bicolor
  misc_feature: Ceres ANNOT ID no. 6023823
  misc_feature (348)..(744): Pfam Id: FH2 Pfam Desc: Formin Homology 2 Domain
  misc_feature (32)..(793): NCBI GI: 115473083 NCBI Desc: os07g0588200 [oryza sativa (japonica cultivar-group)]
  misc_feature (203)..(794): NCBI GI: 37694426 NCBI Desc: formin-like protein atfh6 [arabidopsis thaliana]
  misc_feature (294)..(793): NCBI GI: 124361016 NCBI Desc: actin-binding fh2 [medicago truncatula]
  misc_feature (241)..(793): NCBI GI: 50726257 NCBI Desc: diaphanous protein-like [oryza sativa (japonica cultivar-group)]
  misc_feature (178)..(793): NCBI GI: 92866950 NCBI Desc: actin-binding fh2 [medicago truncatula]
MRRGTEGVVSALLVVVVVAGLLLSSSSSSSPAAATEEYGVGIHRRSLHQPFFPIDSTPPPGFDDSIVPPPPPPAAGAASASASKGGGRSSTGLTNTIAIALATGLVVLAVAFYSCFLLWRRRSDGGGGGGNGLRAVKSAPPGSVAVRVPSDVGSSARHQRSPPPSSTASDAIYLDPLTTMVEVSRHRPPSPDLRPLALVKQPSPDLRPLPPLKRPAQQPPPPPASTPPATTTGDSSDEDDQATYYTAPKTAKSWFSRSTSQRSTLEQTVAVAQPPAPAPVPTPTPTQANPPRPARPPPPPPPPRQRLLRPMPEESPPPAVLASLALTNSADPSVQDRGGENPDGDGGRARPPKPPSLKPLHWDKLRAISGRTTVWDQVNNSDSFRVNEAAMESLFLNNSGGAGNSDQAARRGSAGKQESRLLDPKRLQNVAIMLKVLNVTSADVIGALMHGNGDLGSEFYETLAKMAPTKEEELKLKDYNGDISKLDPAERFLKDVLDVPFAFKRVDAMLYRANFGTEANYLKKSFGTLEAACTDLRSSKLFLKLLDAVLKTGNRMNDGTNRGEARAFKLDTLLKLADIKSTDGKTTVLHFVVQEIIRSEGFGSDQTAASNPGSTSKEQFKKDGLKVLAGLSSELSNVKSAATLEMDTLVGSVSRLETDLEKVKLVSQLNQTCPGQVSSEKFFEAIDAFLGHAQAEIDTVKAAGESALQHVKETTEYFHGDAIKEEPHPLRIFMVVSDFLATLDRVCRDVGRTPERVMMGSGKSFRVSAGTSLPQRRNEQRRDLSSSDEDSSSD

SEQ ID NO: 11613 - DNA, 1962 bp, Sorghum bicolor
  misc_feature: Ceres ANNOT ID no. 6023855
  misc_feature: Encodes the peptide sequence at SEQ ID NO 11614
atggcggctccatccgcctccgcccccttgctccgctcccacccccaccgcggctcgctcgtgccctcgtcgccgcgccaccgtcccgcggccacttccctgcttgagttcccaccccgcagacccgcctcctcccgcaggttcccatacaccgcggtgcggtcctcctccactgcctcaccctcggcacctgtggaagaggcttccgcggccgcggccccgaccggagacgaggaggaggagcgggtggtgctccccaccaacgagtcctccgaaaccctgctgcgcatccgaagctgttcccccaactccaaggtgacaataggtccctggatagagaatggtttctactacgactttgacatggagcccttgacagataaggacctcaagaagattaagaaggagatggatcggatcatccgacagaacctcccgctggtgagggaggaggtgtcccgagaagaggctcagaagaggattgaagcactcaatgagccttataagttggagattttggagagcattaaggaagaaccaatcacgatataccacattggagaagagtggtgggatctctgtgccgggcctcatgtggagtcaactggaaaaataaacagaaaggctgttgagcttgagtctgttgctggtgcttactggagaggtgatgagaaaaaccaaatgctacaaagaatatatggaactgcttgggaaaatgaagatcaactgaaggcttacatccactttaaggaggaagccaagcgccgagatcatcgacgattgggtcaggaccttgatctgttctctatacaggatgatgctggtggtggtctagtattctggcatccaaaaggcgctatcatcagacacattttagaagactcatggaaacagattcatttgcaacatggttatgatctactgtacactcctcatgttgcgaaggctgatctttggaagatcagtggacacatagacttctacaaagagagcatgtacaatcaaatggatgttgaagatgagatgtatcaactgcggcctatgaattgcccttaccacattttggtatacaagagaaaactacattcatatcgggattttcctatcagagtggcagagctaggaacggtctacagatatgagctatctggtagtcttcacgggttgttccgtgtaagagggttcacacaggatgatgcccacatattttgcctggaggaccagataaaagatgaaattagaggtgttcttgatctaactgagcaaatacttggacaatttggttttcggtattatgagataaacctttcaactaggccagaaaaatctgttggcactgatgacatatgggaaaaggcaacgattgctctgaagaatgcattagatgataaaggttgggaatacaaggttgatgaaggtggaggtgctttttatggtccaaaaatcgatctaaaaattgaggatgctcttggaaggaaatggcagtgttccactgtgcaggtggatttcaatttgcctgaacggttcgacattacctatgttgattcaaattctgagaaaaagcgacccatcatgattcatagagctatccttgggtctttggagcgcttctttggtgtcctgattgagcactatgctggtgattttccactttggcttgccccaacccaagcccgtattctacctgtgacagacaatgagttgcaatactgtaacgaggtggcctcagaactgaaatcaagagggttacgtgttgaagtctgtcatggagagcgcctaccaaagctaataaggaatgctgaaacacaaaaggtgccactcatggcagttgttggccctaaagaagttcaagccaggaccctgactatcaggtccaggcacaatggggagatcggcacaatgcccgtcgacgaattcatcacgagacttcaacttgctgtcgcaaacaaatcatcgttatag

SEQ ID NO: 11614 - protein, 653 aa, Sorghum bicolor
  misc_feature: Ceres ANNOT ID no. 6023855
  misc_feature (288)..(454): Pfam Id: tRNA-synt_2b Pfam Desc: tRNA synthetase class II core domain (G, H, P, S and T)
  misc_feature (181)..(233): Pfam Id: tRNA_SAD Pfam Desc: Threonyl and Alanyl tRNA synthetase second additional domain
  misc_feature (557)..(646): Pfam Id: HGTP_anticodon Pfam Desc: Anticodon binding domain
  misc_feature (65)..(652): NCBI GI: 116075451 NCBI Desc: threonyl-trna synthetase [synechococcus sp. rs9916]
  misc_feature (67)..(652): NCBI GI: 87303299 NCBI Desc: threonyl-trna synthetase, class iia [synechococcus sp. wh 5701]
  misc_feature (158)..(653): NCBI GI: 67920215 NCBI Desc: threonyl-trna synthetase, class iia [crocosphaera watsonii wh 8501]
  misc_feature (163)..(653): NCBI GI: 126658692 NCBI Desc: threonyl-trna synthetase, class iia [cyanothece sp. ccy0110]
  misc_feature (55)..(650): NCBI GI: 78184510 NCBI Desc: threonyl-trna synthetase, class iia [synechococcus sp. cc9902]
  misc_feature (38)..(652): SWISSPROT Homolog: EC 6.1.1.3 Threonyl-tRNA synthetase
MAAPSASAPLLRSHPHRGSLVPSSPRHRPAATSLLEFPPRRPASSRRFPYTAVRSSSTASPSAPVEEASAAAAPTGDEEEERVVLPTNESSETLLRIRSCSPNSKVTIGPWIENGFYYDFDMEPLTDKDLKKIKKEMDRIIRQNLPLVREEVSREEAQKRIEALNEPYKLEILESIKEEPITIYHIGEEWWDLCAGPHVESTGKINRKAVELESVAGAYWRGDEKNQMLQRIYGTAWENEDQLKAYIHFKEEAKRRDHRRLGQDLDLFSIQDDAGGGLVFWHPKGAIIRHILEDSWKQIHLQHGYDLLYTPHVAKADLWKISGHIDFYKESMYNQMDVEDEMYQLRPMNCPYHILVYKRKLHSYRDFPIRVAELGTVYRYELSGSLHGLFRVRGFTQDDAHIFCLEDQIKDEIRGVLDLTEQILGQFGFRYYEINLSTRPEKSVGTDDIWEKATIALKNALDDKGWEYKVDEGGGAFYGPKIDLKIEDALGRKWQCSTVQVDFNLPERFDITYVDSNSEKKRPIMIHRAILGSLERFFGVLIEHYAGDFPLWLAPTQARILPVTDNELQYCNEVASELKSRGLRVEVCHGERLPKLIRNAETQKVPLMAVVGPKEVQARTLTIRSRHNGEIGTMPVDEFITRLQLAVANKSSL

SEQ ID NO: 11615 - DNA, 174 bp, Sorghum bicolor
  misc_feature: Ceres ANNOT ID no. 6023957
  misc_feature: Encodes the peptide sequence at SEQ ID NO 11616
atggccggcctcaggatgaagttcgtcgccgtcgccgccatggccgccgccctcgtggcgtcagccgcggccgccgaggcccccgcccccgcgccggcctccgacgccgccgctgccgtgcccctcgccgcggcctccctcgccgccgccgccttcggctacctcttctgctag

SEQ ID NO: 11616 - protein, 57 aa, Sorghum bicolor
  misc_feature: Ceres ANNOT ID no. 6023957
  misc_feature (1)..(51): NCBI GI: 115472945 NCBI Desc: os07g0573900 [oryza sativa (japonica cultivar-group)]
  misc_feature (2)..(57): NCBI GI: 115440295 NCBI Desc: os01g0778300 [oryza sativa (japonica cultivar-group)]
  misc_feature (1)..(56): NCBI GI: 25992536 NCBI Desc: fiber protein fb7 [gossypium barbadense]
  misc_feature: Useful for making plants with altered Lignin content
  misc_feature: Useful for making plants with altered cell wall content and/or composition
  misc_feature: Functional homolog of the protein sequence given in SEQ ID NO 13337
  misc_feature: GREAT-hit functional homolog of the protein sequence encoded by LOCUS at4g26320
MAGLRMKFVAVAAMAAALVASAAAAEAPAPAPASDAAAAVPLAAASLAAAAFGYLFC

SEQ ID NO: 11617 - DNA, 987 bp, Sorghum bicolor
  misc_feature: Ceres ANNOT ID no. 6023966
  misc_feature: Encodes the peptide sequence at SEQ ID NO 11618
atggtggacgcacgcctcgcggcgcgcccaccccgcccgcgtgcccctgtccgcctcccgtttgccgcctccaccgcaacgcggcgcgcggggtggcggtgccctcgcgatcctcgtgtcgattccagcggcgggggtacctttccctttccctcccctggccgttgcccgcgcctcgcggtcgcgcaccggaaccggagccccgcggcgaatctaggtttgcctccgccccgccctctcctcccgacactcccggcggctggaattaggacgagggtaacaggggacggaggctgcgagggacgccccctcgtcgaatgcaccggcgaccgatctgttgaggagcagccggagcacgcaggagttgaggggaaagcattgaaaatgtcatctactgtgccgaagtcatcaaatatcttctggcatgattgtccagttggcaagactgatcgccagaagctactcaagcagaaaggctgtgttgtgtggattaccggccttagtggttcaggtaaaagtacgttggcatgtacattaggtcgggagctccacacaagagggaagcttgcatatgtccttgatggtgataacttaagacatggtctgaacaaggatcttggctttaacgctgaagatcgtgctgaaaatataaggagagttgatgcgggccttgtatgtattgcaagtttgatatctccatataggagggaccgtgaatcttgccgtgcaatgttgtctgatggtagctttattgaagttttcttgaacatgtccttggaattgtgtgaagcaagggatccaaagggcctctataagcttgctcgtgcaggaaaaataaagggttttacaggaatagatgacccttatgaagcaccactgaattgcgagattgagatcaaagaagctgatggtgtatgcccttcgccttctgacatggcagggcaagtggttacttaccttgaggagaaaggcttcctgcacgagtag

SEQ ID NO: 11618 - protein, 328 aa, Sorghum bicolor
  misc_feature: Ceres ANNOT ID no. 6023966
  misc_feature (158)..(305): Pfam Id: APS_kinase Pfam Desc: Adenylylsulphate kinase
  misc_feature (55)..(328): NCBI GI: 6563285 NCBI Desc: adenosine-5'-phosphosulfate kinase [zea mays]
  misc_feature (124)..(326): NCBI GI: 92880848 NCBI Desc: adenylylsulfate kinase [medicago truncatula]
  misc_feature (121)..(326): NCBI GI: 2832300 NCBI Desc: adenosine-5'-phosphosulfate-kinase [catharanthus roseus]
  misc_feature (135)..(326): NCBI GI: 9757873 NCBI Desc: adenylylsulfate kinase-like protein [arabidopsis thaliana]
  misc_feature (135)..(326): NCBI GI: 20453397 NCBI Desc: at4g39940/t5j17_110 [arabidopsis thaliana]
  misc_feature (121)..(326): SWISSPROT Homolog: EC 2.7.1.25 Adenylyl-sulfate kinase, chloroplast precursor
  misc_feature: Useful for making plants with modulated biomass
  misc_feature: Useful for making plants with modulated heat sensitivity
  misc_feature: Functional homolog of the protein sequence given in SEQ ID NO 13501
MVDARLAARPPRPRAPVRLPFAASTATRRAGWRCPRDPRVDSSGGGTFPFPSPGRCPRLAVAHRNRSPAANLGLPPPRPLLPTLPAAGIRTRVTGDGGCEGRPLVECTGDRSVEEQPEHAGVEGKALKMSSTVPKSSNIFWHDCPVGKTDRQKLLKQKGCVVWITGLSGSGKSTLACTLGRELHTRGKLAYVLDGDNLRHGLNKDLGFNAEDRAENIRRVDAGLVCIASLISPYRRDRESCRAMLSDGSFIEVFLNMSLELCEARDPKGLYKLARAGKIKGFTGIDDPYEAPLNCEIEIKEADGVCPSPSDMAGQVVTYLEEKGFLHE

SEQ ID NO: 11619 - DNA, 1743 bp, Sorghum bicolor
  misc_feature: Ceres ANNOT ID no. 6024574
  misc_feature: Encodes the peptide sequence at SEQ ID NO 11620
atggggattcccctccggtctctcctcgtcgcctcgctcgtcctcagttcggtcgtcttgcacgtcgcagcggccaaaactatagatccctacaaggcgagagttgacaagaatgccagccaacgggatattcagaaagcctttcacaagctttctctaaaataccaccctgacaagaataaaggcaagggtgctcaggaaaaatttgaagaaataaacaatgcatatgagattctatctgatgaagagaagaggaaaaactatgacctctacggggatgagaagggtaaccctggatttggtggtgggaattttggaaatcatgagggctatacatactttggtggtggccccaagtccagtcattttacatctggtaatggatggcagacaatgggtggtcaaggaaatacaaaaacgttttccttttcttttggtggtaaacctggcgccagtggtggaaacccgtttggtggtggttttgatgttggtgatgttttctcgaacctttttagtggtggatcaatgggcgacagccattttggtggatcaactggctcagctagagccaactctggaacttctggtcagcattctggcactgccaagattcaggatgtcaccacgcaagttttcaataaagaagtagctgaccaaggaactacttggcttctattattttatacaccccagtcaaaaggtcaatttgtgctagagagtgtcatgcaggatgtggtccattcactggatggtgctctgagggctggtaaggtcaactgtgacaatgaaaaaactctttgcaaaaggtctggtgtttctatagggaaattggcccgcctcttcatctattcatatgctactacagaaaaagggtctttgcatgagtattctggagaacatgatgctaagagcttgaagacattttgtcaagagcacctgccaagattctccaaacgggtagatattggccaattcagcttccctttaaatgttctaccaaaccttcctcaagtgctcttactatcgagtaagaaggacacaccagcaatgtggcgtgctatcagtgggatgttccgcaatcgattaattttttatgatgctgaggttcatgatgtttctcatccgctgctcaaaagtcttggtgtgaagaatcttccagctgtaattggccgaaccgtgaatggtgaggagctccttctgaaggatggcatttcggtgaaagatctcagatctggtatcaaggaattgaagacactgctagaaagttttgagaagaagaataagaagctgtcatcgagtcaagctaacagcaaaccttccagtcaatgggaagaaaaaaaggtccctctcctcacagcttccaactttgaggaaatatgtggagataagacttcagtatgcatcattggtgttttcggatcaaacaaagccaaggggcagcttgaaacagtcctgtctgagatatctaagaagactctgataagggggcagaactataattccagaaatgcagtctcctatgctttgttggataaggacaaacaatctgcattcctgtcatcgtttgacaagtctggatataggtcatctgacaaactgctcatcgcctacaagcctcgccgggggaggttcgcggtgtacgacggcgaggtgacattggaagaagctgaaaggttcgtgggatctgttttgaacggagacgttcaactgtcaccgaccaaacaaaagcctgtccttaggtag

SEQ ID NO: 11620 - protein, 580 aa, Sorghum bicolor
  misc_feature: Ceres ANNOT ID no. 6024574
  misc_feature (29)..(89): Pfam Id: DnaJ Pfam Desc: DnaJ domain
  misc_feature (8)..(571): NCBI GI: 67612712 NCBI Desc: heat shock protein dnaj pfj2 [cryptosporidium hominis]
  misc_feature (8)..(571): NCBI GI: 54658370 NCBI Desc: heat shock protein dnaj pfj2 [cryptosporidium hominis]
  misc_feature (12)..(180): NCBI GI: 82793288 NCBI Desc: heat shock protein dnaj [plasmodium yoelii yoelii str. 17xnl]
  misc_feature (12)..(180): NCBI GI: 23484095 NCBI Desc: heat shock protein dnaj homologue pfj2 [plasmodium yoelii yoelii]
  misc_feature (12)..(147): NCBI GI: 3721862 NCBI Desc: heat shock protein dnaj homologue pfj2 [plasmodium falciparum]
  misc_feature: Useful for making plants with modulated heat sensitivity
  misc_feature: Functional homolog of the protein sequence given in SEQ ID NO 13683
MGIPLRSLLVASLVLSSVVLHVAAAKTIDPYKARVDKNASQRDIQKAFHKLSLKYHPDKNKGKGAQEKFEEINNAYEILSDEEKRKNYDLYGDEKGNPGFGGGNFGNHEGYTYFGGGPKSSHFTSGNGWQTMGGQGNTKTFSFSFGGKPGASGGNPFGGGFDVGDVFSNLFSGGSMGDSHFGGSTGSARANSGTSGQHSGTAKIQDVTTQVFNKEVADQGTTWLLLFYTPQSKGQFVLESVMQDVVHSLDGALRAGKVNCDNEKTLCKRSGVSIGKLARLFIYSYATTEKGSLHEYSGEHDAKSLKTFCQEHLPRFSKRVDIGQFSFPLNVLPNLPQVLLLSSKKDTPAMWRAISGMFRNRLIFYDAEVHDVSHPLLKSLGVKNLPAVIGRTVNGEELLLKDGISVKDLRSGIKELKTLLESFEKKNKKLSSSQANSKPSSQWEEKKVPLLTASNFEEICGDKTSVCIIGVFGSNKAKGQLETVLSEISKKTLIRGQNYNSRNAVSYALLDKDKQSAFLSSFDKSGYRSSDKLLIAYKPRRGRFAVYDGEVTLEEAERFVGSVLNGDVQLSPTKQKPVLR

SEQ ID NO: 11621 - DNA, 1824 bp, Sorghum bicolor
  misc_feature: Ceres ANNOT ID no. 6024877
  misc_feature: Encodes the peptide sequence at SEQ ID NO 11622
atggacagccacggcaacgcctctggcggcaagcgcaagggcaagcgcggccgcaagccgaagccgccggtacccgcacccgcctcacccgacaacgaccacaaccacaaccaccacaatcaccacgccgcaccgtcctcctcgccgctctccacggccgccgtggcggcgtcagactcccccccggacccggagccggcgtcatcctccccggctccgcgccgccggggccgcaagtcccgccgcatccgcaacgggcccccggcctccgaggtcgacgccgcccacggcgcctcgccctcgcctccgccgcgggcgcggggcgggcccaaggcggccgcgcccaacggcgagatggtggaggttcaggtccccgcggcggcggtggagcccctgcgctgggaccaggtggtgaaggtggtaccgtcgatggacgccgtggtgaaggtgttctgcgtccacaccgagcccaacttctccctgccgtggcagcggaagcggcagtacagctccagcagcagcgggtttatcattgggggacgcagggtgctcaccaacgcccactcggttgagcattacacacaggtcaagctcaagaagcgtggctccgacaccaagtaccttgcgactgtccttgccataggcaccgagtgtgacattgcaatgttgactgtggaggatgatgaattctggaaaggtgtttcacctgtagagtttgggtcgctgccagcactccaggatgccgtcactgttgttggttacccaattggaggcgatactatctcagtgactagtggtgtagtttctaggatagaaatactgtcatatgttcatggttctacagagcttcttgggttacagatagatgcagctataaattcagggaactcagggggccctgctttcaatgataagggaaaatgtgttggtatagcttttcaatctctgaaacatgaagatgcagagaacataggctacgttatacccaccccagttattaaccacttcattgaagactaccacaaatctggagaatacacaggtttccctatacttggaatagaatggcaaaaaatggaaaatcctgatctccgcaaggcaatgggaatgaaagctaaccaaaagggtgttcggatacgaaggattgagccaactgctcctgaatctggatgcctccaaccttctgatatcgtccttagctttgatggtattgatattgccaatgatggtacagttccttttaggcatggtgagcgcattggattcagctaccttgtttctcaaaagtatactggtgagaaggcacgtgtgaaagtacttcgcaactcaaaaatccatgaatttaacataaagctggcaacccacaaaagactcattccagctcatatcaagggaaggccaccgtcatattacattgttgctggctttgtttttatggtcgtgtctgttccatatcttcgatctgagtatggaaaagactatgaatatgatgccccggtcaagttgttggacaagcatttgcatgcaatggcgcaatcatctgatgagcagcttgtggtggtgtcacaggtgcttgtggcagatataaacattggttatgaagatatagtcaaccttcaggttcttgccttcaatggcacaccggttaaaaacttgaagcacctagcgaccatggtggaagagtgcaatgaggcattcctgaagtttgatatggactacgatcagttggttgtcctggagacgaaaactgcaaaggctgcaactcaagatattctgacaacacattgtataccttcggctgtctcagaagacctgaagagctga

SEQ ID NO: 11622 - protein, 607 aa, Sorghum bicolor
  misc_feature: Ceres ANNOT ID no. 6024877
  misc_feature (150)..(337): Pfam Id: Trypsin Pfam Desc: Trypsin
  misc_feature (143)..(599): NCBI GI: 84999382 NCBI Desc: serine protease [theileria annulata strain ankara]
  misc_feature (143)..(488): NCBI GI: 2190549 NCBI Desc: f5i14.17 gene product [arabidopsis thaliana]
  misc_feature (143)..(488): NCBI GI: 91806029 NCBI Desc: degp protease [arabidopsis thaliana]
  misc_feature (147)..(381): NCBI GI: 33332321 NCBI Desc: degp-like serine protease 1 precursor [plasmodium falciparum]
  misc_feature (317)..(605): NCBI GI: 115462085 NCBI Desc: os05g0147500 [oryza sativa (japonica cultivar-group)]
MDSHGNASGGKRKGKRGRKPKPPVPAPASPDNDHNHNHHNHHAAPSSSPLSTAAVAASDSPPDPEPASSSPAPRRRGRKSRRIRNGPPASEVDAAHGASPSPPPRARGGPKAAAPNGEMVEVQVPAAAVEPLRWDQVVKVVPSMDAVVKVFCVHTEPNFSLPWQRKRQYSSSSSGFIIGGRRVLTNAHSVEHYTQVKLKKRGSDTKYLATVLAIGTECDIAMLTVEDDEFWKGVSPVEFGSLPALQDAVTVVGYPIGGDTISVTSGVVSRIEILSYVHGSTELLGLQIDAAINSGNSGGPAFNDKGKCVGIAFQSLKHEDAENIGYVIPTPVINHFIEDYHKSGEYTGFPILGIEWQKMENPDLRKAMGMKANQKGVRIRRIEPTAPESGCLQPSDIVLSFDGIDIANDGTVPFRHGERIGFSYLVSQKYTGEKARVKVLRNSKIHEFNIKLATHKRLIPAHIKGRPPSYYIVAGFVFMVVSVPYLRSEYGKDYEYDAPVKLLDKHLHAMAQSSDEQLVVVSQVLVADINIGYEDIVNLQVLAFNGTPVKNLKHLATMVEECNEAFLKFDMDYDQLVVLETKTAKAATQDILTTHCIPSAVSEDLKS

SEQ ID NO: 11623 - DNA, 285 bp, Sorghum bicolor
  misc_feature: Ceres ANNOT ID no. 6024880
  misc_feature: Encodes the peptide sequence at SEQ ID NO 11624
atgtataagctggggagaggaaaccgcgacaaggtgcagcagttcatgaccataaccggcgccagtgagaaggttgcccttcaggcactgaaagctagtgattggcacttggaaggagcttttgacttcttctatagccaacctcagatttctgcggtcaatactcggcatcttgaagatattttcaacagatataaagaacctgatggtgatatgatcatggtggaaggaatatctcaactttgcaatgatctgcaggtaatgagcatttattttcatctgtaa

SEQ ID NO: 11624 - protein, 94 aa, Sorghum bicolor
  misc_feature: Ceres ANNOT ID no. 6024880
  misc_feature (1)..(87): NCBI GI: 113967811 NCBI Desc: sm10 [nicotiana tabacum]
  misc_feature (1)..(87): NCBI GI: 73919225 NCBI Desc: dcn1-like protein 2 (defective in cullin neddylation protein 2-like protein 2) (dcun1-domain protein 2)
  misc_feature (1)..(87): NCBI GI: 111162655 NCBI Desc: dcn1, defective in cullin neddylation 1, domain containing 2 isoform c [mus musculus]
  misc_feature (1)..(87): NCBI GI: 111162657 NCBI Desc: dcn1, defective in cullin neddylation 1, domain containing 2 isoform d [mus musculus]
  misc_feature (1)..(87): NCBI GI: 111162661 NCBI Desc: dcn1, defective in cullin neddylation 1, domain containing 2 isoform b [mus musculus]
  misc_feature: Useful for making plants with altered lignin content
  misc_feature: Functional homolog of the protein sequence given in SEQ ID NO 13194
MYKLGRGNRDKVQQFMTITGASEKVALQALKASDWHLEGAFDFFYSQPQISAVNTRHLEDIFNRYKEPDGDMIMVEGISQLCNDLQVMSIYFHL

SEQ ID NO: 11625 - DNA, 1260 bp, Sorghum bicolor
  misc_feature: Ceres ANNOT ID no. 6024883
  misc_feature: Encodes the peptide sequence at SEQ ID NO 11626
atggctgaaccggccgcttcttcttcttcttcgtccggatccttcgccccgcgccgcctctatggcgccggcgtcgtcagggacgagctcccgtacagtggcctcgccgccgcacccccgccgcctcttccgccggtgcaggtgcaggttgcggcttccggcggcggcggcggaggaggcggaggaggaggaggaggaggaggaggaggagggaagattagtcccgcggtgctcttcatcatcgtgattctcgcggtggtgttcttcatctccggcctgctccacctcctggtgcgcgtcctcgtgaagaagcagcaccgccgcggcggccgagggggcacggcgtcggcgtctgcggcggcgcggggggctggaggaggggaggccggcggggcggacgtggcgttgcagcggcagctgcagcagctgttccacctccacgactccgggctggaccaggccttcatcgacgcgctgccggtcttcgcctaccgcgagatcgtcgtgggcggcggcggcgacggggacaaggagccgttcgactgcgcggtgtgcctgtgcgagttcgacgccgaagaccggctccggctgctgccgctgtgcgggcacgccttccacctcaactgcatcgacacgtggctgctctccaactccacctgcccgctctgccgcggggtgctcttcgtcccggggctcatgggcgaggacaccccgatgttcgatttcgaggaaaggctggaggaagggcggttgtccgaggattgcttcagggtggcacagacaccggtggctgagaagaaagtatttcctgtgaggttgaggaagttcaagaatgtcggaccccagggtgcggtggaaggtggcaatgccaatgccgatgccaatgcccgtgtgctgagtagggatcaaggggagagtagcagcagcagcttggatggaaggagatgcttctccatgggcacctatcagtatgttcttggcgcttctgagctccgggtagctctccagcctggccggattaggaatggcgctggtggtgcaatgaggggaagacctcctggtttaagttcgatcaatgctgatattatggaggggaagaagatctgtgcacgcaacaaaggggagagtttctccgtgtcgaaaatttggcaatggtctaatcttaagggcaagctacctgctggttcggatgaatgttcggatgccgggagccttccatggatgaagagaggaggtgctgcggatacatcaaacttatga

SEQ ID NO: 11626 - protein, 419 aa, Sorghum bicolor
  misc_feature: Ceres ANNOT ID no. 6024883
  misc_feature (182)..(223): Pfam Id: zf-C3HC4 Pfam Desc: Zinc finger, C3HC4 type (RING finger)
  misc_feature (70)..(409): NCBI GI: 68565290 NCBI Desc: ring-h2 finger protein atl5i
  misc_feature (135)..(242): NCBI GI: 18417587 NCBI Desc: zinc finger (c3hc4-type ring finger) family protein [arabidopsis thaliana]
  misc_feature (135)..(242): NCBI GI: 21655299 NCBI Desc: at4g30400/f17i23_260 [arabidopsis thaliana]
  misc_feature (60)..(414): NCBI GI: 49389042 NCBI Desc: ring finger 1 [oryza sativa (japonica cultivar-group)]
  misc_feature (93)..(337): NCBI GI: 9369405 NCBI Desc: t23e23.15 [arabidopsis thaliana]
  misc_feature: The sequence is a functional homolog of SEQ ID NO 1131 in the 10/666,642US patent application
  misc_feature: The sequence is a functional homolog of SEQ ID NO 1134 in the 10/666,642US patent application
  misc_feature: The sequence is a functional homolog of SEQ ID NO 1939 in the 11/479,226US patent application
  misc_feature: Useful for making plants with modulated growth and phenotype characteristics
  misc_feature: The sequence is a functional homolog of SEQ ID NO 1939 in the 20070022495 US patent application
  misc_feature: The sequence is a functional homolog of SEQ ID NO 1131 in the 20070033671 US patent application
  misc_feature: The sequence is a functional homolog of SEQ ID NO 1134 in the 20070033671 US patent application
  misc_feature: The sequence is a functional homolog of SEQ ID NO 1939 in the 11/479,226 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MAEPAASSSSSSGSFAPRRLYGAGVVRDELPYSGLAAAPPPPLPPVQVQVAASGGGGGGGGGGGGGGGGGGKISPAVLFIIVILAVVFFISGLLHLLVRVLVKKQHRRGGRGGTASASAAARGAGGGEAGGADVALQRQLQQLFHLHDSGLDQAFIDALPVFAYREIVVGGGGDGDKEPFDCAVCLCEFDAEDRLRLLPLCGHAFHLNCIDTWLLSNSTCPLCRGVLFVPGLMGEDTPMFDFEERLEEGRLSEDCFRVAQTPVAEKKVFPVRLRKFKNVGPQGAVEGGNANADANARVLSRDQGESSSSSLDGRRCFSMGTYQYVLGASELRVALQPGRIRNGAGGAMRGRPPGLSSINADIMEGKKICARNKGESFSVSKIWQWSNLKGKLPAGSDECSDAGSLPWMKRGGAADTSNL

SEQ ID NO: 11627 - DNA, 1185 bp, Sorghum bicolor
  misc_feature: Ceres ANNOT ID no. 6024957
  misc_feature: Encodes the peptide sequence at SEQ ID NO 11628
atggacgtcaccggagatgccagcggaggtcgccgccccaacttccctttgcagcttctggagaagaagaaggaggaacagccttgctccacgtccccagcagctgttgtgggtgctggggctaatgggtcggcggggtcgggagagatgctgcagatgaagaaggtggcgccgccaaagcgcacatcgaccaaggaccggcacacgaaggtggacgggcgcgggcggcgcatccggatgccggcgatttgcgcagctcgggtgttccagctgacgagggagttggggcacaagacggacggcgagacgatcgagtggctgctgcagcaggcggagcccgcggtgatcgcggccacgggcaccggcaccatcccggccaacttcacctcgctcaacatctctctccgctcctcgggctcttccttctccatcccagcgcacctccgtgctgccggcttgcccggcccacgcttcggcggcgcgcggggagacccgtgggagcgcgtcgtaggcctcgggttcggcggcgccgagggtcctccatccgctacgtcgtcggcgtcgtctccgctgctgctgagcttccactccggcagcgtcggtcttgacgtgtcaccatcgtcgtcgtctgctgccgccagctccgacctgtccaagaaacggcggtgggagcaagaaatgcagcagcagcagcagcaataccagcagcagatggccgggtacacgcagagccaaatgccaggcaccgtgtggatggtgccgagcagcaacgcccaggccgccgcagttgctggcggaggcggcagcaacgagtcgatctggacgttcccgcagacaggaagcggcggcggcggcgcggcgaccgtgtaccgcggcgtgcctagtgggctacatttcatgaacttccccgcgccgatggcgctgctccccggtgcgcagcagcagctcgggctcggcggccccgtgggcggcaacgaaaatggcagcgccagcggcggcggaggcggagccgagggccacatggggatcctcgccgcgctcaacgcgtaccgggcacatgctgtctcggacgctacgccggcggcgcagaacggtgcaggaggaggcggctctagtcagcatcagcagcatggccatggcggcggcgagcgacaggagagcatgagccccagcgacgactcgtag

SEQ ID NO: 11628 - protein, 394 aa, Sorghum bicolor
  misc_feature: Ceres ANNOT ID no. 6024957
  misc_feature (48)..(286): Pfam Id: TCP Pfam Desc: TCP family transcription factor
  misc_feature (1)..(392): NCBI GI: 115467212 NCBI Desc: os06g0226700 [oryza sativa (japonica cultivar-group)]
  misc_feature (55)..(200): NCBI GI: 92892428 NCBI Desc: tcp-domain protein [medicago truncatula]
  misc_feature (12)..(278): NCBI GI: 5731257 NCBI Desc: auxin-induced basic helix-loop-helix transcription factor [gossypium hirsutum]
  misc_feature (12)..(389): NCBI GI: 37719051 NCBI Desc: tcp-domain protein [antirrhinum majus subsp. majus]
  misc_feature (58)..(145): NCBI GI: 92885257 NCBI Desc: tcp transcription factor [medicago truncatula]
  misc_feature: The sequence is a functional homolog of SEQ ID NO 1391 in the 10/374,780US patent application
  misc_feature: The sequence is a functional homolog of SEQ ID NO 1392 in the 10/374,780US patent application
  misc_feature: The sequence is a functional homolog of SEQ ID NO 166 in the 10/225,068US patent application
  misc_feature: The sequence is a functional homolog of SEQ ID NO 220 in the 10/374,780US patent application
  misc_feature: The sequence is a functional homolog of SEQ ID NO 941 in the 11/479,226US patent application
  misc_feature: Useful for making plants with modulated growth and phenotype characteristics
  misc_feature: The sequence is a functional homolog of SEQ ID NO 166 in the 20050120408 US patent application
  misc_feature: The sequence is a functional homolog of SEQ ID NO 1391 in the 20060162006 US patent application
  misc_feature: The sequence is a functional homolog of SEQ ID NO 1392 in the 20060162006 US patent application
  misc_feature: The sequence is a functional homolog of SEQ ID NO 941 in the 20070022495 US patent application
MDVTGDASGGRRPNFPLQLLEKKKEEQPCSTSPAAVVGAGANGSAGSGEMLQMKKVAPPKRTSTKDRHTKVDGRGRRIRMPAICAARVFQLTRELGHKTDGETIEWLLQQAEPAVIAATGTGTIPANFTSLNISLRSSGSSFSIPAHLRAAGLPGPRFGGARGDPWERVVGLGFGGAEGPPSATSSASSPLLLSFHSGSVGLDVSPSSSSAAASSDLSKKRRWEQEMQQQQQQYQQQMAGYTQSQMPGTVWMVPSSNAQAAAVAGGGGSNESIWTFPQTGSGGGGAATVYRGVPSGLHFMNFPAPMALLPGAQQQLGLGGPVGGNENGSASGGGGGAEGHMGILAALNAYRAHAVSDATPAAQNGAGGGGSSQHQQHGHGGGERQESMSPSDDS

SEQ ID NO: 11629 - DNA, 1173 bp, Sorghum bicolor
  misc_feature: Ceres ANNOT ID no. 6024994
  misc_feature: Encodes the peptide sequence at SEQ ID NO 11630
atgtccatgctccttgtccagaaacaacacctccctctctccgtccgtccccgcacgaccgtcactctcctctccttgcgccaccaatgccgtctccccacgactcgattctccgccgccgccgccgaatcggctagccgcgctgcccccttcgccgtcgaggactacctcgtcgccacatgccacctcaccccggcgcaggcgctcaaggcctccaaggtgctctcgcacctcaagtccccctccagacccgacgccgtgctcgccttcctctcggacctcggtctctccgacgccgacatcgccgctgccgtctcctacgaccccaagcttctctgctccgaggtcgagcggactctggccccgcgtctcgtggagctccgggacctcggcctctctccgtcccagatcgcccgcctcgtcctcgtcgaccccgcgcgcttccgccgccccaccgtcgtctccaagctgcagtattacgtccccctcttcggttccttcgagaacctcatccatgctctcaggagcaacgcctacctcctcagctccgacctcgagcgcgtggtcaagcccaacgtcgcgttcctgatggagtgcgggctagatgcttgtgatattgccaagctgtccatacccgtccctaggctgatcaccaccaacccagaacgcgtccgggcaatggtcgagcgagctgaagctgtcggtgcgcctcgtggcaccgggatgtttaggcacgcactgctggctgtcgcgttcctcagcgaggaaaagatcaaagctaaggtggagttcttgaagacaacatttcagtggtcggatgctgaggtgggcgttgcggtttccaagctgccattggtgctcaagcactccaaggacaggttgcgccgcatgtcagagttcctgatcaccaaggttgggttggagccggagtacattgctcacaggcctgctctgcttacatatagcttggaacgccgcctcatgccccggcactatgttgaccggagctactatactgctgtccaggtgagcgagaatgtcttcatggagaagttcatactcccttacaaggaagctgcaccaagcctcgccctagattatgctgctgcttgcagaggagaggtgcctaccttcagatttcaagaacccagcaccggctcagcaagtgtttaa

SEQ ID NO: 11630 - protein, 390 aa, Sorghum bicolor
  misc_feature: Ceres ANNOT ID no. 6024994
  misc_feature (56)..(350): Pfam Id: mTERF Pfam Desc: mTERF
  misc_feature (2)..(389): NCBI GI: 115467190 NCBI Desc: os06g0225100 [oryza sativa (japonica cultivar-group)]
  misc_feature (18)..(375): NCBI GI: 51536066 NCBI Desc: mitochondrial transcription termination factor-like [oryza sativa (japonica cultivar-group)]
  misc_feature (6)..(375): NCBI GI: 115467186 NCBI Desc: os06g0224900 [oryza sativa (japonica cultivar-group)]
  misc_feature (3)..(351): NCBI GI: 115467184 NCBI Desc: os06g0224700 [oryza sativa (japonica cultivar-group)]
  misc_feature (32)..(373): NCBI GI: 51536063 NCBI Desc: mitochondrial transcription termination factor-like [oryza sativa (japonica cultivar-group)]
  misc_feature: Useful for making plants with altered alkaloid content
  misc_feature: Functional homolog of the protein sequence given in SEQ ID NO 13002
MSMLLVQKQHLPLSVRPRTTVTLLSLRHQCRLPTTRFSAAAAESASRAAPFAVEDYLVATCHLTPAQALKASKVLSHLKSPSRPDAVLAFLSDLGLSDADIAAAVSYDPKLLCSEVERTLAPRLVELRDLGLSPSQIARLVLVDPARFRRPTVVSKLQYYVPLFGSFENLIHALRSNAYLLSSDLERVVKPNVAFLMECGLDACDIAKLSIPVPRLITTNPERVRAMVERAEAVGAPRGTGMFRHALLAVAFLSEEKIKAKVEFLKTTFQWSDAEVGVAVSKLPLVLKHSKDRLRRMSEFLITKVGLEPEYIAHRPALLTYSLERRLMPRHYVDRSYYTAVQVSENVFMEKFILPYKEAAPSLALDYAAACRGEVPTFRFQEPSTGSASV

SEQ ID NO: 11631 - DNA, 867 bp, Sorghum bicolor
  misc_feature: Ceres ANNOT ID no. 6025085
  misc_feature: Encodes the peptide sequence at SEQ ID NO 11632
atgcagccgccgcccgccgagatgcaccccgccgtcgctgtcgaggcctccgcctccaccgcgcaggccgacaccaccgcaagcgccgccgccgccgccgtccccgcacccgatccctccccgcccccgccggcgccggcggctgagacggtcgatccgccgcccccgccgcccgcgccggcgcccaagacggtcacctggagcgagaagctcacgtccgactcgccgacgcacgtgcacgccgccgccgcggcggagtccagccagtacgtgtcccgcgggcccgcatcctcctcgtctaagggcgccgtggaggtgatgagggagacgctgtcgaggtgggggaagtcgtggggggagaccaccaagatggtcgagagcctcagccgcgacacgtggcaacacttcaagactggacccagttttaccgaagctgctatgggacgcctagcacaagggactaaagttttagcagaaggaggctatgaaaaaatatttaagcagaccttcgaagttcttccagatgagcagctgaaaatatgctatgcttgttatctctcaacatcggcaggtcctgtcatgggagtcttgtatatttctacagcgaaaattgctttctgcagtgataatcctctgtcatacaaagctggaaataaaactgaatggagctactacaaggtggtcattcctcttcaccagctaagagcagctaatccttcagtaagcaaagtaaattccgctgagaagtacattcaggtcgtttctgttgaaggccatgagttctggttcatgggttttctaatgtacgacaaggctgcagccagtcttcaagaagccttggctactgctcgtgagttgcaaccgtaa

SEQ ID NO: 11632 - protein, 288 aa, Sorghum bicolor
  misc_feature: Ceres ANNOT ID no. 6025085
  misc_feature (164)..(245): Pfam Id: GRAM Pfam Desc: GRAM domain
  misc_feature (51)..(230): NCBI GI: 42570873 NCBI Desc: gram domain-containing protein / aba-responsive protein-related [arabidopsis thaliana]
  misc_feature (122)..(276): NCBI GI: 38454154 NCBI Desc: at5g13200 [arabidopsis thaliana]
  misc_feature (87)..(280): NCBI GI: 140038631 NCBI Desc: gram [medicago truncatula]
  misc_feature (147)..(269): NCBI GI: 9581889 NCBI Desc: tel1s.3 [arabidopsis thaliana]
  misc_feature (2)..(260): NCBI GI: 4103635 NCBI Desc: aba-responsive protein [hordeum vulgare]
  misc_feature: The sequence is a functional homolog of SEQ ID NO. 430 in the 11/188,298 US application
MQPPPAEMHPAVAVEASASTAQADTTASAAAAAVPAPDPSPPPPAPAAETVDPPPPPPAPAPKTVTWSEKLTSDSPTHVHAAAAAESSQYVSRGPASSSSKGAVEVMRETLSRWGKSWGETTKMVESLSRDTWQHFKTGPSFTEAAMGRLAQGTKVLAEGGYEKIFKQTFEVLPDEQLKICYACYLSTSAGPVMGVLYISTAKIAFCSDNPLSYKAGNKTEWSYYKVVIPLHQLRAANPSVSKVNSAEKYIQVVSVEGHEFWFMGFLMYDKAAASLQEALATARELQP

SEQ ID NO: 11633 - DNA, 1047 bp, Sorghum bicolor
  misc_feature: Ceres ANNOT ID no. 6025160
  misc_feature: Encodes the peptide sequence at SEQ ID NO 11634
atggagatgccgggagggaacggggccccgtcgctggcgcggcagggctcggtctactcgctcacgttcgacgagttccagagcacgctcggcgcgggcgctaccaaggacttcggctccatgaacatggacgagctgctgcgcaacatctggacggccgaggagtccaacgccatggccacggccgctccgaccacggcgcccgccgcatccgtggacgcgcacgcacgcgcgcagcagcagcagcagaccggggcgcccatcctgcgccagggctccttcacgctgtcccgcacgctcagccagaagacggtcgacgaggtctggcgcgagatcgtgggcttcaccggcggggaggacgcgcagcctgtcgcggctcccgctcccactcccgcgcccgcgcccgcaccgctgccggcccaggcgcaggcgcaggcgcaggcccagcggcagcagacgctggggtccatgactctggaggagttcctggtacgcgccggcgtggttcgggaggacatggggcagcagaccctcgtgctgcagccgcacgcgcaggggcttttctcccagggcaatgcggtcgcgccgcagaccatgcagctggggaacgggatggtggccggcgtcgtcgggcaggggctcggaggagggatgacggtggcggcgccgacgacgccggtcgtgctcaacgggatggggaaggtggaggcgggggatctgtcgtcgctgtcgccggtgccgtatcccttcgacaccgcgctgagggtgaggaaggggccgaccgtcgagaaggtggtggagaggaggcagaggcgcatgatcaagaacagggagtcggccgccaggtcgcgtgcgaggaagcaggcatacataatggagctggaagctgaggtggcaaaactcaaggatcagaatgacgaattgcagaaaaagcaggttgaaatgctaaagaagcaaaaggatgaggtcctggagcgaatcaacaaccaacatggaccaaaggcaaagaaactttgccttcgccgcaccctgactggtccatggtag

SEQ ID NO: 11634 - protein, 348 aa, Sorghum bicolor
  misc_feature: Ceres ANNOT ID no. 6025160
  misc_feature (264)..(319): Pfam Id: bZIP_2 Pfam Desc: Basic region leucine zipper
  misc_feature (264)..(321): Pfam Id: bZIP_1 Pfam Desc: bZIP transcription factor
  misc_feature (33)..(348): NCBI GI: 111115692 NCBI Desc: aba responsive element binding factor 2 [hordeum vulgare subsp. vulgare]
  misc_feature (185)..(348): NCBI GI: 13775111 NCBI Desc: bzip transcription factor 6 [phaseolus vulgaris]
  misc_feature (201)..(348): NCBI GI: 42561991 NCBI Desc: areb-like protein [lycopersicon esculentum]
  misc_feature (202)..(348): NCBI GI: 110749701 NCBI Desc: bzip transcription factor [caragana korshinskii]
  misc_feature (186)..(348): NCBI GI: 6739278 NCBI Desc: abscisic acid responsive elements-binding factor [arabidopsis thaliana]
  misc_feature: The sequence is a functional homolog of SEQ ID NO 1761 in the 10/374,780US patent application
  misc_feature: The sequence is a functional homolog of SEQ ID NO 1762 in the 10/374,780US patent application
  misc_feature: Useful for making plants with modulated drought sensitivity
  misc_feature: Useful for making plants with modulated growth and phenotype characteristics
  misc_feature: Functional homolog of the protein sequence given in SEQ ID NO 13372
  misc_feature: The sequence is a functional homolog of SEQ ID NO 1761 in the 20060162006 US patent application
  misc_feature: The sequence is a functional homolog of SEQ ID NO 1762 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MEMPGGNGAPSLARQGSVYSLTFDEFQSTLGAGATKDFGSMNMDELLRNIWTAEESNAMATAAPTTAPAASVDAHARAQQQQQTGAPILRQGSFTLSRTLSQKTVDEVWREIVGFTGGEDAQPVAAPAPTPAPAPAPLPAQAQAQAQAQRQQTLGSMTLEEFLVRAGVVREDMGQQTLVLQPHAQGLFSQGNAVAPQTMQLGNGMVAGVVGQGLGGGMTVAAPTTPVVLNGMGKVEAGDLSSLSPVPYPFDTALRVRKGPTVEKVVERRQRRMIKNRESAARSRARKQAYIMELEAEVAKLKDQNDELQKKQVEMLKKQKDEVLERINNQHGPKAKKLCLRRTLTGPW

SEQ ID NO: 11635 - DNA, 1539 bp, Sorghum bicolor
  misc_feature: Ceres ANNOT ID no. 6025467
  misc_feature: Encodes the peptide sequence at SEQ ID NO 11636
atgggttggctgaccaagttttttagaggctcaacccacaatatctcggaagggcagtatcacagcaggcctgcagaagatacagcatggaatgaaccctctagctctcctgttgtcactgacatcttttcagagtttaacaatgaggatattgaccgtgctatagcactctctctatcggaagaggagcaaagaaaggcaaagaccatagataaggatatgcatttggaggaggatgagcaacttgcaagagctatccaggaaagtttgaatgttgaatcaccccctcgcagaaatggcagtgccaatggtggcactacatatcatctgcctcgcgaaactggcaatggtggcaatgcatatcagccatctcgcgaaaatggcagtgccaatggtggaaatgcatatcacccattaccatttatgttctcatccggattcagagcgtgcgctggatgtcacagagagattggtcacgggcgttttctcagttgcatgggagctgtttggcatccagaatgctttcgttgccatgcctgtagtcaaccgatatatgactatgagttctccatgtccgggaatcatccataccataaaacttgctacaaggagcagtttcacccaaaatgtgatgtctgcaagcaatttattcctacaaatatgaatggccttattgaatatagggcacatcctttctggctacaaaaatactgtccttcacatgaagttgatggcactccgagatgttgtagttgtgaaagaatggagccaagggaatcaagatatgtattactggatgatggtcgtaagctctgcctggagtgccttgattctgcagtgatggatacaaacgagtgtcagcctttgtatcttgaaattcaggaattttacgaaggactgaatatgaaagtggaacagcaggttcctctgcttctggtagagagacaagctttgaatgaagccatggaaggagagaaggctggtcaccaccatcttccagaaacaagaggactgtgcttatcagaagaacagactgttagcacgatactgaggagaccaagaatggctggaaacaaaattatgggaatgataacagagccatataggctgacacggcgatgtgaagtgactgcaattctcattctgtatggtctcccaagattgttgacaggttcaattttagctcatgagatgatgcatgcatggttgcgacttaaaggataccggacactgagtccagacgtagaagagggcatttgccaagttcttgctcacctgtggatcgagtcagagatcatggccggatcaggcagtggtgctgcttcgtcatcctcaggatcttcatcatccatgtcatccaaaaaggcggggcggtctcagtttgagcacaagcttggggattttttcaagcatcagatcgagacagatacttccatggcctacggagagggtttcagagccgggaaccgggccgttcttcagtacggcctgaagcgcaccctcgagcatatccggctgacagggacctttccattttga

SEQ ID NO: 11636 - protein, 512 aa, Sorghum bicolor
  misc_feature: Ceres ANNOT ID no. 6025467
  misc_feature (150)..(206): Pfam Id: LIM Pfam Desc: LIM domain
  misc_feature (35)..(512): NCBI GI: 55771369 NCBI Desc: lim domain containing protein-like [oryza sativa (japonica cultivar-group)]
  misc_feature (1)..(511): NCBI GI: 140063803 NCBI Desc: lim, zinc-binding; ubiquitin interacting motif; peptidase m, neutral zinc metallopeptidases, zinc-binding site [medicago truncatula]
  misc_feature (32)..(511): NCBI GI: 15221983 NCBI Desc: ubiquitin interaction motif-containing protein / lim domain-containing protein [arabidopsis thaliana]
  misc_feature (32)..(509): NCBI GI: 8954064 NCBI Desc: contains a weak similarity to an actin-binding lim protein, isoform a, from homo sapiens gi4504999 and contains multiple lim proteins pf00412 and ppr repeats pf01535. est
  misc_feature (32)..(509): NCBI GI: 8954064 (continued) gbn96780 comes from this gene. [arabidopsis thaliana]
  misc_feature (75)..(511): NCBI GI: 115454203 NCBI Desc: os03g0626600 [oryza sativa (japonica cultivar-group)]
MGWLTKFFRGSTHNISEGQYHSRPAEDTAWNEPSSSPVVTDIFSEFNNEDIDRAIALSLSEEEQRKAKTIDKDMHLEEDEQLARAIQESLNVESPPRRNGSANGGTTYHLPRETGNGGNAYQPSRENGSANGGNAYHPLPFMFSSGFRACAGCHREIGHGRFLSCMGAVWHPECFRCHACSQPIYDYEFSMSGNHPYHKTCYKEQFHPKCDVCKQFIPTNMNGLIEYRAHPFWLQKYCPSHEVDGTPRCCSCERMEPRESRYVLLDDGRKLCLECLDSAVMDTNECQPLYLEIQEFYEGLNMKVEQQVPLLLVERQALNEAMEGEKAGHHHLPETRGLCLSEEQTVSTILRRPRMAGNKIMGMITEPYRLTRRCEVTAILILYGLPRLLTGSILAHEMMHAWLRLKGYRTLSPDVEEGICQVLAHLWIESEIMAGSGSGAASSSSGSSSSMSSKKAGRSQFEHKLGDFFKHQIETDTSMAYGEGFRAGNRAVLQYGLKRTLEHIRLTGTFPF

SEQ ID NO: 11637 - DNA, 654 bp, Sorghum bicolor
  misc_feature: Ceres ANNOT ID no. 6025489
  misc_feature: Encodes the peptide sequence at SEQ ID NO 11638
atggtcatcatggctgggatgctccccggcgtggagtgcgcgcggcggcggcggctccggcagggtgcggaggcggccggaggaggcacgaggcggtcctccttctgcctgtacgcggccggccacggcggtgctggtggccttggcggcggcggcaattctggcaagcagcggagcggcgtgatggagatgatccacgggtggacgctggacagcaatgcccgggaggccaaggagcggctggaccagaagctgcggagcaagagggaggccgccatcaagaggcatcacagcacggggagcataaagctgagcagaccgcaccggagcggaagcggcggtaccgccgcctccgccggcgccgtcgcggacgaacgcggcgagtgctcggcgatgtccggcgtgcagcgggaggtgtactcgaagaaaggcgtgatgcggcgcctgatgcggtggagccggccgcggtgggccgcggcggagcaggcggagtgcgcggtgtgcctggacgagttccgcgccggcgacgtcctggcgcacctcccctgcggccaccgcttccactggtcctgcgctctgccctggctcgagggcacctcacgctgccccttctgccgcgccgccgtcgacgccgccgccgccagtaataattaa

SEQ ID NO: 11638 - protein, 217 aa, Sorghum bicolor
  misc_feature: Ceres ANNOT ID no. 6025489
  misc_feature (165)..(205): Pfam Id: zf-C3HC4 Pfam Desc: Zinc finger, C3HC4 type (RING finger)
  misc_feature (1)..(210): NCBI GI: 55773781 NCBI Desc: ring-h2 zinc finger protein-like [oryza sativa (japonica cultivar-group)]
  misc_feature (1)..(210): NCBI GI: 115466752 NCBI Desc: os06g0180800 [oryza sativa (japonica cultivar-group)]
  misc_feature (1)..(217): NCBI GI: 51091319 NCBI Desc: ring-h2 zinc finger protein-like [oryza sativa (japonica cultivar-group)]
  misc_feature (108)..(207): NCBI GI: 115445315 NCBI Desc: os02g0249300 [oryza sativa (japonica cultivar-group)]
  misc_feature (158)..(215): NCBI GI: 56201670 NCBI Desc: ring-h2 zinc finger protein-like [oryza sativa (japonica cultivar-group)]
  misc_feature: Useful for making plants with altered terpenoid content
  misc_feature: GREAT-hit functional homolog of the protein sequence given in SEQ ID NO 13241
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
MVIMAGMLPGVECARRRRLRQGAEAAGGGTRRSSFCLYAAGHGGAGGLGGGGNSGKQRSGVMEMIHGWTLDSNAREAKERLDQKLRSKREAAIKRHHSTGSIKLSRPHRSGSGGTAASAGAVADERGECSAMSGVQREVYSKKGVMRRLMRWSRPRWAAAEQAECAVCLDEFRAGDVLAHLPCGHRFHWSCALPWLEGTSRCPFCRAAVDAAAASNN

SEQ ID NO: 11639 - DNA, 459 bp, Sorghum bicolor
  misc_feature: Ceres ANNOT ID no. 6025538
  misc_feature: Encodes the peptide sequence at SEQ ID NO 11640
atggctcctaaagccgctcctgccaagaaggctgacgccaaggcccaggccttgaaggttgccaaggctgtgaagtctggggcaggcaagaagaagaccaagaagatccgcacttcggtgacatttcaccgccccaagaccctgaagaaggccagggacccgaagtacccaagaatcagcactaccggaagaaacaagcttgatcagtaccaaatcctcaagtacccactcaccacagaatcagcaatgaagaagattgaagataacaacactctggtgttcatcgtcgacctcaaggcagacaagaagaagatcaaggccgctgtcaagaagatgtatgacattcaggcaaagaaggtcaacaccctgatcaggcctgatgggaagaagaaggcttatgtgaagctgacccccgactacgatgctcttgatgtggccaacaaaattggcatcatctaa

SEQ ID NO: 11640 - protein, 152 aa, Sorghum bicolor
  misc_feature: Ceres ANNOT ID no. 6025538
  misc_feature (70)..(149): Pfam Id: Ribosomal_L23 Pfam Desc: Ribosomal protein L23
  misc_feature (11)..(64): Pfam Id: Ribosomal_L23eN Pfam Desc: Ribosomal protein L23, N-terminal domain
  misc_feature (1)..(152): NCBI GI: 70663909 NCBI Desc: osjnba0029h02.21 [oryza sativa (japonica cultivar-group)]
  misc_feature (1)..(152): NCBI GI: 90265143 NCBI Desc: h0711g06.17 [oryza sativa (indica cultivar-group)]
  misc_feature (1)..(152): NCBI GI: 110590379 NCBI Desc: chain 4, structure of signal recognition particle receptor (sr) in complex with signal recognition particle (srp) and ribosome nascent chain complex
  misc_feature (1)..(152): NCBI GI: 2641201 NCBI Desc: ribosomal protein l23a [fritillaria agrestis]
  misc_feature (1)..(152): NCBI GI: 585876 NCBI Desc: 60s ribosomal protein l23a (l25)
  misc_feature: Useful for making plants with modulated nitrogen use efficiency
  misc_feature: Functional homolog of the protein sequence given in SEQ ID NO 13047
  misc_feature: Useful for making plants with modulated nitrogen use efficiency
  misc_feature: Functional homolog of the protein sequence given in SEQ ID NO 13047
MAPKAAPAKKADAKAQALKVAKAVKSGAGKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 11641 - DNA, 366 bp, Sorghum bicolor
  misc_feature: Ceres ANNOT ID no. 6025616
  misc_feature: Encodes the peptide sequence at SEQ ID NO 11642
atgggcggcggcggcggcggcggtggcaggagggaggcgatagagcgggagctaaagaagcttcgggcggagcgggaggacctcgacggccggatacggctgctggaatcgcagctcgaggcgacgcctgcgggagtcagcggtgcggcggcggggataggagtagaggatggtgcgtgcggcgggagtgtcgcgtgccagagccgcgtgagtaacgggtttaagctggatggtggtctcccagcggatatggtctaccggtatagccgccacctccttctcccggacttcggggtcgaaggttgcttgggcattgtggatggtgatgatgttgaactgaataaccttcatcgacaggtgaaataa

SEQ ID NO: 11642 - protein, 121 aa, Sorghum bicolor
  misc_feature: Ceres ANNOT ID no. 6025616
  misc_feature (12)..(101): NCBI GI: 49388274 NCBI Desc: molybdopterin synthase sulphurylase-like [oryza sativa (japonica cultivar-group)]
  misc_feature (8)..(120): NCBI GI: 79330848 NCBI Desc: cnx5; mo-molybdopterin cofactor sulfurase [arabidopsis thaliana]
  misc_feature (8)..(101): NCBI GI: 9758110 NCBI Desc: molybdopterin synthase sulphurylase [arabidopsis thaliana]
  misc_feature (17)..(101): NCBI GI: 4337046 NCBI Desc: molybdopterin synthase sulphurylase [nicotiana plumbaginifolia]
  misc_feature (12)..(103): NCBI GI: 54645590 NCBI Desc: ga12041-pa [drosophila pseudoobscura]
MGGGGGGGGRREAIERELKKLRAEREDLDGRIRLLESQLEATPAGVSGAAAGIGVEDGACGGSVACQSRVSNGFKLDGGLPADMVYRYSRHLLLPDFGVEGCLGIVDGDDVELNNLHRQVK

SEQ ID NO: 11643 - DNA, 1092 bp, Sorghum bicolor
  misc_feature: Ceres ANNOT ID no. 6025680
  misc_feature: Encodes the peptide sequence at SEQ ID NO 11644
atggccgccagcgacgccgacgccgacgccggcgccggcgccggcgcggggctcaggtcggagttcctccaggtcctgctcagccgccgccgccatctccaagtgcctctctcggtggagcaagggagtccagtgaagaacccgctgtatcaaaagcctctgtcgcccaatgaggcaaatccgatgaagtcgtgccccagtaaagaggtggggaacttcaaggagaagctggttgaagaaaatttctacctagtcactgagctaggtgaacaaggacgagtacctgcacttctgctgaaacttaacgaccccattcctaaaagaaaaccagctattgtattcttgcacagctcttacaaatgcaaagaatggttgcgcccgctgcttgaggcatatgcctccaggggttacatttgtgttgctattgactctcgctatcatggtgaaagggccagcaatgaaaccacttatatagatgcactgaaatcggcttggtggaatggggatacgatgccttttatttttgacacggtgtgggacttgataaagcttggagaccaccttagtggaagggaggacatcgatcccagtaggattgggattaccggtgaatcgcttggaggaatgcacgcatggtttgctgcttttgtggacacacggtatagtgtcattgttcctataatcggtgttcagggattccggtgggcccttgataacaacaagtggcaggctagggtgaatagcataaaacctttatttgaagaagcaagaattgaattaggaaagagcgaaatagatacacaagttgttgaaatggtttgggaaaagatagcaccaggtctggactcgcaatttgatgccccctattcacttcctttgcttgcaccacggccgctgctccttctaaatggcgctgaagaccctcgctgcccaataagtggtttagaagaagctgcttcaaaagctgctaaggcttatgaagaatctggttgtgcggagaagttcatgttcattgcagagcctggaatcggccatcaaatgacaatagacatggtgaaggcagcaagccaatggttcgatcgcttcctctag

SEQ ID NO: 11644 - protein, 363 aa, Sorghum bicolor
  misc_feature: Ceres ANNOT ID no. 6025680
  misc_feature (10)..(363): NCBI GI: 115466590 NCBI Desc: os06g0163200 [oryza sativa (japonica cultivar-group)]
  misc_feature (83)..(214): NCBI GI: 56964333 NCBI Desc: hydrolase, alpha/beta superfamily [bacillus clausii ksm-k16]
  misc_feature (79)..(227): NCBI GI: 2293182 NCBI Desc: ytap [bacillus subtilis]
  misc_feature (279)..(363): NCBI GI: 77978115 NCBI Desc: cog1073: hydrolases of the alpha/beta superfamily [yersinia intermedia atcc 29909]
  misc_feature (258)..(363): NCBI GI: 77961294 NCBI Desc: cog1073: hydrolases of the alpha/beta superfamily [yersinia mollaretii atcc 43969]
MAASDADADAGAGAGAGLRSEFLQVLLSRRRHLQVPLSVEQGSPVKNPLYQKPLSPNEANPMKSCPSKEVGNFKEKLVEENFYLVTELGEQGRVPALLLKLNDPIPKRKPAIVFLHSSYKCKEWLRPLLEAYASRGYICVAIDSRYHGERASNETTYIDALKSAWWNGDTMPFIFDTVWDLIKLGDHLSGREDIDPSRIGITGESLGGMHAWFAAFVDTRYSVIVPIIGVQGFRWALDNNKWQARVNSIKPLFEEARIELGKSEIDTQVVEMVWEKIAPGLDSQFDAPYSLPLLAPRPLLLLNGAEDPRCPISGLEEAASKAAKAYEESGCAEKFMFIAEPGIGHQMTIDMVKAASQWFDRFL

SEQ ID NO: 11645 - DNA, 1155 bp, Sorghum bicolor
  misc_feature: Ceres ANNOT ID no. 6025815
  misc_feature: Encodes the peptide sequence at SEQ ID NO 11646
atgctgtacctccgaaaccacctcctccctctgctccgcgccgcgtccccgctgttctctcccatccaccaccactgccgcggcgcgtgcctcctctccgcctccgcggctgcccccttctccctcgaggactacctcgtcgccgcctgcggcctcagcccagcgcaagcccgcaaggcgtttgaacgggcatccagagatgccaggaaaccattcgtcgccgccgcctccaatcccgacgccgtcctcgccctgctctccagcgccggcctctcccgcgccgacatcgccgccgtcgtcgccgcggacccgctcatcctccgctcctgtgtaaacaagatcgggccccgcctcctcgctctccgcgaccgtgtcggcctgtccgctccgcagatctcacgcttcctcttggtcggctcccgggcgctccgttccggcgacgtcgttcccaacctcgacttcttgatctcctccttcggctcgctcgagccggtccttgccgtcatgaaggggaacacgagcatcctcgaaagggaccttgatagggtgatcaagcctaacgtggcgcagcttcgccagcgcggtctaagcgctcgagagattgcccagatgtgtttctactgcccgtggctgattgggttccaaccagagcgcgtcaaggatttcctgctgcgcgcagaagaccttggggtgtccagccgatcgcccatgttcaagcacatggtaccagcgatggcccgtaccaacaaagagaagaatgctgccacgctcgagtttctcaagacgagtcttggttgctctcagagtgaagctgcctttgctgtgtccaagatgccaggcattctaggaatatctaatgagtgccttctccccaagattcagttcttgatcaacgaggttggactggagccacaggacattctgcacaggccttccctgctcacatacagcctggagaagcggctagtgccccgatattgtgtcatgaagatcctgctggcaaagggactgacgaaaagcaattttatcacattagcccaagttggagagaagaaattcagatcgaagttcattgaccatcacaaggactctgtttctgggctagcacatgcttatgccacagctagtgctggccttgtgccctctggagtctaa

SEQ ID NO: 11646 - protein, 384 aa, Sorghum bicolor
  misc_feature: Ceres ANNOT ID no. 6025815
  misc_feature (44)..(355): Pfam Id: mTERF Pfam Desc: mTERF
  misc_feature (1)..(382): NCBI GI: 115467190 NCBI Desc: os06g0225100 [oryza sativa (japonica cultivar-group)]
  misc_feature (9)..(384): NCBI GI: 51536066 NCBI Desc: mitochondrial transcription termination factor-like [oryza sativa (japonica cultivar-group)]
  misc_feature (1)..(374): NCBI GI: 51536067 NCBI Desc: mitochondrial transcription termination factor-like [oryza sativa (japonica cultivar-group)]
  misc_feature (1)..(378): NCBI GI: 115467186 NCBI Desc: os06g0224900 [oryza sativa (japonica cultivar-group)]
  misc_feature (1)..(378): NCBI GI: 51536063 NCBI Desc: mitochondrial transcription termination factor-like [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13214
MLYLRNHLLPLLRAASPLFSPIHHHCRGACLLSASAAAPFSLEDYLVAACGLSPAQARKAFERASRDARKPFVAAASNPDAVLALLSSAGLSRADIAAVVAADPLILRSCVNKIGPRLLALRDRVGLSAPQISRFLLVGSRALRSGDVVPNLDFLISSFGSLEPVLAVMKGNTSILERDLDRVIKPNVAQLRQRGLSAREIAQMCFYCPWLIGFQPERVKDFLLRAEDLGVSSRSPMFKHMVPAMARTNKEKNAATLEFLKTSLGCSQSEAAFAVSKMPGILGISNECLLPKIQFLINEVGLEPQDILHRPSLLTYSLEKRLVPRYCVMKILLAKGLTKSNFITLAQVGEKKFRSKFIDHHKDSVSGLAHAYATASAGLVPSGV

SEQ ID NO: 11647 - DNA, 1041 bp, Sorghum bicolor
  misc_feature: Ceres ANNOT ID no. 6025929
  misc_feature: Encodes the peptide sequence at SEQ ID NO 11648
atgtccggttccaagagaagcctcccgtcttggatgggttcttctaaagatggagaggacgattcatgcaagaagaaacatgcaggcacctcccagaaggctcagaaagggcctgatttctccaaacttttggatggggtggtgtttgtgctgtcagggttcgtgaacccggagaggagcacgcttcgttcacaagcattggacatgggggctgagtatcgagccgattggacatcggactgcacccttcttgtttgtgcatttgtcaacacccccaagtttcgacaagttcaggcggataatggaaccattatctcaaaggactggatctttgagtcctacaagcaaaaaaagcttgtggacattgaacctttccttatgcatgctggaaagccatggcggaaaaataaggagcctgtcgaaactgatcaagatgagaaggagacacgcaaagtgcatcaaaagcaagttcaacggtctcgtgtcaagccatccacctctgatgccacggaggcaggaaatttagaatctgcaaacaagtgcttttctccctccaaaataaagcaatgggccgtcgatgatctggcacagactatgtcatggctggacagccaagaagagaagccagagccaagtgaactgaagacaatagcttctgaagggataatcacttgtctgcaagacgccatagaatccctcgagcaaggcaatgatatcaagggagttgcagagcagtggagcttcgtaccccatgttgtcaacgaactgctgaaactagatggaggcggaaaaggcgcagctctgcccaaagaacaactgtgtcaactagcagccaagtgcaagaagatctatcaggctgagtttgctcgcgtggacatggatggcaagaacaaggataagcatcaaaatgattcacatgtggcggagcatcgcaggaagaccaaatcagatgatgaccactacgatagcgatgagacgatagaaatgacagaggaagaaatcgatttcgcgtgcagacagctccctgggctatgcggatga

SEQ ID NO: 11648 - protein, 346 aa, Sorghum bicolor
  misc_feature: Ceres ANNOT ID no. 6025929
  misc_feature (39)..(114): Pfam Id: BRCT Pfam Desc: BRCA1 C Terminus (BRCT) domain
  misc_feature (4)..(346): NCBI GI: 55296355 NCBI Desc: dna repair protein xrcc1-like [oryza sativa (japonica cultivar-group)]
  misc_feature (3)..(344): NCBI GI: 119638455 NCBI Desc: dna repair protein [brachypodium sylvaticum]
  misc_feature (22)..(345): NCBI GI: 110737739 NCBI Desc: dna repair protein like xrcc1 [arabidopsis thaliana]
  misc_feature (2)..(220): NCBI GI: 51571935 NCBI Desc: zgc:91996 [danio rerio]
  misc_feature (31)..(169): NCBI GI: 27924221 NCBI Desc: xrcc1-prov protein [xenopus laevis]
MSGSKRSLPSWMGSSKDGEDDSCKKKHAGTSQKAQKGPDFSKLLDGVVFVLSGFVNPERSTLRSQALDMGAEYRADWTSDCTLLVCAFVNTPKFRQVQADNGTIISKDWIFESYKQKKLVDIEPFLMHAGKPWRKNKEPVETDQDEKETRKVHQKQVQRSRVKPSTSDATEAGNLESANKCFSPSKIKQWAVDDLAQTMSWLDSQEEKPEPSELKTIASEGIITCLQDAIESLEQGNDIKGVAEQWSFVPHVVNELLKLDGGGKGAALPKEQLCQLAAKCKKIYQAEFARVDMDGKNKDKHQNDSHVAEHRRKTKSDDDHYDSDETIEMTEEEIDFACRQLPGLCG

SEQ ID NO: 11649 - DNA, 921 bp, Sorghum bicolor
  misc_feature: Ceres ANNOT ID no. 6025988
  misc_feature: Encodes the peptide sequence at SEQ ID NO 11650
atggattccgacgcgatccctcttatcgatatcgccccacttgtcgagaggattgatgatccaaatatggccaatgacaaggatttactacaagttgtccaaatgttggatggtgcttgcaagaacgctgggttcttttatgtgaaaggccatgggatctgtgatttgttgatgagggaagttagggacgtggcaaagcaaatctttcagcttccttatgaggaaaaaatgaagattaagatgacgcctgatagtggatatagaggatatcaaagactaggtcagcatatcacctcaggaaaacgcgatatgcacgaagcaattaattacttggctccagttatacctggtaaatatggtgatcttggtaaaatacttgaaggatctaacgtgtgcctccttaaagatctttcgaggaagatcatgcggggtatagcattagcattgggagggccagttgatgcattcgaagggacagtagcaggagacccttattgtccaatgaggttgattagctatcctgtctcaaccgatgttccagaagagaaacgcactgaaactggaatattgaaaacaacagggcttctggcactagttaaccaggctgatgatatatgtgcccttgaggttcaaaaccactctggcaagtggatacatgccatgcctattcctggaacctttgtttgcaacattggtgacatgctcgaggtctactcgaatgggatttataagcccaagcttcatagagtcatcaacaattcccttggttgccgtgtatctgccgtgtttttttacgagacaaatttcgatgctgccatagagcctgcggagttctgcaaggagaaaactggtggcactgccaaatacgagaaggtcgtgtatggggaacgtttggttcggaaggctagatgcatgtgctga

SEQ ID NO: 11650 - protein, 306 aa, Sorghum bicolor
  misc_feature: Ceres ANNOT ID no. 6025988
  misc_feature (164)..(267): Pfam Id: 2OG-FeII_Oxy Pfam Desc: 2OG-Fe(II) oxygenase superfamily
  misc_feature (23)..(162): NCBI GI: 104294980 NCBI Desc: oxidoreductase, 2og-fe(ii) oxygenase family protein [musa acuminata]
  misc_feature (2)..(188): NCBI GI: 115478148 NCBI Desc: os09g0248900 [oryza sativa (japonica cultivar-group)]
  misc_feature (2)..(174): NCBI GI: 21554579 NCBI Desc: flavonol synthase-like protein [arabidopsis thaliana]
  misc_feature (2)..(174): NCBI GI: 6523032 NCBI Desc: flavonol synthase-like protein [arabidopsis thaliana]
  misc_feature (1)..(277): NCBI GI: 49087674 NCBI Desc: pa4191 [synthetic construct]
  misc_feature: The sequence is a functional homolog of SEQ ID NO. 513 in the 11/188,298 US application
  misc_feature: The sequence is a functional homolog of SEQ ID NO. 278 in the 11/188,298 US application
MDSDAIPLIDIAPLVERIDDPNMANDKDLLQVVQMLDGACKNAGFFYVKGHGICDLLMREVRDVAKQIFQLPYEEKMKIKMTPDSGYRGYQRLGQHITSGKRDMHEAINYLAPVIPGKYGDLGKILEGSNVCLLKDLSRKIMRGIALALGGPVDAFEGTVAGDPYCPMRLISYPVSTDVPEEKRTETGILKTTGLLALVNQADDICALEVQNHSGKWIHAMPIPGTFVCNIGDMLEVYSNGIYKPKLHRVINNSLGCRVSAVFFYETNFDAAIEPAEFCKEKTGGTAKYEKVVYGERLVRKARCMC

SEQ ID NO: 11651 - DNA, 912 bp, Sorghum bicolor
  misc_feature: Ceres ANNOT ID no. 6025995
  misc_feature: Encodes the peptide sequence at SEQ ID NO 11652
atggcgcgcggcggcggcggcagcctcgcccacctgctcgccacgctcctcctcttcctcctgctcgccacgccactcgccgtcggagcttccgaggcagaggtggacctcgcgccggcagagggcgtgtccgaggcggtggcgccagacgcggacgcgcagcagcagcacctcctgccgcggccgctcgtcatcgagctcccgtcggcgagggccgcggagcccgacgccgacgccgacgccgacgccgtgccgacggacgtccgctgcgccagctggtggctcgcggcggaggccaacaacctcgcgccatggaaggcggtgccgccggagtgcgtgccgcacgtgcgggactacgtcacgggcgccgcctaccgctccgacctcgagctcgtggcgcgggagtccgccgcctacgcgcgcgcggccttgccgctcggcgacgatggacgcgacgcctgggtgttcgacgtcgacgagacgctgctctccaacctcccctactacgccgaccacggatacggggccgagttgttcgaccaccacaggtttgacgagtgggtggagagaggcgaggcggccgccatcccctcgagcttgaagctgtacaatgaggttcgcgagctgggcttcaagaccttcctgctcacgggcagaagcgagggccaccgaggcgtcacggtggagaacctcaacaagcaggggttccatgattgggaaaagctcatactcagggcagcaggtgaccgcaagaaaacggcgacagtctacaaatcagaaaagaggaaagaaatggaagaagagggttacaggatcctaggcaactctggcgaccaatggagcgacctgctgggatcttccatgagtgctcgctctttcaagctccctaacccaatgtactatatcccgtga

SEQ ID NO: 11652 - protein, 303 aa, Sorghum bicolor
  misc_feature: Ceres ANNOT ID no. 6025995
  misc_feature (80)..(303): Pfam Id: Acid_phosphat_B Pfam Desc: HAD superfamily, subfamily IIIB (Acid phosphatase)
  misc_feature (59)..(303): NCBI GI: 119638446 NCBI Desc: acid phosphatase [brachypodium sylvaticum]
  misc_feature (47)..(302): NCBI GI: 28375516 NCBI Desc: acid phosphatase [lycopersicon esculentum]
  misc_feature (47)..(302): NCBI GI: 445113 NCBI Desc: acid phosphatase 1
  misc_feature (90)..(302): NCBI GI: 92877929 NCBI Desc: plant acid phosphatase [medicago truncatula]
  misc_feature (90)..(302): NCBI GI: 21536678 NCBI Desc: acid phosphatase-like protein [arabidopsis thaliana]
  misc_feature (47)..(302): SWISSPROT Homolog: EC 3.1.3.2 Acid phosphatase 1 precursor
MARGGGGSLAHLLATLLLFLLLATPLAVGASEAEVDLAPAEGVSEAVAPDADAQQQHLLPRPLVIELPSARAAEPDADADADAVPTDVRCASWWLAAEANNLAPWKAVPPECVPHVRDYVTGAAYRSDLELVARESAAYARAALPLGDDGRDAWVFDVDETLLSNLPYYADHGYGAELFDHHRFDEWVERGEAAAIPSSLKLYNEVRELGFKTFLLTGRSEGHRGVTVENLNKQGFHDWEKLILRAAGDRKKTATVYKSEKRKEMEEEGYRILGNSGDQWSDLLGSSMSARSFKLPNPMYYIP

SEQ ID NO: 11653 - DNA, 705 bp, Sorghum bicolor
  misc_feature: Ceres ANNOT ID no. 6026172
  misc_feature: Encodes the peptide sequence at SEQ ID NO 11654
atgacttctctggacaccgtgagaggagatcttgccctggttattttgtacctaaacaaggctgaggcaagagataaaatctgcagagcgatacagtatggatcaaagttcctgagcaatggagaaccagggcctgcacagaatgtcgacaagtcaactagtctggctcggaaagttttccggctttttaagtttgtcaatgatctccatgctttaattagtcctcctgccaaaggaactccacttccactgatcttactcgggaagtcgaagaatgcgatgctgtcaactttcctcttcctggaccaaattgtgtgggctgggaggacaggaatatacaagaacaaggagcgagcggagttccttggaaggatagcattttattgcttcctcggttcaaacacctgcacaaccattatcgagctagctgagctccaacggttatctgcttcaatgaagaagctagagaaggagctgaaacaccaagagttgtacaagaatgagcagtaccggatgaagctgcagaagtcgaacgagcggctgctggccctcatcaagtcgagcctcgacatcgtggttgccgtggggctgctgcagctggcgcccaagaaggtgacccctcgtgtcacgggcgcgtttggtttcgccagctcgctgatcgcttgctaccagttgcttccaagcccaccagcgaagagcaagtag

SEQ ID NO: 11654 - protein, 234 aa, Sorghum bicolor
  misc_feature: Ceres ANNOT ID no. 6026172
  misc_feature (11)..(226): Pfam Id: PEX11 Pfam Desc: Peroxisomal biogenesis factor 11 (PEX11)
  misc_feature (1)..(234): NCBI GI: 55296207 NCBI Desc: peroxisomal biogenesis factor 11 protein-like [oryza sativa (japonica cultivar-group)]
  misc_feature (1)..(234): NCBI GI: 115466122 NCBI Desc: os06g0127000 [oryza sativa (japonica cultivar-group)]
  misc_feature (1)..(234): NCBI GI: 92886312 NCBI Desc: peroxisomal biogenesis factor 11 [medicago truncatula]
  misc_feature (1)..(234): NCBI GI: 56368449 NCBI Desc: peroxisomal membrane protein pex11-2 [arabidopsis thaliana]
  misc_feature (131)..(230): NCBI GI: 16323256 NCBI Desc: at2g45740/f4i18.28 [arabidopsis thaliana]
MTSLDTVRGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFLGRIAFYCFLGSNTCTTIIELAELQRLSASMKKLEKELKHQELYKNEQYRMKLQKSNERLLALIKSSLDIVVAVGLLQLAPKKVTPRVTGAFGFASSLIACYQLLPSPPAKSK

SEQ ID NO: 11655 - DNA, 597 bp, Sorghum bicolor
  misc_feature: Ceres ANNOT ID no. 6026224
  misc_feature: Encodes the peptide sequence at SEQ ID NO 11656
atggccggctccgaccccctcccgcatccagggctagcgatcgtggtgatgggagtcagcggctgcggcaaatccaccgtcgcggcaatgctcgccgaagccttgggctgcagcttcatcgaagcagacgactaccattcccaggcaaacaaagccaagatgagcgagggcatcccgctctccgacgcggaccgcgcgccgtggctggagtcgctgcaggacgccatccgggagcggctggacggcggcgaggacgtggccgtgagctgctcggcgctgcagctcaggtaccgggacgtgctccgggccgccgaccgcggctacagctacaggccgggggagtacgccgcctgcagggtgaagttcgtgtgcctgcgggcgtcggcggaggtgatcgcggagcggatgctgcggaggtcggcggaagggaagcacttcatgccggcgagcctgctgcggagccagctcgacctgctgcaggtcgacgccgcggagggggtcacggagttcgatgccacgacggtgcgccccggcgacatcgtccgtgacaccgttgctctgttcagggaggacctggcgtcgacagtccatgcttga

SEQ ID NO: 11656 - protein, 198 aa, Sorghum bicolor
  misc_feature: Ceres ANNOT ID no. 6026224
  misc_feature (20)..(176): Pfam Id: SKI Pfam Desc: Shikimate kinase
  misc_feature (15)..(187): NCBI GI: 91789379 NCBI Desc: carbohydrate kinase, thermoresistant glucokinase [polaromonas sp. js666]
  misc_feature (12)..(160): NCBI GI: 121529129 NCBI Desc: gluconokinase [ralstonia pickettii 12j]
  misc_feature (10)..(164): NCBI GI: 55958667 NCBI Desc: otthump00000021547 [homo sapiens]
  misc_feature (10)..(164): NCBI GI: 33304183 NCBI Desc: similar to 5133401n09rik protein [synthetic construct]
  misc_feature (12)..(163): NCBI GI: 83746598 NCBI Desc: gluconokinase [ralstonia solanacearum uw551]
MAGSDPLPHPGLAIVVMGVSGCGKSTVAAMLAEALGCSFIEADDYHSQANKAKMSEGIPLSDADRAPWLESLQDAIRERLDGGEDVAVSCSALQLRYRDVLRAADRGYSYRPGEYAACRVKFVCLRASAEVIAERMLRRSAEGKHFMPASLLRSQLDLLQVDAAEGVTEFDATTVRPGDIVRDTVALFREDLASTVHA

SEQ ID NO: 11657 - DNA, 597 bp, Sorghum bicolor; identical to SEQ ID NO: 11655
  misc_feature: Ceres ANNOT ID no. 6026230
  misc_feature: Encodes the peptide sequence at SEQ ID NO 11658

SEQ ID NO: 11658 - protein, 198 aa, Sorghum bicolor; identical to SEQ ID NO: 11656
  misc_feature: Ceres ANNOT ID no. 6026230
  misc_feature (20)..(176): Pfam Id: SKI Pfam Desc: Shikimate kinase
  misc_feature (15)..(187): NCBI GI: 91789379 NCBI Desc: carbohydrate kinase, thermoresistant glucokinase [polaromonas sp. js666]
  misc_feature (12)..(160): NCBI GI: 121529129 NCBI Desc: gluconokinase [ralstonia pickettii 12j]
  misc_feature (10)..(164): NCBI GI: 55958667 NCBI Desc: otthump00000021547 [homo sapiens]
  misc_feature (10)..(164): NCBI GI: 33304183 NCBI Desc: similar to 5133401n09rik protein [synthetic construct]
  misc_feature (12)..(163): NCBI GI: 83746598 NCBI Desc: gluconokinase [ralstonia solanacearum uw551]

SEQ ID NO: 11659 - DNA, 1740 bp, Sorghum bicolor
  misc_feature: Ceres ANNOT ID no. 6026243
  misc_feature: Encodes the peptide sequence at SEQ ID NO 11660
atggcttcgacattcggtgccacttctacagttggccttatggctgctccagcagggaagaatgtgcgccttcagaggagggctaacttcagagtaaaagcagccaaggagctgtacttcaacaaggatggctcagctatcaagaagctccagactggagtcaataagcttgcagacctagttggagttacacttggaccaaagggaaggaatgtcgttttggagagcaagtatggctctcctaagattgttaacgatggtgttacagttgcaagagaggttgagctggaggaccctgtggaaaacattggagctaaattggtcaggcaagctgcagctaagaccaatgatctagctggagatgggacaaccacctccgtggtccttgctcagggactgattgctgagggtgttaaggttgtggcagctggtgctaatcctgttcagattactcgtggtattgagaaaacagcgaaagcactagttgaagaactacgtaagttgtccaaggatgttgaagatagcgagcttgcagatgttgctgcagttagtgctggcaacaactatgaaatcggtaacatgatagcagaggccatgagcaaggttggtcggaagggtgtggttacccttgaagagggaaggagttctgagaactttctctatgttgtggagggaatgcagtttgaccgtggttatatctctccctactttgtaacagacagtgagaaaatgtctgccgagtacgagaactgcaagcttcttttggttgacaagaagatcaccaatgcaagggatcttatcaacgttttggaagaagccatcagaggtgcatacccaatcctgataattgctgaggatattgagcaggaggctcttgctactcttgttgtcaacaagcttagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagctgcaaaggttgttcttaccaaagagtcaacaacaattgttggtgacggcagcacccaggaagaagttactaaaagggttgcgcagattaaaaatctgattgaggcagcagaacaagaatatgaaaaggaaaagctcaatgagaggatagctaagcttgctggtggtgttgctgtcattcaggtgggagcacaaacagaaactgaactaaaagagaagaagttgagagttgaggatgccctaaatgcaactaaggctgctgttgaggaaggtattgttgttggtggagggtgcactcttttgcggcttgcagctaaagtcgatgccatcaaagatacactggagaatgatgagcagaaggttggagctgaaatagtaagaagggccctgagctacccacttaaattgattgctaaaaacgctggtgtcaatggcagcgttgtcactgagaaggtcctttctaacgataacttcaagtatggttacaatgctgctactggacagcacgaggacttgatggctgctggtatcattgaccccaccaaggtggtgagatgctgcttggagcatgccgcatcggtggccaagaccttcctgacatcagatgttgtggtcgtcgatatcaaggagccggaggccgcgcccctcgctaacccgatggacaactctggctatggatactga

SEQ ID NO: 11660 - protein, 579 aa, Sorghum bicolor
  misc_feature: Ceres ANNOT ID no. 6026243
  misc_feature (57)..(561): Pfam Id: Cpn60_TCP1 Pfam Desc: TCP-1/cpn60 chaperonin family
  misc_feature (23)..(579): NCBI GI: 4204266 NCBI Desc: rubisco subunit binding-protein beta subunit [arabidopsis thaliana]
  misc_feature (20)..(579): NCBI GI: 1762130 NCBI Desc: chaperonin-60 beta subunit
  misc_feature (1)..(578): NCBI GI: 806808 NCBI Desc: chaperonin precursor [pisum sativum]
  misc_feature (23)..(579): NCBI GI: 81601 NCBI Desc: chaperonin 60 beta precursor - arabidopsis thaliana
  misc_feature (8)..(579): NCBI GI: 79330970 NCBI Desc: atp binding / protein binding [arabidopsis thaliana]
  misc_feature: Useful for making plants with modulated nitrogen use efficiency
  misc_feature: Functional homolog of the protein sequence given in SEQ ID NO 13023
MASTFGATSTVGLMAAPAGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKDVEDSELADVAAVSAGNNYEIGNMIAEAMSKVGRKGVVTLEEGRSSENFLYVVEGMQFDRGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQHEDLMAAGIIDPTKVVRCCLEHAASVAKTFLTSDVVVVDIKEPEAAPLANPMDNSGYGY

SEQ ID NO: 11661 - DNA, 489 bp, Sorghum bicolor
  misc_feature: Ceres ANNOT ID no. 6026316
  misc_feature: Encodes the peptide sequence at SEQ ID NO 11662
atgctgatgggattccccatgggctactcggagatgcccaagctggtgctgcacctgctcttcctcctgggccacctgcgccgcctctcctcctggctgctccgcctagcgggcgcctccgccgacgccgacagctgggcgtcggcatccgacgcggaccaccacccgcgccaccccgccgccgcccagcgcctggaggagcactctccggcggtgcgcttcgactcgctgtcgtctggcggttcctcctccgcaactgccggcgaggtgccgcggccgctccccgaggggtgctgcgtctgcctgggcgacttccacgccgccgccgaggtgcgccgcgcccggggctgccgccacgtcttccaccgcgcctgcctcgaccgctgggccgcgcacggccaccgcacctgcccgctctgccggacccagctcctcccgccgccgctgctgctccccctgcccctgcccctcccgctgccgccatcgtag

SEQ ID NO: 11662 - protein, 162 aa, Sorghum bicolor
  misc_feature: Ceres ANNOT ID no. 6026316
  misc_feature (98)..(140): Pfam Id: zf-C3HC4 Pfam Desc: Zinc finger, C3HC4 type (RING finger)
  misc_feature (3)..(146): NCBI GI: 87162911 NCBI Desc: zinc finger, ring-type; ringv [medicago truncatula]
  misc_feature (3)..(146): NCBI GI: 32488512 NCBI Desc: osjnba0011j08.19 [oryza sativa (japonica cultivar-group)]
  misc_feature (3)..(149): NCBI GI: 21554155 NCBI Desc: ring zinc finger protein-like [arabidopsis thaliana]
  misc_feature (17)..(151): NCBI GI: 72536737 NCBI Desc: at1g63840-like protein [arabidopsis lyrata]
  misc_feature (18)..(151): NCBI GI: 72536735 NCBI Desc: at1g63840 [arabidopsis thaliana]
  misc_feature: The sequence is a functional homolog of SEQ ID NO 270 in the 10/666,642US patent application
  misc_feature: The sequence is a functional homolog of SEQ ID NO 874 in the 11/435,388US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13260
  misc_feature: The sequence is a functional homolog of SEQ ID NO 874 in the 20060272060 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 424 in the 11/188,298 US application
MLMGFPMGYSEMPKLVLHLLFLLGHLRRLSSWLLRLAGASADADSWASASDADHHPRHPAAAQRLEEHSPAVRFDSLSSGGSSSATAGEVPRPLPEGCCVCLGDFHAAAEVRRARGCRHVFHRACLDRWAAHGHRTCPLCRTQLLPPPLLLPLPLPLPLPPS

SEQ ID NO: 11663 - DNA, 1020 bp, Sorghum bicolor
  misc_feature: Ceres ANNOT ID no. 6026368
  misc_feature: Encodes the peptide sequence at SEQ ID NO 11664
atgggtatgagcagcgcacaagcgcagacgcagcagctggttcctccaggttttcgattccatccgacagacgaagagctggtggactactacctcaggaagaaggtggcctcaagaaggatcgacctcaatgtcatcaaagatgtcgatctttacaagatagagccatgggatctccaagagaagtgcagattgggaggacctggtgaggaggagcagaacgagtggtacttcttcagccacaaagacaagaaatacccgacgggcacccggaccaaccgtgccaccgccgctgggttttggaaggccaccggcagagacaagccgatctatgctaacaagcagcggcagctggtgggcatgaggaagacgctggtgtactacaagggcagggctcccaatggccacaagtccgattggatcatgcacgagtaccgccttgaaaccaatgagaatggccctccccaggaggaaggatgggtagtatgtagggtgttcaaaaagcgactaccaacaacaagaagagaatctgaccatgatgcaccatgctggtatgtcgatgatgatggaaccttcatgcatgaccttaactctcccatgagtggattgccaccacaccacagcatcgcacagctgcaagaacaacacctccaaatgctgaacaatagctacaagagggaactgaagctacaattccagatgccaagccatcatattctaaatgccattcctcacgagctagagagcccatccttccattctcttttggtctccccagaccatcaaaccaaagtgcaacatgcccaccaacatgttcagctcatggagcatgcagtcgaccaagtcactgattggagagttctggacaagtttgttgcgtctcaacttagtaacgatgcagcaaagggtgtagattatactgatgaaggagatatccttcaggtcaatgagaagcaagaggtggctaccgattatgcatcaacgtcaacatccagcagccaagttgatccatggaagtga

SEQ ID NO: 11664 - protein, 339 aa, Sorghum bicolor
  misc_feature: Ceres ANNOT ID no. 6026368
  misc_feature (14)..(148): Pfam Id: NAM Pfam Desc: No apical meristem (NAM) protein
  misc_feature (14)..(299): NCBI GI: 144924749 NCBI Desc: no apical meristem (nam) protein [medicago truncatula]
  misc_feature (14)..(259): NCBI GI: 15221554 NCBI Desc: no apical meristem (nam) family protein [arabidopsis thaliana]
  misc_feature (69)..(259): NCBI GI: 6630463 NCBI Desc: f23n19.6 [arabidopsis thaliana]
  misc_feature (14)..(339): NCBI GI: 116310094 NCBI Desc: h0502g05.5 [oryza sativa (indica cultivar-group)]
  misc_feature (9)..(331): NCBI GI: 73759951 NCBI Desc: nac-domain protein ze567 [zinnia elegans]
  misc_feature: The sequence is a functional homolog of SEQ ID NO 1270 in the 10/374,780US patent application
  misc_feature: The sequence is a functional homolog of SEQ ID NO 1378 in the 10/666,642US patent application
  misc_feature: The sequence is a functional homolog of SEQ ID NO 142 in the 10/412,699US patent application
  misc_feature: The sequence is a functional homolog of SEQ ID NO 1423 in the 10/412,699US patent application
  misc_feature: The sequence is a functional homolog of SEQ ID NO 1750 in the 10/412,699US patent application
  misc_feature: The sequence is a functional homolog of SEQ ID NO 2416 in the 10/374,780US patent application
  misc_feature: The sequence is a functional homolog of SEQ ID NO 2590 in the 10/374,780US patent application
  misc_feature: The sequence is a functional homolog of SEQ ID NO 286 in the 10/225,066US patent application
  misc_feature: The sequence is a functional homolog of SEQ ID NO 286 in the 11/435,388US patent application
  misc_feature: The sequence is a functional homolog of SEQ ID NO 288 in the 10/714,887US patent application
  misc_feature: The sequence is a functional homolog of SEQ ID NO 333 in the 11/479,226US patent application
  misc_feature: The sequence is a functional homolog of SEQ ID NO 38 in the 10/374,780US patent application
  misc_feature: The sequence is a functional homolog of SEQ ID NO 54 in the 10/225,068US patent application
  misc_feature: The sequence is a functional homolog of SEQ ID NO 586 in the 10/225,066US patent application
  misc_feature: The sequence is a functional homolog of SEQ ID NO 853 in the 10/374,780US patent application
  misc_feature: The sequence is a functional homolog of SEQ ID NO 898 in the 10/666,642US patent application
  misc_feature: The sequence is a functional homolog of SEQ ID NO 914 in the 10/225,066US patent application
  misc_feature: Useful for making plants with modulated growth and phenotype characteristics
  misc_feature: The sequence is a functional homolog of SEQ ID NO 142 in the 20040045049 US patent application
  misc_feature: The sequence is a functional homolog of SEQ ID NO 1423 in the 20040045049 US patent application
  misc_feature: The sequence is a functional homolog of SEQ ID NO 286 in the 20050160493 US patent application
  misc_feature: The sequence is a functional homolog of SEQ ID NO 914 in the 20050160493 US patent application
  misc_feature: The sequence is a functional homolog of SEQ ID NO 853 in the 20060162006 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for biocontainment applications
  misc_feature: Functional homolog of the protein sequence given in SEQ ID NO 13684
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: Useful for making plants with altered carbohydrate content
  misc_feature: Functional homolog of the protein sequence given in SEQ ID NO 13685
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MGMSSAQAQTQQLVPPGFRFHPTDEELVDYYLRKKVASRRIDLNVIKDVDLYKIEPWDLQEKCRLGGPGEEEQNEWYFFSHKDKKYPTGTRTNRATAAGFWKATGRDKPIYANKQRQLVGMRKTLVYYKGRAPNGHKSDWIMHEYRLETNENGPPQEEGWVVCRVFKKRLPTTRRESDHDAPCWYVDDDGTFMHDLNSPMSGLPPHHSIAQLQEQHLQMLNNSYKRELKLQFQMPSHHILNAIPHELESPSFHSLLVSPDHQTKVQHAHQHVQLMEHAVDQVTDWRVLDKFVASQLSNDAAKGVDYTDEGDILQVNEKQEVATDYASTSTSSSQVDPWK

SEQ ID NO: 11665 - DNA, 1863 bp, Sorghum bicolor
  misc_feature: Ceres ANNOT ID no. 6026373
  misc_feature: Encodes the peptide sequence at SEQ ID NO 11666
atggcaaaagaacaggatggatcccccaaggtgcgccacccagaattccaaaggatgcgagtaactctcaccataggcgtcattggcctctgtgtcacagcatacattcttggtgcttggcaaggcacctcaaacggcattaactcttccttaataagtaccagaacccagtgcaaagataatgtgcggtcatctggtgctcgcctggatttccaagcccaccaccaggtgggcttcaatgaatccgtgcttgcggtggagaaattcccaccttgccagctcaagtacagtgagtataccccttgccaagatccaaggagggctaggaagttcccaaagaaaatgatgcagtacagggagcgccactgcccaaagaaagaggacatgctccgatgcttgatccctgcacctccaaattataacaaccccttccagtggccaagaagtcgagactatgcttggttcaataacatccctcatcgggagctcagtattgagaaggctgttcagaactggatccatgttgagggagacctgcttagattccctggaggtggcaccatgttcccacatggtgccgatgcttatattgatggcataaatgcccttgtgccattgaatgaaggcaacatccgaactgcacttgatactggatgtggggttgcaagctggggtgcttatcttatgaagagaaacatcaccaccatgtcttttgcaccaagggattctcatgaggcacaggtacagtttgcattggaacggggggtaccagccatgattggagtgatgggaactgaaagactcccatatcccgctagagcatttgacatggcgcactgctctagatgtttgatcccatggaataaacttgacggcatctatctaattgaagtagacagagttcttagaccaggggggtactggatcctttctgggcctccaatccactggaagaggcactacaaggggtgggagaggacagaagaagacctgaagcaagaacaagatgagattgaggacttagcgaaacggctctgctggaagaaagtcatagagaaaggtgatcttgctatatggcagaaacctatcaatcatgtagaatgtgttgacagtaggaaggtctatgatgctccgcagatttgtaagagcaatgatgtggattctgcttggtacaagaagatggacagttgcatatctcctctcccagatgtgaagagtgaagatgaagttgctggtggagcccttgagagatggccaaaaagggcatttgttgttcccccaagaataatccgcggttcagttccaggcttcacccctgagaagttccaagaggataacaaggtgtggtcagagagagtgaatcactacaagaaattgattccaccactgggaaaaagacgatacaggaacgtgatggacatgaatgcagggatagggggttttgcagctgcattgatggagtaccctctttgggtgatgaatgttgtgccttcaggcttggcccatgacaccctcggtgttatttatgaacgagggtttattggcacctaccaggactggtgtgaggctttctcaacatacccgaggacctacgatctcatccacgcagataaaattttcagcagttaccaggataggtgtgacataacgtacatcctcctggagatggaccggattctaaggcctgaagggactgtgatcatcagggacaacgtggaggtgttggtgaaggtacaagctatcactggaggcatgaggtggaagagccaaatcatggatcacgagtccggtccgttcaaccctgacaagatcctagtggctgtcaagacttactggaccgggaagcccatggaaaagcaataa

SEQ ID NO: 11666 - protein, 620 aa, Sorghum bicolor
  misc_feature: Ceres ANNOT ID no. 6026373
  misc_feature (215)..(310): Pfam Id: Methyltransf_11 Pfam Desc: Methyltransferase domain
  misc_feature (1)..(620): NCBI GI: 55296764 NCBI Desc: dehydration-responsive protein-like [oryza sativa (japonica cultivar-group)]
  misc_feature (1)..(620): NCBI GI: 115465894 NCBI Desc: os06g0103900 [oryza sativa (japonica cultivar-group)]
  misc_feature (1)..(618): NCBI GI: 120564759 NCBI Desc: dehydration-induced protein [triticum aestivum]
  misc_feature (64)..(618): NCBI GI: 38567915 NCBI Desc: osjnba0088i22.11 [oryza sativa (japonica cultivar-group)]
  misc_feature (53)..(619): NCBI GI: 50253255 NCBI Desc: dehydration-responsive family protein-like [oryza sativa (japonica cultivar-group)]
  misc_feature: The sequence is a functional homolog of SEQ ID NO 2740 in the 10/374,780US patent application
  misc_feature: The sequence is a functional homolog of SEQ ID NO 388 in the 10/225,066US patent application
  misc_feature: The sequence is a functional homolog of SEQ ID NO 758 in the 10/412,699US patent application
  misc_feature: Useful for making plants with modulated growth and phenotype characteristics
  misc_feature: The sequence is a functional homolog of SEQ ID NO 758 in the 20040045049 US patent application
  misc_feature: The sequence is a functional homolog of SEQ ID NO 388 in the 20050160493 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: Useful for making plants with altered cell wall content and/or composition
  misc_feature: Functional homolog of the protein sequence given in SEQ ID NO 13686
  misc_feature: The sequence is a functional homolog of SEQ ID NO 560 in the 10/412,699 US patent application
MAKEQDGSPKVRHPEFQRMRVTLTIGVIGLCVTAYILGAWQGTSNGINSSLISTRTQCKDNVRSSGARLDFQAHHQVGFNESVLAVEKFPPCQLKYSEYTPCQDPRRARKFPKKMMQYRERHCPKKEDMLRCLIPAPPNYNNPFQWPRSRDYAWFNNIPHRELSIEKAVQNWIHVEGDLLRFPGGGTMFPHGADAYIDGINALVPLNEGNIRTALDTGCGVASWGAYLMKRNITTMSFAPRDSHEAQVQFALERGVPAMIGVMGTERLPYPARAFDMAHCSRCLIPWNKLDGIYLIEVDRVLRPGGYWILSGPPIHWKRHYKGWERTEEDLKQEQDEIEDLAKRLCWKKVIEKGDLAIWQKPINHVECVDSRKVYDAPQICKSNDVDSAWYKKMDSCISPLPDVKSEDEVAGGALERWPKRAFVVPPRIIRGSVPGFTPEKFQEDNKVWSERVNHYKKLIPPLGKRRYRNVMDMNAGIGGFAAALMEYPLWVMNVVPSGLAHDTLGVIYERGFIGTYQDWCEAFSTYPRTYDLIHADKIFSSYQDRCDITYILLEMDRILRPEGTVIIRDNVEVLVKVQAITGGMRWKSQIMDHESGPFNPDKILVAVKTYWTGKPMEKQ

SEQ ID NO: 11667 - DNA, 1233 bp, Sorghum bicolor
  misc_feature: Ceres ANNOT ID no. 6026661
  misc_feature: Encodes the peptide sequence at SEQ ID NO 11668
atggccatccacggtggggcatcctgtaggctcgctgccgtgtgcttgttgctggagctcctcgcgctgcagggtggtgccggtgccgcggagccgctcgtgccggcgatgttcgtgttcggggactccatggtggacgtcggcaacaacaacttcattgacaagtgcgacatcagctgcaaagccgactacccgcacttcggcgtggactacctcgaccatgcacccaccggcaggttcagcaatggctacaacctggcagaccatctagcacaagagcttggctttgccgagagcccgccgccattcctgtccctgtcaaacgcgagccagtggatgagcaagggcatcaacttcgcgtcaggagggtcggggctccttcttaaaaccggcaatgatggaagaacggcaactttacgcatttcgctgacaagtgttatatccatcgctgagcagtgtacgcaagttctgtccatcgctgagcaggtcagcaacttcacgaatcttgcttggcagtgggcagcaagtggtgataacaggtcagccgatctcttgtccaaatcactcttcttcatcagcgccggcagcaacgacctgttcgagtacatcgatctaggcccccacgacaacgacacgaaactattgcaagacctcgttgcctcctacgcagcctacctgagggacttgtatgacgttggggcaaggaagttcagcgtggtgagcacgtcgctggtgggttgctgcccgtcgcagagactcatagctcatcgtctccaggaccccaagggcgccatcgacgagtacgggtgcctcgccccgctgaacagcctctcctaccagctttaccccatgttcgccgccatgctgcaggacctcagcgtggagctgcccggcatgaactactccttggccaactcgaccaagatggccgagtgggtgttggaaaccccggcctccgagccaacaagcctcaacgacttcacgttcacggtgctggacactgcgtgctgtggcgcagggaagtttggcgcggagtacgattgcaacttctcggctcccctgtgcccgaaccgcagcaaccacctcttctgggacgattaccaccccaccgaagccctgacgcagctcgctgcgaagatgatattcagcgaccctttcaggctcttcgcccaccccatcaccgtgcagcagctggtcggcggtggagcgcctgcgaccctagagaatatatga

SEQ ID NO: 11668 - protein, 410 aa, Sorghum bicolor
  misc_feature: Ceres ANNOT ID no. 6026661
  misc_feature (37)..(381): Pfam Id: Lipase_GDSL Pfam Desc: GDSL-like Lipase/Acylhydrolase
  misc_feature (14)..(317): NCBI GI: 140066639 NCBI Desc: lipolytic enzyme, g-d-s-l [medicago truncatula]
  misc_feature (151)..(398): NCBI GI: 115439921 NCBI Desc: os01g0748500 [oryza sativa (japonica cultivar-group)]
  misc_feature (157)..(398): NCBI GI: 21553940 NCBI Desc: gdsl-motif lipase/hydrolase-like protein [arabidopsis thaliana]
  misc_feature (157)..(398): NCBI GI: 20453403 NCBI Desc: at5g45670/mra19_6 [arabidopsis thaliana]
  misc_feature (175)..(389): NCBI GI: 50726533 NCBI Desc: gdsl-motif lipase/hydrolase-like [oryza sativa (japonica cultivar-group)]
MAIHGGASCRLAAVCLLLELLALQGGAGAAEPLVPAMFVFGDSMVDVGNNNFIDKCDISCKADYPHFGVDYLDHAPTGRFSNGYNLADHLAQELGFAESPPPFLSLSNASQWMSKGINFASGGSGLLLKTGNDGRTATLRISLTSVISIAEQCTQVLSIAEQVSNFTNLAWQWAASGDNRSADLLSKSLFFISAGSNDLFEYIDLGPHDNDTKLLQDLVASYAAYLRDLYDVGARKFSVVSTSLVGCCPSQRLIAHRLQDPKGAIDEYGCLAPLNSLSYQLYPMFAAMLQDLSVELPGMNYSLANSTKMAEWVLETPASEPTSLNDFTFTVLDTACCGAGKFGAEYDCNFSAPLCPNRSNHLFWDDYHPTEALTQLAAKMIFSDPFRLFAHPITVQQLVGGGAPATLENI

SEQ ID NO: 11669 - DNA, 390 bp, Sorghum bicolor
  misc_feature: Ceres ANNOT ID no. 6026672
  misc_feature: Encodes the peptide sequence at SEQ ID NO 11670
atggccgaggcagcgaacgggaaggaggacgccaagaggacaggactggaaggcactggcctaccgctgcaaggcggctcccacggcaaccttcgcagcgctggcagcgaccagcagctgaggcagatgctcgattcgctcaaatcctcaaagtcccctgctgtgatcaactatggtgcctcatgccagattcttccatccttctgcaagttcagtgataagttcaagaatcttactttcgtctatgcggacattgacgagtgccctgaaacaacgcaaaacatacgctacaccccaaccttccatttctacagagacggggaaagggttgatgagatgcttggcacaggagaagagagactacatgatcggctatggttgcattcttga

SEQ ID NO: 11670 - protein, 129 aa, Sorghum bicolor
  misc_feature: Ceres ANNOT ID no. 6026672
  misc_feature (10)..(129): NCBI GI: 115459888 NCBI Desc: os04g0560200 [oryza sativa (japonica cultivar-group)]
  misc_feature (10)..(129): NCBI GI: 116311129 NCBI Desc: b0103c08-b0602b01.12 [oryza sativa (indica cultivar-group)]
  misc_feature (17)..(129): NCBI GI: 21554669 NCBI Desc: thioredoxin-like protein [arabidopsis thaliana]
  misc_feature (17)..(129): NCBI GI: 6630742 NCBI Desc: thioredoxin-like protein [arabidopsis thaliana]
  misc_feature (62)..(129): NCBI GI: 34980254 NCBI Desc: thioredoxin [paracoccidioides brasiliensis]
MAEAANGKEDAKRTGLEGTGLPLQGGSHGNLRSAGSDQQLRQMLDSLKSSKSPAVINYGASCQILPSFCKFSDKFKNLTFVYADIDECPETTQNIRYTPTFHFYRDGERVDEMLGTGEERLHDRLWLHS

SEQ ID NO: 11671 - DNA, 1185 bp, Sorghum bicolor
  misc_feature: Ceres ANNOT ID no. 6026794
  misc_feature: Encodes the peptide sequence at SEQ ID NO 11672
atggagaaactgccccctggtttcctctctctcggaagcgaaagcgcggaattcagcttccccgacctactagggactcaccgcacgccgccgcagctgccggacgagatcatcgaagagatcctcctctgcatccctcctgatgaccacgacgagcatctcctctatgtcgctctcgtctgcaagcgttgggcctgcctccttgctagccgtggcttccgtcgccgataccgcgagcgccaccggacgccgctgctgctggggttcctcggcaacctcatcgacaccggcgggtatgcacgcttcatccccacgcgtgcgttccggccagtccaccccgaccgccatgactatcgcgcacatgatgcccgccatggccgggtcctcctcaacagaatcgctcggtgcggcgacgtgttccagggagtggaggccgctctcatcgtctgggaccctatcaccgatgatcagtggcccctgccgcctctgcaacgggaccagccggtgcacaactggaccgccgcggtgctttgcgccaccgccggcgtgggcacctgcgaccacctagattgcctcccgggggacttccatgtcgtcttcgttggcatcgatgacaaggagatgtttgccagtgtctactcgtcagattccgccacatggagtgaagcgacctctgcgaaccttcctcatgatcagctcaatgaggcggtgctccctgctctagcagggaatgcactctacttggtctttcggatgggaatgacaatgctcaagtacgatctggccacgaaggtgatgtctgtgctgcccataccgatcagttggtatcttcgccgcgttgtgcccatggcgatggacgatggcggcttaggactcgcagaagtggatatgcagtctaatctcatactctggtcaatggaggttagtgctgatggagatgttgaaaattgggtagtgagtagacagattgacctcaggacgctgctccctgctcatgcccttgcattctgtgtggttgccgttgcggatgcggtcggtgtcatcttcgtgtatacggatgatggggtctacacttttaatctgaactctgggcaggtcaccaaggtttttagctatggtttctatgacgttatccccttcgtgagcttctatactccagtattacgagcggccttagacaggtga

SEQ ID NO: 11672 - protein, 394 aa, Sorghum bicolor
  misc_feature: Ceres ANNOT ID no. 6026794
  misc_feature (28)..(79): Pfam Id: F-box Pfam Desc: F-box domain
  misc_feature (30)..(386): NCBI GI: 115437584 NCBI Desc: os01g0557400 [oryza sativa (japonica cultivar-group)]
  misc_feature (30)..(386): NCBI GI: 115470391 NCBI Desc: os07g0122900 [oryza sativa (japonica cultivar-group)]
  misc_feature (46)..(386): NCBI GI: 115481210 NCBI Desc: os10g0158700 [oryza sativa (japonica cultivar-group)]
  misc_feature (21)..(387): NCBI GI: 115475786 NCBI Desc: os08g0299900 [oryza sativa (japonica cultivar-group)]
  misc_feature (26)..(329): NCBI GI: 115481076 NCBI Desc: os10g0137700 [oryza sativa (japonica cultivar-group)]
MEKLPPGFLSLGSESAEFSFPDLLGTHRTPPQLPDEIIEEILLCIPPDDHDEHLLYVALVCKRWACLLASRGFRRRYRERHRTPLLLGFLGNLIDTGGYARFIPTRAFRPVHPDRHDYRAHDARHGRVLLNRIARCGDVFQGVEAALIVWDPITDDQWPLPPLQRDQPVHNWTAAVLCATAGVGTCDHLDCLPGDFHVVFVGIDDKEMFASVYSSDSATWSEATSANLPHDQLNEAVLPALAGNALYLVFRMGMTMLKYDLATKVMSVLPIPISWYLRRVVPMAMDDGGLGLAEVDMQSNLILWSMEVSADGDVENWVVSRQIDLRTLLPAHALAFCVVAVADAVGVIFVYTDDGVYTFNLNSGQVTKVFSYGFYDVIPFVSFYTPVLRAALDR

SEQ ID NO: 11673 - DNA, 444 bp, Sorghum bicolor
  misc_feature: Ceres ANNOT ID no. 6026905
  misc_feature: Encodes the peptide sequence at SEQ ID NO 11674
atggccgttgttgttcccgccggccattgttgtcgttgtgctactgctcggccatccgccggcgggaacaacaacggcacgcagcacctgcacttgttcatgcacgacgggtaccccaccgccgtgctgatcgtgaacggcagcacggcggctccggtgcttcccggcaaccgtcggttcgggcacctacgtacgtgctggcgtcgctggaggaggcccgccccggccgccttgctgctgtccatgaacctcgtgctcgccgacgacggcagcacggtggcggtcatgggccgcaacgacctcacggcacccgtgcgcgagctctccgtcgtcggcggcaccggccggttccgcatggccaccgggtacgtcctctggaagatggccagctggcgcgccgacaacgccgccgtgctcgagctcgatgtcttcctgcgcgcctga

SEQ ID NO: 11674 - protein, 147 aa, Sorghum bicolor
  misc_feature: Ceres ANNOT ID no. 6026905
  misc_feature (1)..(147): Pfam Id: Dirigent Pfam Desc: Dirigent-like protein
  misc_feature (70)..(145): NCBI GI: 77552297 NCBI Desc: dirigent-like protein [oryza sativa (japonica cultivar-group)]
  misc_feature (25)..(144): NCBI GI: 28812108 NCBI Desc: disease resistance response protein-like protein [oryza sativa (japonica cultivar-group)]
  misc_feature (29)..(145): NCBI GI: 49387652 NCBI Desc: disease resistance response protein-like [oryza sativa (japonica cultivar-group)]
  misc_feature (78)..(145): NCBI GI: 6227011 NCBI Desc: f12p19.3 [arabidopsis thaliana]
  misc_feature (36)..(143): NCBI GI: 34394264 NCBI Desc: disease resistance response protein-like protein [oryza sativa (japonica cultivar-group)]
MAVVVPAGHCCRCATARPSAGGNNNGTQHLHLFMHDGYPTAVLIVNGSTAAPVLPGNRRFGHLRTCWRRWRRPAPAALLLSMNLVLADDGSTVAVMGRNDLTAPVRELSVVGGTGRFRMATGYVLWKMASWRADNAAVLELDVFLRA

SEQ ID NO: 11675 - DNA, 594 bp, Sorghum bicolor
  misc_feature: Ceres ANNOT ID no. 6026924
  misc_feature: Encodes the peptide sequence at SEQ ID NO 11676
atgcggggcggctgctacgtcggcaaggccaccaagatcttcctcgccctcctcgccgccctcgccgtcgtcggcgtcgtcctcgccttccgcgccgtcctccaccgcgccgccgccaagtccagctcaaactccgcctcatccgcgtgcgccgccgccgacgcgtgccagcccgtcctgcccgacaccgaccctaccgtccagcaacccgccacggccgcccgcccaccgcccacgcccgctcaaaatcccacctttccttccccggacgccgccacctggccgccgccgccgccgccgccctcgcagccaacgcctgtgcccgagacccctctacaacccccgccgtcgccggtgccggtgcccgtgctcccacctcctcagcagcagctgcccccgccggcaccagtcgtgccgcccccgccggcattcccgtcaccgacgccgccaccggcggagatcgcgtcgcccccgcccgcactcgcgtcgccaccgccagacctgctgccgccgcctccaacgccacctgcgttgccgtcctcgcctgatgcgccgccggccgccccagaggcgcccagcccgacggcgtcttga

SEQ ID NO: 11676 - protein, 197 aa, Sorghum bicolor
  misc_feature: Ceres ANNOT ID no. 6026924
  misc_feature (5)..(166): NCBI GI: 50510150 NCBI Desc: extensin-like protein [oryza sativa (japonica cultivar-group)]
  misc_feature (58)..(194): NCBI GI: 119627579 NCBI Desc: hcg1793893 [homo sapiens]
  misc_feature (46)..(197): NCBI GI: 6523547 NCBI Desc: hydroxyproline-rich glycoprotein dz-hrgp [volvox carteri f. nagariensis]
  misc_feature (50)..(194): NCBI GI: 76262500 NCBI Desc: pherophorin-c2 protein precursor [chlamydomonas reinhardtii]
  misc_feature (61)..(194): NCBI GI: 21322711 NCBI Desc: pherophorin-dz1 protein [volvox carteri f. nagariensis]
MRGGCYVGKATKIFLALLAALAVVGVVLAFRAVLHRAAAKSSSNSASSACAAADACQPVLPDTDPTVQQPATAARPPPTPAQNPTFPSPDAATWPPPPPPPSQPTPVPETPLQPPPSPVPVPVLPPPQQQLPPPAPVVPPPPAFPSPTPPPAEIASPPPALASPPPDLLPPPPTPPALPSSPDAPPAAPEAPSPTAS

SEQ ID NO: 11677 - DNA, 1089 bp, Sorghum bicolor
  misc_feature: Ceres ANNOT ID no. 6026945
  misc_feature: Encodes the peptide sequence at SEQ ID NO 11678
atggcttcgccgcacccgctcagctgggccgacgcgccgcccttttactaccacgggacgacaccccagccggcacccgactcctcctccgacggggccgggccgcgctcgctctggatcggcggcctgctgcactggatggacgaggactacctctacgcctgcttcaccacctcgcccgagcttctttccgttgtcatcagacggagcaagcagactgggcaatcagagggttttggctttctcaattttgctgaccataccaccgctgctcagattctcaagtcttacaatggtcacaagatgcctaactctgttcaagatttcaagctcaactgggccactcaacaacctgctcccgacaaacttcctgatccacatttcaagctcgacccggccatgcagcaggatgtgcctcagaggcacgacgacgataattcctcatctgagcatttcatatttgttggggacttggcctatgatgtcacagaatacatgctacaccatctgttcaagacccgctacgcatcagtgaagagggcgaaaattatcgttgacaggttcactggtcgctcgaaaggctatggctttgttcagtttggagatgtcaatgagcagacacaagcactgacagaaatgaatggagcctactgttctaccaggcctatgcggattggacctgttcccaacaagaaaaaattttcccacaacaaacaagggactgagccttatcatgataacaattcaaggctatttgttaggcaacttgaccaaagtgtcacttatgaagatatgatacaagcctttcgtccatatggagagcttattgatgtcaatatattagcagggaagggctttgggtttgtcacatactctaataggccatcagcagaggaagccattagaatgctaaatggaagtcaactgggaggtaaagctataaaactttcatggggccgttctgctgacaagcaggctcaaaggaatagcggcggcttcggttggtctcctcaggatccctatgcttatgctcagaccggccatccgggatatggatattaccaacagcagctgcccgcagtgcagtga

SEQ ID NO: 11678 - protein, 362 aa, Sorghum bicolor
  misc_feature: Ceres ANNOT ID no. 6026945
  misc_feature (38)..(109): Pfam Id: RRM_1 Pfam Desc: RNA recognition motif. (a.k.a. RRM, RBD, or RNP domain)
  misc_feature (153)..(225): Pfam Id: RRM_1 Pfam Desc: RNA recognition motif. (a.k.a. RRM, RBD, or RNP domain)
  misc_feature (251)..(316): Pfam Id: RRM_1 Pfam Desc: RNA recognition motif. (a.k.a. RRM, RBD, or RNP domain)
  misc_feature (128)..(361): NCBI GI: 115453831 NCBI Desc: os03g0569900 [oryza sativa (japonica cultivar-group)]
  misc_feature (140)..(353): NCBI GI: 9663767 NCBI Desc: rna binding protein 45 [nicotiana plumbaginifolia]
  misc_feature (4)..(359): NCBI GI: 115475137 NCBI Desc: os08g0190200 [oryza sativa (japonica cultivar-group)]
  misc_feature (140)..(356): NCBI GI: 39545835 NCBI Desc: osjnbb0060e08.6 [oryza sativa (japonica cultivar-group)]
  misc_feature (140)..(356): NCBI GI: 115460682 NCBI Desc: os04g0625800 [oryza sativa (japonica cultivar-group)]
  misc_feature: The sequence is a functional homolog of SEQ ID NO 1484 in the 10/666,642US patent application
  misc_feature: The sequence is a functional homolog of SEQ ID NO 278 in the 10/714,887US patent application
  misc_feature: The sequence is a functional homolog of SEQ ID NO 278 in the 11/435,388US patent application
  misc_feature: Useful for making plants with modulated growth and phenotype characteristics
  misc_feature: The sequence is a functional homolog of SEQ ID NO 278 in the 20060015972 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MASPHPLSWADAPPFYYHGTTPQPAPDSSSDGAGPRSLWIGGLLHWMDEDYLYACFTTSPELLSVVIRRSKQTGQSEGFGFLNFADHTTAAQILKSYNGHKMPNSVQDFKLNWATQQPAPDKLPDPHFKLDPAMQQDVPQRHDDDNSSSEHFIFVGDLAYDVTEYMLHHLFKTRYASVKRAKIIVDRFTGRSKGYGFVQFGDVNEQTQALTEMNGAYCSTRPMRIGPVPNKKKFSHNKQGTEPYHDNNSRLFVRQLDQSVTYEDMIQAFRPYGELIDVNILAGKGFGFVTYSNRPSAEEAIRMLNGSQLGGKAIKLSWGRSADKQAQRNSGGFGWSPQDPYAYAQTGHPGYGYYQQQLPAVQ

SEQ ID NO: 11679 - DNA, 783 bp, Sorghum bicolor
  misc_feature: Ceres ANNOT ID no. 6027324
  misc_feature: Encodes the peptide sequence at SEQ ID NO 11680
atggccagcggcgggcggcggcggcccaagccgagggcgagggcgagggctaggggcaaggcgaagaggaccaagtacctcagcctcagcgacctgatggttaaggcggaggtggcagcgacgccgtcgccgccgtcgccgccggcggacccgtgggaggaggaggaggcggaggcggaagtgaagcgggaggaggacgctggcggcgacgacggaggcgccgggcggcagcagcagcaggtggagccgttcgcgctgcacaaccacaacgaggcgtccacgctgttcgaggccctgccggcgccgtcgctctccgacatcctcggcccgtcgccgtccgcgtcgcccgacggggccggctcgggggcttcggggctcccgggcgcccaggaggaggacctcgcgcgccgcgcgctgcggggcagggagcgctgggtgtactgctcctcgccggcggctacggccacccccaccgccaccgccaccacgtcgtcgtcgtcgccgtgctcgtccgccgccagtacgggcgcgtcggcggcgcgctcgctgctgctcaagctcgactacgaggagatcctcgcggcgtgggccgaccgggggtcgctctacatcggcgccgctgggagggcggagagggtgaggcggtacaaggagaagcggcggaggcggctcttcgccaagcggatccggtacgaggttcgccgggttaatgccgtcaagcggccgcggttcaagggtcgtttcataaaggaacatgaggaaagcgagctgcggcctacgtag

SEQ ID NO: 11680 - protein, 260 aa, Sorghum bicolor
  misc_feature: Ceres ANNOT ID no. 6027324
  misc_feature (209)..(253): Pfam Id: CCT Pfam Desc: CCT motif
  misc_feature (1)..(210): NCBI GI: 115474553 NCBI Desc: os08g0119700 [oryza sativa (japonica cultivar-group)]
  misc_feature (209)..(245): NCBI GI: 140045409 NCBI Desc: cct [medicago truncatula]
  misc_feature (208)..(250): NCBI GI: 53793155 NCBI Desc: zinc finger protein-like [oryza sativa (japonica cultivar-group)]
  misc_feature (208)..(250): NCBI GI: 46390649 NCBI Desc: zinc finger protein-like [oryza sativa (japonica cultivar-group)]
  misc_feature (209)..(250): NCBI GI: 79319580 NCBI Desc: zinc ion binding [arabidopsis thaliana]
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: Useful for making plants with modulated drought sensitivity
  misc_feature: Useful for making plants with modulated growth and phenotype characteristics
  misc_feature: Useful for making plants with modulated low light sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13482
  misc_feature: GREAT-hit functional homolog of the protein sequence given in SEQ ID NO 13484
  misc_feature: The sequence is a functional homolog of SEQ ID NO 1593 in the 20040045049 US patent application
MASGGRRRPKPRARARARGKAKRTKYLSLSDLMVKAEVAATPSPPSPPADPWEEEEAEAEVKREEDAGGDDGGAGRQQQQVEPFALHNHNEASTLFEALPAPSLSDILGPSPSASPDGAGSGASGLPGAQEEDLARRALRGRERWVYCSSPAATATPTATATTSSSSPCSSAASTGASAARSLLLKLDYEEILAAWADRGSLYIGAAGRAERVRRYKEKRRRRLFAKRIRYEVRRVNAVKRPRFKGRFIKEHEESELRPT

SEQ ID NO: 11681 - DNA, 1239 bp, Sorghum bicolor
  misc_feature: Ceres ANNOT ID no. 6027396
  misc_feature: Encodes the peptide sequence at SEQ ID NO 11682
atggcgacgaacccggccccgggcgttctctgccgcgctccccgcccctcgcctgcgccaatggccgccgcccccacgcagtcttcctctgcctccgtacccattccgcatgctacccgctgcatccgcctcgccgccgcagccccaccaccaccacgttgtgtagctagtccaaccattgctaatgtgaaagaccaaactgaggctgaagttgcaatggggtacacgatgactgaaatctgcgacaaattcattgagttcttcatgtataagaaaccagaaacaaaggactggagaaaattattggtgtttagagaggagtggcgaaggtatagagagcacttctacaagcgttgccaagtgcgcatagatatggaaactgatccttcagtgaaacaaaagttggttgtacttgctagaaaagttaagaagatagatgatgaaatagagaagcacatggaactgttcactgagctcagtgagaaccctgctgatattaatgctattgttgcaagacgacgaaaggatttcactggggagttcttccgccatcttaatttccttgtgaatgcttataatggccttgacgagcgagacggagtagtcaggctcggggccaaatgcctatctgcaattcatgcatatgactgcacactagaacagttagacatcgaatctgctcagttgaagtttgatgatatactgaattcctcttcactagatggtgcttgtgacgagataaaaagcttagccaaggctaaagaacttgattcatctctaattcttctcattaacagagcttgggctgctgcaaaagaatctacaactatgaatgataaggtcaaggacataatgtatcatatttatacaactacaaaagaaagcctcaagaacatctcacctccggagatgaagcttctgaagtatctgctgaatattgaagaccctgaagagagatttggtgctcttgcaactgctttctctcccggggatgagtgtgaaaccaaggatgaagatgctctttacacaactcccaacgaactccacaaatggatcaaaatgctgctcgattcataccatctcaacaaggaggagacggattttatggatgcgagaaagatgagcgacccggtgatcatccagaggttaactttgctgaaggagacgatcgaggaagaatacatgaaacagtatatacatcccgaggaggaagaatccatggacgaggacgacaattag

SEQ ID NO: 11682 - protein, 412 aa, Sorghum bicolor
  misc_feature: Ceres ANNOT ID no. 6027396
  misc_feature (54)..(412): NCBI GI: 52077520 NCBI Desc: endoribonuclease e-like protein [oryza sativa (japonica cultivar-group)]
  misc_feature (54)..(248): NCBI GI: 52077521 NCBI Desc: endoribonuclease e-like protein [oryza sativa (japonica cultivar-group)]
  misc_feature (54)..(230): NCBI GI: 115475868 NCBI Desc: os08g0320800 [oryza sativa (japonica cultivar-group)]
MATNPAPGVLCRAPRPSPAPMAAAPTQSSSASVPIPHATRCIRLAAAAPPPPRCVASPTIANVKDQTEAEVAMGYTMTEICDKFIEFFMYKKPETKDWRKLLVFREEWRRYREHFYKRCQVRIDMETDPSVKQKLVVLARKVKKIDDEIEKHMELFTELSENPADINAIVARRRKDFTGEFFRHLNFLVNAYNGLDERDGVVRLGAKCLSAIHAYDCTLEQLDIESAQLKFDDILNSSSLDGACDEIKSLAKAKELDSSLILLINRAWAAAKESTTMNDKVKDIMYHIYTTTKESLKNISPPEMKLLKYLLNIEDPEERFGALATAFSPGDECETKDEDALYTTPNELHKWIKMLLDSYHLNKEETDFMDARKMSDPVIIQRLTLLKETIEEEYMKQYIHPEEEESMDEDDN

SEQ ID NO: 11683 - DNA, 1635 bp, Sorghum bicolor
  misc_feature: Ceres ANNOT ID no. 6027594
  misc_feature: Encodes the peptide sequence at SEQ ID NO 11684
atggcgtacatggcagctgtcgcgcccgtgccctggtggccgcctccaccggagctggcgcctgtgggcttccccgacgcgtcctctcccgccggctatccaaagccccaaaccctacccttcttgctagcgccgacccctccgccaccgccgccgccgccgccgctgcctgcggggtaccctcttcttcctcccccagccccgatcatcatccagctccagcccgaccccagcttcgtcgcggaggtggatcagcgtcgcagcagttcccttgtgcagttcttgaaggatgagggggccgttccgtcgccggaggatgaaaagaagagggagaaggtgatccgagagctcaagaagatagtgatgcattgggccaacgcggtggcctatgagcagagtgtgccccaggggctggccactgctacggtcttgacatacggctcttacaccttaggggctcatggacctgaatctgacatcgatgtactttgcgttggaccttgtattgcaacactgcagtaccatttctttgttgttttgagacaacttcttgagggcagacctgaagtatcagaactgcaaactattgagaaggctaaggttcccttgatgcgatttagatttactggaattgcagttgatttcacatatgcccagctccctgttattgatgcattaaaggccataaatacatttagcactcaactactacagaaaatagacacacggagctggaggagtttatctggagttcgtgtcaatgaacaaattgttcagctagtaccaaatgcggagaagtttcaagctctgttgcgatgcatcaaactgtgggctaggaaaagaggacttcattgtcattatcttggcttctttgctgggattcatttagcgatccttgcggcttatgtctgtcggaaatttccagatgccagtgtcaatggtttgttcgcagtgttctttcagacttttgctcactggccttggcaagttccagtaagtctacatgatgagccaactacctccttgcattcagaggggcttctcatgcccatagtgatgccttgtaccccgccagagttttgtgtgtccaatgtgacaagaggcagcttcaaaaaaataagagaggaacttacacgtggttatgctttgacaaggtggacctggctttttgaaccctttccatatgataaaaaatatcaacagtttcttcgcattgctttatgtgcgccaacatttgccgagctacgagactgggctggatgggtgaaatctcgattccgtctcctgattctaaagctggaaagagctggcattgagtgtgatccatgcccctcggaggaagttgatcatacagacaatgaccctaacgtagtcttctactggggcctcatccctgaaagaatcattcaggttgacactagctccctgaaagaagatttcatggaaagcatcaccaatgatgtctatggcacggtgaagtgcacgcattcagatgtgacaatatctgtggttgggctgccacagttgccaaagagtatgcgcagccatgttcactggcagtacatgcagcgttgtatgatggcctacgagggcacagatgaaggccagagcgcaggttggctaggacttggttag

SEQ ID NO: 11684 - protein, 544 aa, Sorghum bicolor
  misc_feature: Ceres ANNOT ID no. 6027594
  misc_feature (76)..(393): Pfam Id: PAP_central Pfam Desc: Poly(A) polymerase central domain
  misc_feature (394)..(524): Pfam Id: PAP_RNA-bind Pfam Desc: Poly(A) polymerase predicted RNA binding domain
  misc_feature (131)..(215): Pfam Id: NTP_transf_2 Pfam Desc: Nucleotidyltransferase domain
  misc_feature (67)..(539): NCBI GI: 24059888 NCBI Desc: poly(a) polymerase-like protein [oryza sativa (japonica cultivar-group)]
  misc_feature (27)..(200): NCBI GI: 115474207 NCBI Desc: os07g0688500 [oryza sativa (japonica cultivar-group)]
  misc_feature (218)..(523): NCBI GI: 115452655 NCBI Desc: os03g0313300 [oryza sativa (japonica cultivar-group)]
  misc_feature (84)..(512): NCBI GI: 62320636 NCBI Desc: poly(a) polymerase [arabidopsis thaliana]
  misc_feature (97)..(512): NCBI GI: 32527644 NCBI Desc: poly(a) polymerase [arabidopsis thaliana]
MAYMAAVAPVPWWPPPPELAPVGFPDASSPAGYPKPQTLPFLLAPTPPPPPPPPPLPAGYPLLPPPAPIIIQLQPDPSFVAEVDQRRSSSLVQFLKDEGAVPSPEDEKKREKVIRELKKIVMHWANAVAYEQSVPQGLATATVLTYGSYTLGAHGPESDIDVLCVGPCIATLQYHFFVVLRQLLEGRPEVSELQTIEKAKVPLMRFRFTGIAVDFTYAQLPVIDALKAINTFSTQLLQKIDTRSWRSLSGVRVNEQIVQLVPNAEKFQALLRCIKLWARKRGLHCHYLGFFAGIHLAILAAYVCRKFPDASVNGLFAVFFQTFAHWPWQVPVSLHDEPTTSLHSEGLLMPIVMPCTPPEFCVSNVTRGSFKKIREELTRGYALTRWTWLFEPFPYDKKYQQFLRIALCAPTFAELRDWAGWVKSRFRLLILKLERAGIECDPCPSEEVDHTDNDPNVVFYWGLIPERIIQVDTSSLKEDFMESITNDVYGTVKCTHSDVTISVVGLPQLPKSMRSHVHWQYMQRCMMAYEGTDEGQSAGWLGLG

SEQ ID NO: 11685 - DNA, 1029 bp, Sorghum bicolor
  misc_feature: Ceres ANNOT ID no. 6027599
  misc_feature: Encodes the peptide sequence at SEQ ID NO 11686
atggcggcgcgtgatcgccgagagctgagcagcgacgaggagtcggcggcggcggcggccggagacctccgccgcgggccgtggacggtggaggaggacatgctcctcgtcaactacgtcgccgcgcacggcgagggacgctggaacgcgctggcacgatgcgcagggctccggcggacgggcaagagctgccggctgcggtggctcaactacctgcggccggacctgcggcggggcaacatcacggcgcaggagcagctgctcatcctggagctgcactcgcggtggggcaaccggtggtccaagatcgcgcagcacctcccggggcgcaccgacaacgagatcaagaactactggcgcacgcgggtgcagaagcacgccaggcagctcaactgcgacgtcaacagccagcagttcaaggacctcatgcgctacatctggatgccgcgcctcctcgagcgcatcggctccgacgactccggggacggcgccgtcgttatcgacgccgcggtgcacgccgacgccacgccgtcgccgacgccgacgctgcagccgcagccgcagccgctcctcacggccgcggcgtggccggtggacgacgtcgagctgtcctgcaccaccgccgtgtcctcgtcgtccgtgtccacggacagcatgcaccaccaccagcagctcgccgccgtgtccccgccgccgccgccgccgccggctgtggcctccgccgccttcggcgagagcaacaacgacggctcctactacggtatcgacaacagcaacactgccatgtccatgtgggacacgctatgccaaccaccgcactcgacgacggcgcagctggcgggcgccgggacctgcggctggtccgacgagtctctgctggtcgtcccttctggcctcctaggcgacggcggcgtgtacgccgacatggggttcccggacctctgcgacaccgacaccatgaccatgtgggccgccggcgccggctccagcgccgacgacctgtggtacacgcagacaatggggctgtga

SEQ ID NO: 11686 - protein, 342 aa, Sorghum bicolor
  misc_feature: Ceres ANNOT ID no. 6027599
  misc_feature (25)..(72): Pfam Id: Myb_DNA-binding Pfam Desc: Myb-like DNA-binding domain
  misc_feature (78)..(123): Pfam Id: Myb_DNA-binding Pfam Desc: Myb-like DNA-binding domain
  misc_feature (1)..(183): NCBI GI: 19073334 NCBI Desc: typical p-type r2r3 myb protein [sorghum bicolor]
  misc_feature (7)..(233): NCBI GI: 115474203 NCBI Desc: os07g0688200 [oryza sativa (japonica cultivar-group)]
  misc_feature (20)..(155): NCBI GI: 19073328 NCBI Desc: typical p-type r2r3 myb protein [sorghum bicolor]
  misc_feature (22)..(164): NCBI GI: 41619230 NCBI Desc: myb transcription factor [arabidopsis thaliana]
  misc_feature (13)..(162): NCBI GI: 115486645 NCBI Desc: os11g0684000 [oryza sativa (japonica cultivar-group)]
  misc_feature: The sequence is a functional homolog of SEQ ID NO 1564 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 126 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MAARDRRELSSDEESAAAAAGDLRRGPWTVEEDMLLVNYVAAHGEGRWNALARCAGLRRTGKSCRLRWLNYLRPDLRRGNITAQEQLLILELHSRWGNRWSKIAQHLPGRTDNEIKNYWRTRVQKHARQLNCDVNSQQFKDLMRYIWMPRLLERIGSDDSGDGAVVIDAAVHADATPSPTPTLQPQPQPLLTAAAWPVDDVELSCTTAVSSSSVSTDSMHHHQQLAAVSPPPPPPPAVASAAFGESNNDGSYYGIDNSNTAMSMWDTLCQPPHSTTAQLAGAGTCGWSDESLLVVPSGLLGDGGVYADMGFPDLCDTDTMTMWAAGAGSSADDLWYTQTMGL

SEQ ID NO: 11687 - DNA, 837 bp, Sorghum bicolor
  misc_feature: Ceres ANNOT ID no. 6027610
  misc_feature: Encodes the peptide sequence at SEQ ID NO 11688
atgggcaacgcgagcggccgggcggaagacctcgcggacgccgacatggacgacggcaaccacgtgcgccgcgcctcctcctcctccgcgggctacgtccggggcggcgggtcgtcgtcgtccccgccggcgagcccgccgaggccgcattcgccgcggatgttcgtgccccagagtcctgtaactccgttgcaaagagctgcagaagtacctcctccagtgttcaaccagatattgatgaatcaacaacaggaggattctgatggcccacctcaaaagaaaattcccacgttgcttacgtggactcttggagggagaaatatctatgtagaaggatcatgggacaaatggacgtcaaagaaacctgttgagaaatccggaaaagatcacaccattctactgatgctttcatctggagttcaccgctatagattcattgtggatggagaaagaagatttatacctgatcttccctgcgaaaccgacaatatgggccagattgtgaacctagtagatgtccatgacttcattcctgaaagcgtggaaagtgtatctgagctgatggcgcctccctccccggactccagctacggtttccatgttcccggcgaaaaggagttcgccaaggagccacctcagctgccggcccagctctacctcggcgtgctgaattcacggagctcggaggaaggctgcgcgaggccgaggcacgtcgtcctcgaccatctctacatagagaagggctggggcgcacagccgctggtggccctcggctacacccacaggttccgctccaagtatgtgacctgcgtcctgtacaaggccatcgagcggtag

SEQ ID NO: 11688 - protein, 278 aa, Sorghum bicolor
  misc_feature: Ceres ANNOT ID no. 6027610
  misc_feature (190)..(276): Pfam Id: AMPKBI Pfam Desc: 5'-AMP-activated protein kinase, beta subunit, complex-interactingregion
  misc_feature (24)..(278): NCBI GI: 50509154 NCBI Desc: akin beta1-like protein [oryza sativa (japonica cultivar-group)]
  misc_feature (1)..(278): NCBI GI: 109287749 NCBI Desc: beta subunit 2 of snrk1 [oryza sativa (japonica cultivar-group)]
  misc_feature (1)..(278): NCBI GI: 21593717 NCBI Desc: akin beta1 [arabidopsis thaliana]
  misc_feature (1)..(278): NCBI GI: 66710734 NCBI Desc: snf1-related protein kinase regulatory beta subunit 1 [pisum sativum]
  misc_feature (5)..(278): NCBI GI: 42540596 NCBI Desc: gal83 [nicotiana attenuata]
  misc_feature: The sequence is a functional homolog of SEQ ID NO. 473 in the 11/188,298 US application
MGNASGRAEDLADADMDDGNHVRRASSSSAGYVRGGGSSSSPPASPPRPHSPRMFVPQSPVTPLQRAAEVPPPVFNQILMNQQQEDSDGPPQKKIPTLLTWTLGGRNIYVEGSWDKWTSKKPVEKSGKDHTILLMLSSGVHRYRFIVDGERRFIPDLPCETDNMGQIVNLVDVHDFIPESVESVSELMAPPSPDSSYGFHVPGEKEFAKEPPQLPAQLYLGVLNSRSSEEGCARPRHVVLDHLYIEKGWGAQPLVALGYTHRFRSKYVTCVLYKAIER

SEQ ID NO: 11689 - DNA, 789 bp, Sorghum bicolor
  misc_feature: Ceres ANNOT ID no. 6027612
  misc_feature: Encodes the peptide sequence at SEQ ID NO 11690
atggaacagggcaagagagccaaggtgctgtgcctgcatggcttccgcacaagcgggagtttcttgaagaagcagatcagcaaatggcacccttccatatttcagcagtttgagatggtcttccctgatggcatcttcccagctggtggaaagtcagagatagagggcatatttccgccgccgtacttcgagtggttccagttcaataaggaattcactgaatacacaaatctggatgagtgcatttcatatctatgtgattacatggtgaaaaatggaccttttgatggcctgctcggattctcccagggcgcaacactttcggcccttttgataggctaccaagcacagggcaaggtgctgagtgatcatccaccaattaagttcatggtctcaatatctgggagcaagttcagggacccaagcatctgtgacgtcgcctacaaagacccgatcaaggtcaaatcagtgcattttattggagaaaaggactggctcaaggtaccttccgaggagctggcttctgcctttgatgaacctctcatcataaggcatcctcaaggccacactgtccctaggcttgacgatgtgtctgtgaaacagctttctgaatggagctcatgcattctggaagaccccaagaatgcaaatgttcccgaggctttagattcaggcaaaccatctgataaggaggctactggtgcggaattcgaggccttagattcaggcaaaccatctgataaggaggctactggtgcggaattagcagaaaacctggtgaaagcttga

SEQ ID NO: 11690 - protein, 262 aa, Sorghum bicolor
  misc_feature: Ceres ANNOT ID no. 6027612
  misc_feature (4)..(215): Pfam Id: FSH1 Pfam Desc: Serine hydrolase (FSH1)
  misc_feature (2)..(200): NCBI GI: 116310078 NCBI Desc: h0818e04.16 [oryza sativa (indica cultivar-group)]
  misc_feature (5)..(193): NCBI GI: 19075853 NCBI Desc: dihydrofolate reductase [schizosaccharomyces pombe]
  misc_feature (5)..(193): NCBI GI: 3618214 NCBI Desc: dfr1 [schizosaccharomyces pombe]
  misc_feature (5)..(193): NCBI GI: 404819 NCBI Desc: dihydropteridine reductase
  misc_feature (5)..(249): NCBI GI: 116129108 NCBI Desc: ensangp00000016674 [anopheles gambiae str. pest]
MEQGKRAKVLCLHGFRTSGSFLKKQISKWHPSIFQQFEMVFPDGIFPAGGKSEIEGIFPPPYFEWFQFNKEFTEYTNLDECISYLCDYMVKNGPFDGLLGFSQGATLSALLIGYQAQGKVLSDHPPIKFMVSISGSKFRDPSICDVAYKDPIKVKSVHFIGEKDWLKVPSEELASAFDEPLIIRHPQGHTVPRLDDVSVKQLSEWSSCILEDPKNANVPEALDSGKPSDKEATGAEFEALDSGKPSDKEATGAELAENLVKA

SEQ ID NO: 11691 - DNA, 492 bp, Sorghum bicolor
  misc_feature: Ceres ANNOT ID no. 6027642
  misc_feature: Encodes the peptide sequence at SEQ ID NO 11692
atgcccccgcacggccccgaagaagacgccgacgcgcacctcttcgccggcgtccgcttcgtgctccacggcttcgaccaggtctccgcctcccagtatcggctggtgatagagcggtgcggcggcgtccatgtgggaagttgggacggagactgcacccacgttatagtttccaacaccttatatgatgatccagtgtgtgtggcagcgaggaaggctgggaagaaggtcgtcgttgatcagtgggtggaagacagcttcgaactcagagaattggttgatgcagatcgggtactatatgctccagtcagagatttcaaaggcattccgggttgcgataaacttcacatttgcttgacagggtacgacaagaattggcgtgatgacataatgaaaatggtttctttgatgggagcaaacttctccaagtctttggcagcaaacaaaattacccatctcatttgctacaaatttgaaggtatttcttcatag

SEQ ID NO: 11692 - protein, 163 aa, Sorghum bicolor
  misc_feature: Ceres ANNOT ID no. 6027642
  misc_feature (10)..(87): Pfam Id: BRCT Pfam Desc: BRCA1 C Terminus (BRCT) domain
  misc_feature (2)..(161): NCBI GI: 118151388 NCBI Desc: pax interacting (with transcription-activation domain) protein 1 [bos taurus]
  misc_feature (4)..(161): NCBI GI: 4336734 NCBI Desc: pax transcription activation domain interacting protein ptip [mus musculus]
  misc_feature (4)..(161): NCBI GI: 53733383 NCBI Desc: zgc:92593 [danio rerio]
  misc_feature (4)..(161): NCBI GI: 21707458 NCBI Desc: paxip1l protein [homo sapiens]
  misc_feature (4)..(161): NCBI GI: 119624929 NCBI Desc: pax interacting (with transcription-activation domain) protein 1, isoform cra_a [homo sapiens]
MPPHGPEEDADAHLFAGVRFVLHGFDQVSASQYRLVIERCGGVHVGSWDGDCTHVIVSNTLYDDPVCVAARKAGKKVVVDQWVEDSFELRELVDADRVLYAPVRDFKGIPGCDKLHICLTGYDKNWRDDIMKMVSLMGANFSKSLAANKITHLICYKFEGISS

SEQ ID NO: 11693 - DNA, 213 bp, Sorghum bicolor
  misc_feature: Ceres ANNOT ID no. 6028523
  misc_feature: Encodes the peptide sequence at SEQ ID NO 11694
atggctgactggggccccgtgctgatcgcggtgctcttcttcgtgctcctcacgccggggctgctctgccagatccccggcagcggccgaggcgtgccggagttccacagcatgcgcaccagcggcgtcgccatcttcgtccacaccctcctcttcttcggcttctgcgccatcttcatggtcgccgtcggggtccacctctacgccggctag

SEQ ID NO: 11694 - protein, 70 aa, Sorghum bicolor
  misc_feature: Ceres ANNOT ID no. 6028523
  misc_feature (1)..(70): NCBI GI: 115485585 NCBI Desc: os11g0496500 [oryza sativa (japonica cultivar-group)]
  misc_feature (3)..(68): NCBI GI: 1532167 NCBI Desc: localized according to blastn similarity to est sequences; therefore, the coding span corresponds only to an area of similarity since the initation codon and stop codon could not
  misc_feature (3)..(68): NCBI GI: 1532167 (continued) be precisely determined [arabidopsis thaliana]
  misc_feature (2)..(68): NCBI GI: 1532168 NCBI Desc: localized according to blastn similarity to est sequences; therefore, the coding span corresponds only to an area of similarity since the initation codon and stop codon could not
  misc_feature (2)..(68): NCBI GI: 1532168 (continued) be precisely determined [arabidopsis thaliana]
  misc_feature (1)..(35): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence encoded by LOCUS at5g63500
  misc_feature: Useful for making plants with altered cell wall content and/or composition
  misc_feature: Functional homolog of the protein sequence given in SEQ ID NO 13690
MADWGPVLIAVLFFVLLTPGLLCQIPGSGRGVPEFHSMRTSGVAIFVHTLLFFGFCAIFMVAVGVHLYAG

SEQ ID NO: 11695 - DNA, 870 bp, Sorghum bicolor
  misc_feature: Ceres ANNOT ID no. 6028552
  misc_feature: Encodes the peptide sequence at SEQ ID NO 11696
atgatgaaccagcacagagaggaggatgccttgagaggtcaagcagtcaaaaaccagaaggcgatatgggacaagaccctggaaatgagattcttgctgcagaagggattttccacttccaacaagttgccccaggaacccatcagaacaaggttttgcaatcatgataagcagatagagcaagcctatgatgatctgttgaattcatcaaagcagactttgagcagcatgatggagctgcaggaggctttgctcgagagtaatcaggctacaaagggtgccaatgaaattccttctgccgcaaatggagacaatgacgagtggtcagaagtacagagattgcagacaaggataacaacattcagaaatactgagatagataaatggcagaggaaaatacaggtgacaacaggtgctgctgcacttaaaggaaagctacatgcatttaatcagaacattagtgaccaagttgctggttacatgagagatccaagccggatgattaacaggatgtacttgtccaactctgctgttagtgtatttggaaaggatgtgggagaacccagaacagctgaggaggggcacattatggaaggtgatcctgaacttattgacgattctgagttttatcaacaacttctcaaggagtttcttgagtcatgtgatagaggggcctcagagtcggcactttatgccctaaaaaagcagcaggttaaaaagagaaagcttgttgatcgtcgtgcttcaaagagcagaaagatacggtatcatgtccatgagaagattactaatttcatggccccagagcccatggttgttcctccaatggccccgaagttgtttgagaatttatttggcaatggcaactag

SEQ ID NO: 11696 - protein, 289 aa, Sorghum bicolor
  misc_feature: Ceres ANNOT ID no. 6028552
  misc_feature (210)..(285): Pfam Id: TRAUB Pfam Desc: TRAUB (NUC102) domain
  misc_feature (2)..(286): NCBI GI: 28416553 NCBI Desc: at5g61330 [arabidopsis thaliana]
  misc_feature (9)..(286): NCBI GI: 74634641 NCBI Desc: protein bfr2
  misc_feature (1)..(286): NCBI GI: 116132204 NCBI Desc: ensangp00000017925 [anopheles gambiae str. pest]
  misc_feature (186)..(289): NCBI GI: 9790013 NCBI Desc: apoptosis antagonizing transcription factor [mus musculus]
  misc_feature (1)..(285): NCBI GI: 19920846 NCBI Desc: cg11188-pa [drosophila melanogaster]
MMNQHREEDALRGQAVKNQKAIWDKTLEMRFLLQKGFSTSNKLPQEPIRTRFCNHDKQIEQAYDDLLNSSKQTLSSMMELQEALLESNQATKGANEIPSAANGDNDEWSEVQRLQTRITTFRNTEIDKWQRKIQVTTGAAALKGKLHAFNQNISDQVAGYMRDPSRMINRMYLSNSAVSVFGKDVGEPRTAEEGHIMEGDPELIDDSEFYQQLLKEFLESCDRGASESALYALKKQQVKKRKLVDRRASKSRKIRYHVHEKITNFMAPEPMVVPPMAPKLFENLFGNGN

SEQ ID NO: 11697 - DNA, 654 bp, Sorghum bicolor
  misc_feature: Ceres ANNOT ID no. 6028560
  misc_feature: Encodes the peptide sequence at SEQ ID NO 11698
  misc_feature: Down-regulated in shoot tissues in response to aminocyclopropane carboxylic treatment
  misc_feature: Down-regulated in shoot tissues in response to salicylic acid treatment
atgccgctccagcatggccctcgacttcgaatggccgcagcctccggcgcggctcgtcgtccccgcagtcgtctccccggccgacctacaagcctcccgtgcggcggcagcaggacaaggacgacggcgctggttcttgtagccgcaacgacaagagaaggggcgaagacgacggcggcagtggccacggccacggcggcggacgtggtgagggcgttctacgacggcgtgaaccggcgggacctggcggcggtggagccgctcatcgcggagggctgcgtgtacgaggacctggtgttcccgcggcccttcgtggggcgggagcggatcatcggcttcttcggcgagttcatgggcaccatcagccccgacctccagttcgtcatcgacgacatctccgccgacgactccgccgccgtcggggtcacctggcacctggagtggagggggaagccgtttcctttcagcaggggatgcagcttctaccgcttgctcgccggctcggagtcggagtcggagcagcagccgctgcagattgtgtatggccgagactgcgtggagcctgccgccaagcctggggatttggcactggtgatcatcaggggagtgacatggatccttgaacgatttccaagccttgcaagcaggttctga

SEQ ID NO: 11698 - protein, 217 aa, Sorghum bicolor
  misc_feature: Ceres ANNOT ID no. 6028560
  misc_feature (67)..(179): Pfam Id: SnoaL Pfam Desc: SnoaL-like polyketide cyclase
  misc_feature (1)..(215): NCBI GI: 51536247 NCBI Desc: nuclear transport factor 2 (ntf2)-like protein [oryza sativa (japonica cultivar-group)]
  misc_feature: Down-regulated in shoot tissues in response to aminocyclopropane carboxylic treatment
  misc_feature: Down-regulated in shoot tissues in response to salicylic acid treatment
MPLQHGPRLRMAAASGAARRPRSRLPGRPTSLPCGGSRTRTTALVLVAATTREGAKTTAAVATATAADVVRAFYDGVNRRDLAAVEPLIAEGCVYEDLVFPRPFVGRERIIGFFGEFMGTISPDLQFVIDDISADDSAAVGVTWHLEWRGKPFPFSRGCSFYRLLAGSESESEQQPLQIVYGRDCVEPAAKPGDLALVIIRGVTWILERFPSLASRF

SEQ ID NO: 11699 - DNA, 321 bp, Sorghum bicolor
  misc_feature: Ceres ANNOT ID no. 6028634
  misc_feature: Encodes the peptide sequence at SEQ ID NO 11700
atggacacatcaagccctgcagcacttgtcaatgcagagactctgaacatgtttgttgggcgaagagtgcgcacggttgttcaagtccaacgcaatgaaggtggagtggttgtcgggcagtccagcgatgggcatcagttgagtatcaaaagtgccatggacgtccctgtatcaaactttatggaggtttatggaattgctgaaaacaaccagaccatccgtgctgaagtttgcacagattttggtcccaactttgatcccaagccttttgatcagttgtgcaagttggcgagtgacaagttcaagcacatgttcctgtag

SEQ ID NO: 11700 - protein, 106 aa, Sorghum bicolor
  misc_feature: Ceres ANNOT ID no. 6028634
  misc_feature (1)..(105): Pfam Id: Rep_fac-A_3 Pfam Desc: Replication factor A protein 3
  misc_feature (1)..(104): NCBI GI: 7268653 NCBI Desc: pollen-specific protein-like [arabidopsis thaliana]
  misc_feature (1)..(106): NCBI GI: 124359736 NCBI Desc: nucleic acid-binding, ob-fold [medicago truncatula]
  misc_feature (1)..(99): NCBI GI: 24641344 NCBI Desc: cg15220-pa [drosophila melanogaster]
  misc_feature (1)..(82): NCBI GI: 54643962 NCBI Desc: ga13581-pa [drosophila pseudoobscura]
MDTSSPAALVNAETLNMFVGRRVRTVVQVQRNEGGVVVGQSSDGHQLSIKSAMDVPVSNFMEVYGIAENNQTIRAEVCTDFGPNFDPKPFDQLCKLASDKFKHMFL

SEQ ID NO: 11701 - DNA, 990 bp, Sorghum bicolor
  misc_feature: Ceres ANNOT ID no. 6028722
  misc_feature: Encodes the peptide sequence at SEQ ID NO 11702
atgattccaggaatcgcccccaagacggcggcggcggtgccggtggcctgggcacctcagcctcggcacatgttcgtgtttggcgcgggcttcgtcggccgctacgtctcggagcgcctcctcgcgcagggctggcaggtttccgggacgtgcaccagtgtcaacaagaagagagagctcgagatgctgggcatgaatgcttccgttttcgatgctacagagagcagcctggaaaatattcacaatttgcgacaagcaactcacttgctcatctccatcccacccatccctggaattggtgatcctctacttaatttaggcgaagacctgaggagaacactcagccatggtaatcttgaatggttatgctacctttcgtcaacaagtgtgtatggtgattgtggtggtgtattggttgatgaggatcatacagtaaacccaaagagtgagtctgccaagctaagatataatgcagaaaaaggatggctgaatcttattgatgatctaaatctgtcagcttttatattccgtttaggtggaatatatgggcctggaagaagtgctttggacaccttagccaagggcaaatttttgtcgcagagacaaaagttgcgagaatctaagcagtatactgcacgaatccacgtggctgacatctaccaggctgtcttggctagcatgtgcatcagatgtgcaaggaaaatatttaatgtggtggatgatgaccctgccccaagagctgaggtttttgcgtttgctaggagtttgatacagaggagatatcctgatctgataactgaaatcattgatgccaactctacaggcttggattatcaagaaataattatacctgcagagaaacgggtttctaatgctcggatgaagcaggaacttggtattaatctgcttcatccaacttatagatctggcctgcagagtatcattgatgcttggcaaattcaatctcaacttcccaatataagtcagtga

SEQ ID NO: 11702 - protein, 329 aa, Sorghum bicolor
  misc_feature: Ceres ANNOT ID no. 6028722
  misc_feature (24)..(239): Pfam Id: Epimerase Pfam Desc: NAD dependent epimerase/dehydratase family
  misc_feature (6)..(129): NCBI GI: 115435782 NCBI Desc: os01g0261500 [oryza sativa (japonica cultivar-group)]
  misc_feature (83)..(323): NCBI GI: 58697167 NCBI Desc: nucleoside-diphosphate-sugar epimerases [wolbachia endosymbiont of drosophila simulans]
  misc_feature (79)..(319): NCBI GI: 58584804 NCBI Desc: nucleoside-diphosphate-sugar epimerase [wolbachia endosymbiont strain trs of brugia malayi]
  misc_feature (27)..(315): NCBI GI: 118735259 NCBI Desc: nad-dependent epimerase/dehydratase [dinoroseobacter shibae dfl 12]
  misc_feature (23)..(317): NCBI GI: 88862313 NCBI Desc: nad-dependent epimerase/dehydratase [jannaschia sp. ccs1]
MIPGIAPKTAAAVPVAWAPQPRHMFVFGAGFVGRYVSERLLAQGWQVSGTCTSVNKKRELEMLGMNASVFDATESSLENIHNLRQATHLLISIPPIPGIGDPLLNLGEDLRRTLSHGNLEWLCYLSSTSVYGDCGGVLVDEDHTVNPKSESAKLRYNAEKGWLNLIDDLNLSAFIFRLGGIYGPGRSALDTLAKGKFLSQRQKLRESKQYTARIHVADIYQAVLASMCIRCARKIFNVVDDDPAPRAEVFAFARSLIQRRYPDLITEIIDANSTGLDYQEIIIPAEKRVSNARMKQELGINLLHPTYRSGLQSIIDAWQIQSQLPNISQ

SEQ ID NO: 11703 - DNA, 1203 bp, Sorghum bicolor
  misc_feature: Ceres ANNOT ID no. 6028763
  misc_feature: Encodes the peptide sequence at SEQ ID NO 11704
atgagccgccgccggggagagacctgcgactcgtggcggcccccgcggaagaaccacgccggggcgccgccgctcctccgcgcggggccccggattcccgccttcgcctcgctctccgtccgcgagggcggggacgccgctgccgccgtcgccaaggcggtcgaggaagtggtcgttgtccaggccgacgaggttaaggagcagagggcggctttggtggccgtggaggagagggcgaagacgaagtcgacggagcgcaggctgccccccgcggcgcagctggtgcaccatccgctcgcgctgctggcgctagtacccaacagcgccgcgctcttcgccgcgggggccgccgcgggcactatagccaagactgtcaccgcgccgctcgaccgcgtcaagatcctcatgcagacgcatagcgtgcgggtggcgggagagagcgccaagaagggtgttggatttctcgaggctatggcagacattgggaagaaggatgggcttaagggttactggaaaggcaaccttccacaggtcattcgcataattccttacagtgcggtgcagctcttctcgtatgaagtttacaagaaaattttccggacaaaggatggagagctttctgtatttgggagacttgctgctggtgcttgcgcgggcatgacatctacacttgtaacttacccactggatgttctccggctcaggctagcagttcaatctggacacagcactttacctcaggttgctcttaacatgctgagagaagaagggctggcctccttctatggaggcttgggtccatctcttatagcaattgcaccttacattgctgtgaacttctgtgtttttgacctaatgaagaaatctgtaccagagaagtacaagaatagaccagaaacatctctagcaactgctcttctttcagcaacatttgcaactttgatgtgttatcccctggacactattaggagacagatgcagatgaaaggcacaccatacaatacagtttttgatgctattccaggcattgtggagcgtgatggtctaactggtctttatagaggttttgtgccaaatgcattaaaaaatctaccaaatagcagcattaaaatgaccgtgtttgacacggtgaagacactgatagctaccgggcagaaggagatggacaaattaattcaagaaaatgaggagaaaacaagctag

SEQ ID NO: 11704 - protein, 400 aa, Sorghum bicolor
  misc_feature: Ceres ANNOT ID no. 6028763
  misc_feature (107)..(203): Pfam Id: Mito_carr Pfam Desc: Mitochondrial carrier protein
  misc_feature (207)..(294): Pfam Id: Mito_carr Pfam Desc: Mitochondrial carrier protein
  misc_feature (297)..(385): Pfam Id: Mito_carr Pfam Desc: Mitochondrial carrier protein
  misc_feature (97)..(397): NCBI GI: 145354682 NCBI Desc: mc family transporter [ostreococcus lucimarinus cce9901]
  misc_feature (70)..(380): NCBI GI: 145351536 NCBI Desc: mc family transporter [ostreococcus lucimarinus cce9901]
  misc_feature (114)..(387): NCBI GI: 92886800 NCBI Desc: adenine nucleotide translocator 1 [medicago truncatula]
  misc_feature (114)..(386): NCBI GI: 33598954 NCBI Desc: solute carrier family 25 member 24 isoform 1 [homo sapiens]
  misc_feature (114)..(386): NCBI GI: 46249805 NCBI Desc: solute carrier family 25 member 24, isoform 1 [homo sapiens]
  misc_feature: The sequence is a functional homolog of SEQ ID NO. 385 in the 11/188,298 US application
  misc_feature: The sequence is a functional homolog of SEQ ID NO. 398 in the 11/188,298 US application
  misc_feature: The sequence is a functional homolog of SEQ ID NO. 517 in the 11/188,298 US application
MSRRRGETCDSWRPPRKNHAGAPPLLRAGPRIPAFASLSVREGGDAAAAVAKAVEEVVVVQADEVKEQRAALVAVEERAKTKSTERRLPPAAQLVHHPLALLALVPNSAALFAAGAAAGTIAKTVTAPLDRVKILMQTHSVRVAGESAKKGVGFLEAMADIGKKDGLKGYWKGNLPQVIRIIPYSAVQLFSYEVYKKIFRTKDGELSVFGRLAAGACAGMTSTLVTYPLDVLRLRLAVQSGHSTLPQVALNMLREEGLASFYGGLGPSLIAIAPYIAVNFCVFDLMKKSVPEKYKNRPETSLATALLSATFATLMCYPLDTIRRQMQMKGTPYNTVFDAIPGIVERDGLTGLYRGFVPNALKNLPNSSIKMTVFDTVKTLIATGQKEMDKLIQENEEKTS

SEQ ID NO: 11705 - DNA, 906 bp, Sorghum bicolor
  misc_feature: Ceres ANNOT ID no. 6028771
  misc_feature: Encodes the peptide sequence at SEQ ID NO 11706
atggtgcttctgcgcgtctgccaccgcttcggccgccccccgcgcttcccctccttcctctccatggcggcgccccagcaacctgctcccctctccgggtcggcgcccaagaggttcagggcgatggccacagacgtcgcggcggcggcggtggatcctccagccgccaggggctgccccgctatgaaggcggagttcgccaagcacgccgagtacctcaacgccctgaatgacaagagagaaaggcttgtgaaagctagtcgggatgtgacaatgaacagcaaaaaggtcatctttcaggtccacagaatcacgaaagttaacagggacgaagttctctccaaggcagaaaatgatcttgctgcagtggttaatcaatacattgcaaaactagtaaaagaattacaaggaactgacttctggaagctcagaagagcctacacctttggtgtacaagaatatgtcgaagctgcaacactgtgtagattttgcaagactggcactctattaagtcttgctgaaattaatgattctttactagcactaagtgataaatctgttgagcccttacagttaaatgtgcttgactatcttttaggggttgctgatttgtcaggagagcttatgaggctcgcaataggccgtatatctgatggggaagttgaatatgcaaaaactatctgtgcttttgtacgtgatatttacagggagctgactcttgtggtacctctaatggatgacaataatgagatgaagaagaaaatggaggtcatgctgcaaagtgtagtaaaaattgagaatgcttgcttcagtgttcatgtgagaggttcagagtacattcctctgctaggatcatcaggagacccagattattcctttttcggtgcctcagactttgaccaatga

SEQ ID NO: 11706 - protein, 301 aa, Sorghum bicolor
  misc_feature: Ceres ANNOT ID no. 6028771
  misc_feature (77)..(277): Pfam Id: Translin Pfam Desc: Translin family
  misc_feature (61)..(300): NCBI GI: 92894686 NCBI Desc: translin [medicago truncatula]
  misc_feature (61)..(180): NCBI GI: 49522517 NCBI Desc: translin-associated factor x [xenopus tropicalis]
  misc_feature (48)..(281): NCBI GI: 24459912 NCBI Desc: translin associated factor x [takifugu rubripes]
  misc_feature (61)..(180): NCBI GI: 32450090 NCBI Desc: mgc64311 protein [xenopus laevis]
  misc_feature (202)..(300): NCBI GI: 24954860 NCBI Desc: translin-associated factor x; i-2int5 [lycopersicon esculentum]
MVLLRVCHRFGRPPRFPSFLSMAAPQQPAPLSGSAPKRFRAMATDVAAAAVDPPAARGCPAMKAEFAKHAEYLNALNDKRERLVKASRDVTMNSKKVIFQVHRITKVNRDEVLSKAENDLAAVVNQYIAKLVKELQGTDFWKLRRAYTFGVQEYVEAATLCRFCKTGTLLSLAEINDSLLALSDKSVEPLQLNVLDYLLGVADLSGELMRLAIGRISDGEVEYAKTICAFVRDIYRELTLVVPLMDDNNEMKKKMEVMLQSVVKIENACFSVHVRGSEYIPLLGSSGDPDYSFFGASDFDQ

SEQ ID NO: 11707 - DNA, 1530 bp, Sorghum bicolor
  misc_feature: Ceres ANNOT ID no. 6028860
  misc_feature: Encodes the peptide sequence at SEQ ID NO 11708
atggaggaggaggaccggctgagcagcctccccgacgacctcctccacgccatcctccgcggcctcccgctgaagcaggccgtccgcaccagcgcgctctcccggcggtgggcgagccagtggctccgcgcgctggccgcctcccgggtgctcgacctcacggaccgagacttcgcccgcggccagccgccggcgcgggccgcggccacggtgagccgctgcctccggctccacgccgagcacggcgcgccgctcgacgtgctccgcgtggcgctggcgtccccgccgtcgtcaggggcagcagggccgagcgacggctcgttcgggcgggacgtcgtcgggtggatcgcggccgccgtgaggaggggcgccagggaggtcgaggtggacgtcctgcacctgacggcgttcctggagctggagctccccggcgacctgttccaggtcaggaactcgctggagcgggtggcgctcggcgggctcagcctccgcgccgtccctctccccgcggcgggcctcgctggcctccgctcgctctccctcagccacgccgacgtcaccgacgaggcggtccggggcattctcgccagctgcggggcgctggagtccctcagcctccggagctgctccctgcccacctcggtgagtatcgccagcgagcggctgcgggacctgcagctcctgggctgccgcgccgtgctgcaagagctccgggtcgccgcgctcgcgctggagtcgctcaccctgtacggccaagtctgctggagagaacctgagcagatctggcaagaggcctaccctgttttcttcgacttcggcaacatgccggcgctgcgggacgcgtacctgtcgcacgtcggctgcggcgactacaacatcgtccacgacatggcctacccttacctctactacgtcgtcgcgcatgcccggatcttgacgctttgctccatcggcttgctgcttctttaccagcacggctgggatgagagcgcattcagggagatgccgaagctagaagagctgcagctgctgctggcctccccaccagagccctgtttctaccggagcaatgaagaccaggagcatgtgtccagtttcttcatgctcaccccacttcccgtcctccagcgtctctttctccgtctccccagcgatcctggatacggatggagcagctcggcagcagcgcgggacgaggagaccgacgacgcagacatgacactcgagcacgagatcgtccttggccagctgaccttcatcaaggttgtgaattttagggggacaaggcgagagctgcggctgcttgccttcttcctgaagagggcccctagcctggagcagctggtgctggtcacgccggaagaagaggaagctcccgcagacctaaaggccatgcgagagagggtgtcagagttgcagaggcctcgccgcgaggcacgcgtctccgtgtgccggcccaaggaagacgatagcccgaaccatgcacacaccaggatcttccacgaggatgatgagtatatatgtgactaa

SEQ ID NO: 11708 - protein, 509 aa, Sorghum bicolor
  misc_feature: Ceres ANNOT ID no. 6028860
  misc_feature (5)..(52): Pfam Id: F-box Pfam Desc: F-box domain
  misc_feature (4)..(261): NCBI GI: 53793450 NCBI Desc: ribosomal rna apurinic site specific lyase-like [oryza sativa (japonica cultivar-group)]
  misc_feature (2)..(129): NCBI GI: 115475193 NCBI Desc: os08g0197500 [oryza sativa (japonica cultivar-group)]
  misc_feature (5)..(57): NCBI GI: 42567605 NCBI Desc: f-box family protein [arabidopsis thaliana]
  misc_feature (5)..(229): NCBI GI: 115457298 NCBI Desc: os04g0208600 [oryza sativa (japonica cultivar-group)]
  misc_feature (4)..(250): NCBI GI: 53793449 NCBI Desc: ribosomal rna apurinic site specific lyase-like [oryza sativa (japonica cultivar-group)]
MEEEDRLSSLPDDLLHAILRGLPLKQAVRTSALSRRWASQWLRALAASRVLDLTDRDFARGQPPARAAATVSRCLRLHAEHGAPLDVLRVALASPPSSGAAGPSDGSFGRDVVGWIAAAVRRGAREVEVDVLHLTAFLELELPGDLFQVRNSLERVALGGLSLRAVPLPAAGLAGLRSLSLSHADVTDEAVRGILASCGALESLSLRSCSLPTSVSIASERLRDLQLLGCRAVLQELRVAALALESLTLYGQVCWREPEQIWQEAYPVFFDFGNMPALRDAYLSHVGCGDYNIVHDMAYPYLYYVVAHARILTLCSIGLLLLYQHGWDESAFREMPKLEELQLLLASPPEPCFYRSNEDQEHVSSFFMLTPLPVLQRLFLRLPSDPGYGWSSSAAARDEETDDADMTLEHEIVLGQLTFIKVVNFRGTRRELRLLAFFLKRAPSLEQLVLVTPEEEEAPADLKAMRERVSELQRPRREARVSVCRPKEDDSPNHAHTRIFHEDDEYICD

SEQ ID NO: 11709 - DNA, 1179 bp, Sorghum bicolor
  misc_feature: Ceres ANNOT ID no. 6028956
  misc_feature: Encodes the peptide sequence at SEQ ID NO 11710
atggactgctccaagaacgagggcgcggtggcagtggccgccctccccgacgaccccctggtggagatcctctcccgcgtccctgcaaagtccgtctgccggttcaagtgcgtctccaaggcctggcgcgacctcattgcggaccctcaccaccggaagaagctcccccaagcaatgcaaggactcttcttcatggtgccagaggaccttatcgatgtcagtttcagtttcatcgatctgacagcgaggtccgtgcctccagacatcgaccctgccttctccttcctgaaagaacggcctggattccagttccacaaccttggcttcctggactcctgcaacggtcttatcctcttcaagaaccaccaggagccgccgtattctgatgcagtgggctatgttgtctgcaacccgaccactaagagatgggcagccgtgccgacttgtggctctctggatctgacaacctgcacctatttagctttcgatcaggccatatcctctcacttccacttggtccagttccagatatatgtgccgggcgagatgttggtgtcgctgcatgtttactcatctgaaactgggacctggagtggcaaccaaattggctctcaagaaaatcaaggaccattggcagagtggcatcatcggagcatagtatctcgtaaggaacctgagtgtgcctttgttaatggcttcctgcatttcatagttggggactcatatcaacatcagatagttgctgtagatgtgcaaggaaaggcaagaagggtgatcacagtgccaggtgtggctgatgggaggcaccggtattgttatttaggccagtcccaagggtgcctgcattacatgactcaggaaatgtttgatgataaaaaagacaggtgcgaactgtgcatctgggttcttcaggattatgatacacaatgggtgttgaaggacactgtaagcgccctgaagatctttggacactatactagggacattttgcacttcatcgttggcattcatcaagatcgtaatgtggtcttttttcagtccctgaggagtaatctgatagcatatgacatggaccataaggaagtgagtgttattaccactttcgatgttctgaaaaagccgctccgttttgttcattatgttccctgtttctcagaatccccggctctcacaaattag

SEQ ID NO: 11710 - protein, 392 aa, Sorghum bicolor
  misc_feature: Ceres ANNOT ID no. 6028956
  misc_feature (10)..(57): Pfam Id: F-box Pfam Desc: F-box domain
  misc_feature (15)..(389): NCBI GI: 115462391 NCBI Desc: os05g0177100 [oryza sativa (japonica cultivar-group)]
  misc_feature (15)..(315): NCBI GI: 115462393 NCBI Desc: os05g0177400 [oryza sativa (japonica cultivar-group)]
  misc_feature (103)..(387): NCBI GI: 50508392 NCBI Desc: receptor-like kinase-like [oryza sativa (japonica cultivar-group)]
  misc_feature (11)..(315): NCBI GI: 115462373 NCBI Desc: os05g0175800 [oryza sativa (japonica cultivar-group)]
  misc_feature (15)..(174): NCBI GI: 117670145 NCBI Desc: f-box-like protein [hordeum vulgare]
  misc_feature: The sequence is a functional homolog of SEQ ID NO. 456 in the 11/188,298 US application
MDCSKNEGAVAVAALPDDPLVEILSRVPAKSVCRFKCVSKAWRDLIADPHHRKKLPQAMQGLFFMVPEDLIDVSFSFIDLTARSVPPDIDPAFSFLKERPGFQFHNLGFLDSCNGLILFKNHQEPPYSDAVGYVVCNPTTKRWAAVPTCGSLDLTTCTYLAFDQAISSHFHLVQFQIYVPGEMLVSLHVYSSETGTWSGNQIGSQENQGPLAEWHHRSIVSRKEPECAFVNGFLHFIVGDSYQHQIVAVDVQGKARRVITVPGVADGRHRYCYLGQSQGCLHYMTQEMFDDKKDRCELCIWVLQDYDTQWVLKDTVSALKIFGHYTRDILHFIVGIHQDRNVVFFQSLRSNLIAYDMDHKEVSVITTFDVLKKPLRFVHYVPCFSESPALTN

SEQ ID NO: 11711 - DNA, 645 bp, Sorghum bicolor
  misc_feature: Ceres ANNOT ID no. 6029025
  misc_feature: Encodes the peptide sequence at SEQ ID NO 11712
atggcgaagcgccgccgctcgtcgtcgtcccttcccctggccctgctgccgccgctgctgctgctgcttctacttgcagccggatcgctcgcagtggcagccgcgcttgacagctccccggaggcacgtcgtggtcgaagcctgcagcagctgccaacccctgtgccacagccgcagccaaccccagtgccacagcccctgccgcaaccaaatccaaatccaaacccacagccgcagccccttccacagcccgatccaaacccacagcctctgcctcagcccctaccgcagcccgatccaaacccacagcctctgcctcagcccctcccacaaccacagccaggcccaatcccgccgcagcctctgccgcagcccgacccaaacccacagcccgtaccacagcccctcccacaaccacagccaggcccaatcccgccgcagcctttgccgcagcctgacccaaaccagcctctgccacagccgcagccggcaccggggacccaacctgtttcgacccaaaatccacaaccgcaggctgaccagctctctggaggtccgcagccactctcggacggcggattaagaatgttgaacctgcagtacgtgaagtacatatttttagatcttatcgttctgatactgtaa

SEQ ID NO: 11712 - protein, 214 aa, Sorghum bicolor
  misc_feature: Ceres ANNOT ID no. 6029025
  misc_feature (52)..(198): NCBI GI: 90022595 NCBI Desc: periplasmic protein tonb links inner and outer membranes-like [saccharophagus degradans 2-40]
  misc_feature (24)..(188): NCBI GI: 21842 NCBI Desc: proline-rich protein [triticum aestivum]
  misc_feature (52)..(194): NCBI GI: 7861746 NCBI Desc: gaba-a receptor epsilon-like subunit [mus musculus]
  misc_feature (52)..(194): NCBI GI: 7861753 NCBI Desc: gaba-a receptor epsilon-like subunit [mus musculus]
  misc_feature (49)..(188): NCBI GI: 122889700 NCBI Desc: gamma-aminobutyric acid (gaba-a) receptor, subunit epsilon [mus musculus]
MAKRRRSSSSLPLALLPPLLLLLLLAAGSLAVAAALDSSPEARRGRSLQQLPTPVPQPQPTPVPQPLPQPNPNPNPQPQPLPQPDPNPQPLPQPLPQPDPNPQPLPQPLPQPQPGPIPPQPLPQPDPNPQPVPQPLPQPQPGPIPPQPLPQPDPNQPLPQPQPAPGTQPVSTQNPQPQADQLSGGPQPLSDGGLRMLNLQYVKYIFLDLIVLIL

SEQ ID NO: 11713 - DNA, 693 bp, Sorghum bicolor
  misc_feature: Ceres ANNOT ID no. 6029338
  misc_feature: Encodes the peptide sequence at SEQ ID NO 11714
atggagcaggaggaggaggcgtgctcgtcttacggctcctcttcgctgcggcagtgcaggatttgccatgacgaggaggacgagcggcgctccgccatggagtcgccctgcgcctgctccggctccctcaagtatgctcacaggggatgcgtgcagagatggtgcgacgagaagggcagcaccatctgcgagatttgccttcagaactttgagccgggctacaccgttcctcccaagaaaacccaacctgctgatgtcgcggtcaccatcagagacagcgtggaggtgcccaggctgcagtacgagcccgaggaggatgacgcggcgttgattggagccagcgatcccgagtacgccgagtgcgcccgcgccgccggcaggagcgcgtcctggtgccgctccgtggccgtcacgttcacgatcgtcctgctgctgaggcacctggtcaccgtggtgacggtcggagcggccaaccagttcgccttcagcctcctcacagtatacttgctgcgggccagtgggatcttgcttccgttctacgttgtcatgaggctcatctccgtgatccagcagggacagaagcagtaccgcctgcagctgctccaggagcagaggagacacgcgctgagattggcccggctgcacggtcaggaacaacggcagcagcaacagcatgtcatcctggtacgctga

SEQ ID NO: 11714 - protein, 230 aa, Sorghum bicolor
  misc_feature: Ceres ANNOT ID no. 6029338
  misc_feature (19)..(66): Pfam Id: zf-C3HC4 Pfam Desc: Zinc finger, C3HC4 type (RING finger)
  misc_feature (1)..(230): NCBI GI: 52077476 NCBI Desc: zinc finger protein-like [oryza sativa (japonica cultivar-group)]
  misc_feature (1)..(230): NCBI GI: 115436152 NCBI Desc: os01g0303600 [oryza sativa (japonica cultivar-group)]
  misc_feature (9)..(222): NCBI GI: 115463379 NCBI Desc: os05g0355300 [oryza sativa (japonica cultivar-group)]
  misc_feature (14)..(196): NCBI GI: 92867998 NCBI Desc: zinc finger, ring-type; ringv [medicago truncatula]
  misc_feature (16)..(226): NCBI GI: 4741923 NCBI Desc: pit1 [arabidopsis thaliana]
MEQEEEACSSYGSSSLRQCRICHDEEDERRSAMESPCACSGSLKYAHRGCVQRWCDEKGSTICEICLQNFEPGYTVPPKKTQPADVAVTIRDSVEVPRLQYEPEEDDAALIGASDPEYAECARAAGRSASWCRSVAVTFTIVLLLRHLVTVVTVGAANQFAFSLLTVYLLRASGILLPFYVVMRLISVIQQGQKQYRLQLLQEQRRHALRLARLHGQEQRQQQQHVILVR

SEQ ID NO: 11715 - DNA, 411 bp, Sorghum bicolor
  misc_feature: Ceres ANNOT ID no. 6029354
  misc_feature: Encodes the peptide sequence at SEQ ID NO 11716
atggcaagcttcaaccaagacagcagagcagccccacaaagggaggaggcacctgtacagagcaagtacggaggcatttctccaaagaaacccctcatcaacaaggaccacgagcgcgcctacttcgactccgcagactgggtcctcggcaaggtaaaccagaaacgaaaccaaggaaaaataacccgcgaaacagcagcaaatatccacgaactggttgcgccggtctgcagactcgtactaaccccgcttgaccttatcggtgtctcgtgtctgcagcaaggcgcgagcagcaacagcacgacgacgacaacgacgacagtccccgccgccgagcccctcaagcccaagctgcagcggacggcgtaccaccagcttccccctcgacggccggcgtgcacgtcagagtag

SEQ ID NO: 11716 - protein, 136 aa, Sorghum bicolor
  misc_feature: Ceres ANNOT ID no. 6029354
  misc_feature (20)..(103): Pfam Id: Lg106 Pfam Desc: Lg106-like protein
  misc_feature (1)..(58): NCBI GI: 144923064 NCBI Desc: lg106-like [medicago truncatula]
  misc_feature (1)..(64): NCBI GI: 115436166 NCBI Desc: os01g0305200 [oryza sativa (japonica cultivar-group)]
  misc_feature (11)..(51): NCBI GI: 115439027 NCBI Desc: os01g0664500 [oryza sativa (japonica cultivar-group)]
  misc_feature (11)..(51): NCBI GI: 115465489 NCBI Desc: os05g0566600 [oryza sativa (japonica cultivar-group)]
  misc_feature (19)..(61): NCBI GI: 4164473 NCBI Desc: negatively light-regulated protein [vernicia fordii]
MASFNQDSRAAPQREEAPVQSKYGGISPKKPLINKDHERAYFDSADWVLGKVNQKRNQGKITRETAANIHELVAPVCRLVLTPLDLIGVSCLQQGASSNSTTTTTTTVPAAEPLKPKLQRTAYHQLPPRRPACTSE

SEQ ID NO: 11717 - DNA, 1506 bp, Sorghum bicolor
  misc_feature: Ceres ANNOT ID no. 6029460
  misc_feature: Encodes the peptide sequence at SEQ ID NO 11718
atggctcgtctccgctgcctcttggtcgccttcgtcgtattcgcggccgccctccgcctgccaggcgacgccattgcctcccgcgggcaccacggccccgccgcgcacgactacagggacgcgctcgccaagtccatcctcttcttcgagggccagcggtccggcaagctgccgccgtcgcagcgcgtgtcgtggcgcagggactcgggcctctccgacggctccgccgccaaggtggacctggtgggcgggtaccacgacgccggcgacaacgtcaagttcgggttcccgatggcgttcagcatgacgatgctggcgtggagcgtggtggagttcggtggcctcatgaagtcggagctgccgcacgccagggatgccgtccgctggggcgccgactacctgctcaaggccacggcgcacccggacaccatctacgtccaggttggtgacgcgaccaaggaccacgcgtgctgggagcgtccggaggacatggacaccccgaggacggtgtacaaggtggacgcgcgcaccccaggctccgacgtcgccgccgagaccgccgccgcgctcgccgctgcctccctcgtcttccgcaagtccgacccagcctacgccagccgcctcgtcgccagagccaagcgtgtgttcgagttcgccgacaagcaccggggcgcctacagcacgggcctggccgcggacgtgtgcccgtactactgctcctactccgggtaccaggacgagctgctgtggggcgcggcgtggctgcaccgcgccaccaggagcgccacgtacctgagctacatccagagcaacggcgccgtcctgggcgccgacgagtcggacaacacgttcgggtgggacaacaagcacgccggcgcgcgcgtcctcatcgccaagtcgttcctggtgcagcgccagggcgcgctccgcgagtacaagtcccacgccgacgggttcatctgctccatggtgcccggcacggccacggaccagacgcagtacacccgtggcgggctgctgttcaggctcagcgacagcaacatgcagtacgtgacgtccagcgctttcctgatgctcacctacgccaagtacctggcgttcgccaagaccacggtgcgctgcggcggcgtggccgtgacgccgcaccggctgcgcgccgtcgcgcggaggcaggtggactacctgctggggagcaacccgatggggatgtcgtacatggtgggctacggcggaaggtacccgcgccggatccaccaccgcgcctcgtcgctgccgtccgtggcggcgcacccgggtaggatcgggtgctcgcaggggttcaccgcgctgtacgcgggcggggccaacccgaacgtgctcgtcggcgccgtcgtcggcggacccgacatgcaggacaggttccccgacgagcggaacgaccacgagcactcggagccggccacctacatcaacgcgccgctcgtcggcgcgctcgcctacctcgcgcattcgtacggccagctctag

SEQ ID NO: 11718 - protein, 501 aa, Sorghum bicolor
  misc_feature: Ceres ANNOT ID no. 6029460
  misc_feature (37)..(492): Pfam Id: Glyco_hydro_9 Pfam Desc: Glycosyl hydrolase family 9
  misc_feature (1)..(501): NCBI GI: 115436218 NCBI Desc: os01g0312800 [oryza sativa (japonica cultivar-group)]
  misc_feature (1)..(501): NCBI GI: 75272525 NCBI Desc: endoglucanase 3 precursor (endo-1,4-beta glucanase 3) (osglu8)
  misc_feature (21)..(501): NCBI GI: 6009979 NCBI Desc: endo-1,4-beta-glucanase [pisum sativum]
  misc_feature (30)..(501): NCBI GI: 924622 NCBI Desc: endo-1,4-beta-glucanase precursor
  misc_feature (31)..(497): NCBI GI: 3025468 NCBI Desc: endo-beta-1,4-glucanase [pinus radiata]
  misc_feature (1)..(501): SWISSPROT Homolog: EC 3.2.1.4 Endoglucanase 3 precursor
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Useful for making plants with modulated heat sensitivity
  misc_feature: Useful for making plants with modulated nitrogen use efficiency
  misc_feature: Useful for making plants with modulated drought sensitivity
  misc_feature: GREAT-hit functional homolog of the protein sequence given in SEQ ID NO 13434
  misc_feature: GREAT-hit functional homolog of the protein sequence given in SEQ ID NO 13443
  misc_feature: GREAT-hit functional homolog of the protein sequence given in SEQ ID NO 13445
  misc_feature: Functional homolog of the protein sequence encoded by LOCUS at1g02800
  misc_feature: Functional homolog of the protein sequence encoded by LOCUS at4g09740
  misc_feature: Functional homolog of the protein sequence encoded by LOCUS at4g23560
  misc_feature: Useful for making plants with altered carbohydrate content
  misc_feature: Functional homolog of the protein sequence given in SEQ ID NO 13691
  misc_feature: Useful for biocontainment applications
  misc_feature: Useful for making plants with altered cell wall content and/or composition
  misc_feature: Useful for making plants with modulated nitrogen use efficiency
  misc_feature: Functional homolog of the protein sequence given in SEQ ID NO 13445
MARLRCLLVAFVVFAAALRLPGDAIASRGHHGPAAHDYRDALAKSILFFEGQRSGKLPPSQRVSWRRDSGLSDGSAAKVDLVGGYHDAGDNVKFGFPMAFSMTMLAWSVVEFGGLMKSELPHARDAVRWGADYLLKATAHPDTIYVQVGDATKDHACWERPEDMDTPRTVYKVDARTPGSDVAAETAAALAAASLVFRKSDPAYASRLVARAKRVFEFADKHRGAYSTGLAADVCPYYCSYSGYQDELLWGAAWLHRATRSATYLSYIQSNGAVLGADESDNTFGWDNKHAGARVLIAKSFLVQRQGALREYKSHADGFICSMVPGTATDQTQYTRGGLLFRLSDSNMQYVTSSAFLMLTYAKYLAFAKTTVRCGGVAVTPHRLRAVARRQVDYLLGSNPMGMSYMVGYGGRYPRRIHHRASSLPSVAAHPGRIGCSQGFTALYAGGANPNVLVGAVVGGPDMQDRFPDERNDHEHSEPATYINAPLVGALAYLAHSYGQL

SEQ ID NO: 11719 - DNA, 1491 bp, Sorghum bicolor
  misc_feature: Ceres ANNOT ID no. 6029903
  misc_feature: Encodes the peptide sequence at SEQ ID NO 11720
atggccaccgccgaaggcgacgccgactggtccctgccctcccccaccgacctcgatgacaacgggttcccggatctaccctgctcccccgccgcctctagcagctgcttcgcggaggacttctacagcagcggcaccgactggtcctccctgcgtgcccctccgccgctgcgcccgcccggaagggcacccggtgtgaaggagaaggagatgggaggcggttcgctcgtgcagagcagcctcctccaggcgtgggggatcgagaagccgcggcgggaggctggggattcatcgcttgtgcagaggagcctcttccaggcgtgggggatcgagaggccaccgagggaggggctcggggctgggcattcatccccctccccctcccgttccggttcttggttgggaaggaagcggaggcgaggaagcaccgaggaggagcgggtggcgcccaagaagcccctcgcgtgccccttctacaagaagattcccggcacaccattcacggtggatgcgtttcgctatggacaagttgaggggtgctcggcctatttccttagccattttcatcatgaccactacggtggattgaccaagaagtggtgtcatggccccatctattgttctgcactcactgcacgcttagtgaagatgtgtctgtcagtaaattccgactatatttatcctttggagcttgataccaattatgtcatagagggagtgacagttaccttgttagaggccaaccattgccctggtgcagctctaatccacttccaactaagtgatggaaagacctatctccacactggggattttagagcatcaaaatcaatgcaattgcatccacttctccagagaggcagggtaaatttggtttacctggacacaacatattgcaatcccaaatacaagttcccaccccaggaggatgttattgattttgttgtgaggacagctcaaagatatctaaagaaacagccaaaaaccctcattgttgttggggcgtatagcattgggaaagagaatgtgtatctagcaatttcccaagctttagaggtccctatatacactgatgcatcaaggaggcggattcttcactcatttggctggtcagacttatccaaaaggatatgctcatgcaatcaaagttcaccactacatgttctgccccttggatctgtaaatcatgagaacttgaagaagtacttggagactcttagtggaagatttctagctgtgctggcttttcggcctacaggttggactttctctgaggcaactggaaagcatcttgacctaataaaaccaagttgtaatggcagtgtaacaatctatggtgtgccttatagcgagcattcaagtttcactgagcttcgggattttgtgatgtttctgagacctcaaaaggtaattcctactgttaatgttggcaacgcaacaagccgagataaaatgcaagcacatttccgggaatggctgaagagcctgtga

SEQ ID NO: 11720 - protein, 496 aa, Sorghum bicolor
  misc_feature: Ceres ANNOT ID no. 6029903
  misc_feature (376)..(475): Pfam Id: DRMBL Pfam Desc: DNA repair metallo-beta-lactamase
  misc_feature (88)..(496): NCBI GI: 38345210 NCBI Desc: osjnbb0012e08.8 [oryza sativa (japonica cultivar-group)]
  misc_feature (88)..(496): NCBI GI: 116309317 NCBI Desc: osigba0155k12.7 [oryza sativa (indica cultivar-group)]
  misc_feature (88)..(483): NCBI GI: 56798256 NCBI Desc: snm1 [oryza sativa (japonica cultivar-group)]
  misc_feature (78)..(494): NCBI GI: 1495267 NCBI Desc: orf12 [arabidopsis thaliana]
  misc_feature (18)..(494): NCBI GI: 87241310 NCBI Desc: dna repair metallo-beta-lactamase [medicago truncatula]
MATAEGDADWSLPSPTDLDDNGFPDLPCSPAASSSCFAEDFYSSGTDWSSLRAPPPLRPPGRAPGVKEKEMGGGSLVQSSLLQAWGIEKPRREAGDSSLVQRSLFQAWGIERPPREGLGAGHSSPSPSRSGSWLGRKRRRGSTEEERVAPKKPLACPFYKKIPGTPFTVDAFRYGQVEGCSAYFLSHFHHDHYGGLTKKWCHGPIYCSALTARLVKMCLSVNSDYIYPLELDTNYVIEGVTVTLLEANHCPGAALIHFQLSDGKTYLHTGDFRASKSMQLHPLLQRGRVNLVYLDTTYCNPKYKFPPQEDVIDFVVRTAQRYLKKQPKTLIVVGAYSIGKENVYLAISQALEVPIYTDASRRRILHSFGWSDLSKRICSCNQSSPLHVLPLGSVNHENLKKYLETLSGRFLAVLAFRPTGWTFSEATGKHLDLIKPSCNGSVTIYGVPYSEHSSFTELRDFVMFLRPQKVIPTVNVGNATSRDKMQAHFREWLKSL

SEQ ID NO: 11721 - DNA, 1443 bp, Sorghum bicolor
  misc_feature: Ceres ANNOT ID no. 6030242
  misc_feature: Encodes the peptide sequence at SEQ ID NO 11722
atggagcagctacctgacgacatgctcgccgatgtcctgggccgcctgccgcccagcagtctagcggcgtcacgctgcgtctgcaagcactggtgctccatcatcgacgctcggtgcctcctccgcgccgacctcctcccgctccgcctcgacgccttctactgcatctccgtcgacaccatcgacaggctgacgtatttcttcgcatctccttgggcggcgcgtcgaatccccggcggctgccttgacttcttgaaaaattacgagaatgtggaagtggaggatcactgcaatggtctgctcttgatgtatgacatggtggtcaaccctgccacacgcgaatgggccaacttgcctacctctccggaaccatccattagcgacatgcttggggtcaaggtctgggccgatcccacgacggatcaggatcaggatcaggagaaggacaaccacgacttgttgtatccaagcttttaccttgtgtacgatcccgtggcggagtcgccgcagcactttgaggtatttcttgtccccttattatttgtccatgttctgctggacaatcgggaaaacatcgccatcgacattgacgaccaagaatggccgccatcgacattgagaatccacgtcttctcgtcgaggagatggaggtgggaagtgaggtcttgggtccgccagggggagcctgccgggaccatggctgatatgctgcaagacgattgctgggaccgcaaggccgtctatttccggggagctctctatgtgcattgtcaaaatgattctctcatgaggatagccttgtccaatgacaagtaccaaatgatgaaacctccggcaacaggtggcgaacttgctggtaaggttgataccttttatttgggaaaatcagagaaaggagtatactctgccttactgtattgggtaggtcactgccttcaccttcgagtctggatccttaaggaagaagaagacaaagaaaatgataacatgattcacatggagtgggtgttgaagactaacatcagccttccaccgctgcttgcaaatagtcctcctcataattatcacagcggctttgctgctgctgatgatgatgatgaatggagggtcatccgcaactataataacaaggaggaagtaccacctgctactgcacatggcgacgatgatgaatgggactttgacaatgctgacattgtcctcgatgaggccaaagataataagctcactaaagcagacaggcactactctattcagttcatcggatttcatccttacaaggagattgtcttcttttacgtaccatctggggcagtatcttataatttgaatacctcaaagtttcaacggttgggcgcacgtataagtataccagtgggcatgagaacctgcttcccgtacatgccaggctggatacggggattatttgaaaacactttataa

SEQ ID NO: 11722 - protein, 480 aa, Sorghum bicolor
  misc_feature: Ceres ANNOT ID no. 6030242
  misc_feature (1)..(46): Pfam Id: F-box Pfam Desc: F-box domain
  misc_feature (148)..(457): NCBI GI: 53370641 NCBI Desc: f-box domain containing protein [oryza sativa (japonica cultivar-group)]
  misc_feature (159)..(476): NCBI GI: 115456876 NCBI Desc: os04g0113000 [oryza sativa (japonica cultivar-group)]
  misc_feature (159)..(476): NCBI GI: 116308824 NCBI Desc: osigba0112g01.1 [oryza sativa (indica cultivar-group)]
  misc_feature (159)..(366): NCBI GI: 50508587 NCBI Desc: protein with f-box domain-like [oryza sativa (japonica cultivar-group)]
  misc_feature (157)..(342): NCBI GI: 57900269 NCBI Desc: f-box domain containing protein-like [oryza sativa (japonica cultivar-group)]
MEQLPDDMLADVLGRLPPSSLAASRCVCKHWCSIIDARCLLRADLLPLRLDAFYCISVDTIDRLTYFFASPWAARRIPGGCLDFLKNYENVEVEDHCNGLLLMYDMVVNPATREWANLPTSPEPSISDMLGVKVWADPTTDQDQDQEKDNHDLLYPSFYLVYDPVAESPQHFEVFLVPLLFVHVLLDNRENIAIDIDDQEWPPSTLRIHVFSSRRWRWEVRSWVRQGEPAGTMADMLQDDCWDRKAVYFRGALYVHCQNDSLMRIALSNDKYQMMKPPATGGELAGKVDTFYLGKSEKGVYSALLYWVGHCLHLRVWILKEEEDKENDNMIHMEWVLKTNISLPPLLANSPPHNYHSGFAAADDDDEWRVIRNYNNKEEVPPATAHGDDDEWDFDNADIVLDEAKDNKLTKADRHYSIQFIGFHPYKEIVFFYVPSGAVSYNLNTSKFQRLGARISIPVGMRTCFPYMPGWIRGLFENTL

SEQ ID NO: 11723 - DNA, 1443 bp, Sorghum bicolor; identical to SEQ ID NO: 11721
  misc_feature: Ceres ANNOT ID no. 6030245
  misc_feature: Encodes the peptide sequence at SEQ ID NO 11724

SEQ ID NO: 11724 - protein, 480 aa, Sorghum bicolor; identical to SEQ ID NO: 11722
  misc_feature: Ceres ANNOT ID no. 6030245
  misc_feature (1)..(46): Pfam Id: F-box Pfam Desc: F-box domain
  misc_feature (148)..(457): NCBI GI: 53370641 NCBI Desc: f-box domain containing protein [oryza sativa (japonica cultivar-group)]
  misc_feature (159)..(476): NCBI GI: 115456876 NCBI Desc: os04g0113000 [oryza sativa (japonica cultivar-group)]
  misc_feature (159)..(476): NCBI GI: 116308824 NCBI Desc: osigba0112g01.1 [oryza sativa (indica cultivar-group)]
  misc_feature (159)..(366): NCBI GI: 50508587 NCBI Desc: protein with f-box domain-like [oryza sativa (japonica cultivar-group)]
  misc_feature (157)..(342): NCBI GI: 57900269 NCBI Desc: f-box domain containing protein-like [oryza sativa (japonica cultivar-group)]

SEQ ID NO: 11725 - DNA, 789 bp, Sorghum bicolor
  misc_feature: Ceres ANNOT ID no. 6030414
  misc_feature: Encodes the peptide sequence at SEQ ID NO 11726
atggacgagatggcggcggcgacagcgcgctcccaggccgccgccgtcgtcgtcgtccccgccgcgcggccctcctcccctccccgcgcctccatccccgtcgtctcttcctccgcctccgcgccttcccagcaaaccgctgctgccgccaagctcccattattctccgcggcggtgcccgcgtccacctccgccgcctcgggctccatctccgtccctatacctatcgcctccgacgggttaggccccgagcccagcacgctcaccgagcccgtctgggacaccgtcaagcgcgacctcgcccgcatcgtcagcaacctcaagctcgttgtcttccccaacccgttccgcgacgaccctggcaaggcgctgcgcgactgggacctctggggccccttcttcttcatcgtcttactcggactcatcctctcctggtcggccaccgccgccaagtctcaagtgttcgctgttgcttttgccgtattagctgctggtgctatagttctcacactcaatgttctactgctgggtggccacatcatcttcttccaaagcctcagccttctcggatactgtctgttcccgctggatgtgggggctctgatctgcatgcttaaggacagtgtcatactaaagatggtcgtggtgacgataacattggcatggagctcttgggcagcataccccctcatgagtgctgctgttaacccaaagagaaaggccctggcgctgtatcccgtgttcctcatgtacatctcagtcgcctgtctcataattgctatagattaa

SEQ ID NO: 11726 - protein, 262 aa, Sorghum bicolor
  misc_feature: Ceres ANNOT ID no. 6030414
  misc_feature (96)..(243): Pfam Id: Yip1 Pfam Desc: Yip1 domain
  misc_feature (86)..(252): NCBI GI: 89284456 NCBI Desc: yip1 domain containing protein [tetrahymena thermophila sb210]
  misc_feature (53)..(259): NCBI GI: 122891159 NCBI Desc: yip1 domain family, member 6 [danio rerio]
  misc_feature (68)..(259): NCBI GI: 50344846 NCBI Desc: zgc:86904 [danio rerio]
  misc_feature (35)..(259): NCBI GI: 119625782 NCBI Desc: yip1 domain family, member 6, isoform cra_b [homo sapiens]
  misc_feature (50)..(260): NCBI GI: 24581631 NCBI Desc: cg3652-pa [drosophila melanogaster]
MDEMAAATARSQAAAVVVVPAARPSSPPRASIPVVSSSASAPSQQTAAAAKLPLFSAAVPASTSAASGSISVPIPIASDGLGPEPSTLTEPVWDTVKRDLARIVSNLKLVVFPNPFRDDPGKALRDWDLWGPFFFIVLLGLILSWSATAAKSQVFAVAFAVLAAGAIVLTLNVLLLGGHIIFFQSLSLLGYCLFPLDVGALICMLKDSVILKMVVVTITLAWSSWAAYPLMSAAVNPKRKALALYPVFLMYISVACLIIAID

SEQ ID NO: 11727 - DNA, 1563 bp, Sorghum bicolor
  misc_feature: Ceres ANNOT ID no. 6030467
  misc_feature: Encodes the peptide sequence at SEQ ID NO 11728
atggcgcaaggtgaggagagttcgtggtgcatgacaagtagtgatcatggtagagctgcatcattcagccaagcaattgcatgtggatcccaaaggcgtgcttctgctgcacaacctgccaatttcttggagttgcaacctgcagctgctccttattactttggtgagttggaggaggcccttatccatggcacccgtacttctgttgatcacggcatgatcggaagtgatgtggacacagagtcagctggataccttgcagctaggccccccacactggagatcttcccttcatggccaatgagtcatctacagcagccatacagtggtaactcgcactcagtagggagcaccactgactcgagctcaggtcagaacagtatgccacagaccgagttggtgtccccagggagcatgagggccgactctgggcagcggcaggaagttttgatggtgaccgttgatgactacaactacgagcaaggactcggagcggcagcaaccacagctcaaatctttcagcagcatgcggcaggccaagacaagggaaagcatggatccacaagaaaagacggcaagctgttagatgccaagactgagaggcgattggctcagaacagagaagctgcaagaaagagcaggctgagaaaaaaggcctatgtacagcagttggagacaagtcggattaggcttcagcaaattgaacaagagctgcatggagcacgttcacagggtctgttcccgggaggaggcggtgcacctggagatttgagttcaggcgctgtgatttttgacatggagtatgcccggtggttagaagatgacaccaagcacatgacagagctccaggccgtgctgcagcctcaaattattgatgcgaacctgggggccatcgttgaagagtgcatgcggcactatgatgagctgttccacctgagggctatgcttgcaagatccgatgtgttccacctgatgactggcttgtgggcaactacagctgagcgatgcttcctctggatgggcggctttcgtccttctgaaatcctcaagatgctgataccgcagcttgatcctcttacggagccgcagctactagggatgtacaatctgcaacggtcgtcggagcagactgaggaggcgcttgggcaggggcttcagcagctgcaccagtcgcttgcggatgcagtgggcgctagtcctctcagtgacggtgcaaatgttgccaactacactgctctcatggccctagcactcgacaggctcgacacccttgagagcttttaccgtcaggcggacagtctgaggcagcagacgttgcaccagatgcggcggatcctgacgactcgccagacggctcggtgcttcctctccatcagcgagtatcaccgccgcctccgcgcgctcagctccgtctgggcctcccgccctccaaccgagagcagcgtcgccgccgccgccgccgccgccggtgcagagaatgtcagccctgctacagggacgacgagcgagcaagctgctctccgtccgtacaatcaccaaagccagcagttccctggcttctga

SEQ ID NO: 11728 - protein, 520 aa, Sorghum bicolor
  misc_feature: Ceres ANNOT ID no. 6030467
  misc_feature (42)..(520): NCBI GI: 115464157 NCBI Desc: os05g0443900 [oryza sativa (japonica cultivar-group)]
  misc_feature (82)..(520): NCBI GI: 2865394 NCBI Desc: basic leucine zipper protein [zea mays]
  misc_feature (181)..(520): NCBI GI: 28630433 NCBI Desc: liguleless2-like protein [zea mays]
  misc_feature (46)..(476): NCBI GI: 14272369 NCBI Desc: bzip transcription factor [arabidopsis thaliana]
  misc_feature (46)..(476): NCBI GI: 110743634 NCBI Desc: bzip protein atbzip21 [arabidopsis thaliana]
  misc_feature: The sequence is a functional homolog of SEQ ID NO 1016 in the 10/225,066US patent application
  misc_feature: The sequence is a functional homolog of SEQ ID NO 1494 in the 10/374,780US patent application
  misc_feature: The sequence is a functional homolog of SEQ ID NO 1498 in the 10/374,780US patent application
  misc_feature: The sequence is a functional homolog of SEQ ID NO 156 in the 10/412,699US patent application
  misc_feature: The sequence is a functional homolog of SEQ ID NO 1564 in the 10/412,699US patent application
  misc_feature: The sequence is a functional homolog of SEQ ID NO 1568 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 1978 in the 10/374,780US patent application
  misc_feature: The sequence is a functional homolog of SEQ ID NO 2240 in the 10/374,780US patent application
  misc_feature: The sequence is a functional homolog of SEQ ID NO 242 in the 10/374,780US patent application
  misc_feature: The sequence is a functional homolog of SEQ ID NO 353 in the 11/479,226US patent application
  misc_feature: The sequence is a functional homolog of SEQ ID NO 369 in the 11/479,226US patent application
  misc_feature: The sequence is a functional homolog of SEQ ID NO 40 in the 10/374,780US patent application
  misc_feature: The sequence is a functional homolog of SEQ ID NO 580 in the 11/435,388US patent application
  misc_feature: The sequence is a functional homolog of SEQ ID NO 76 in the 10/412,699US patent application
  misc_feature: The sequence is a functional homolog of SEQ ID NO 764 in the 10/412,699US patent application
  misc_feature: The sequence is a functional homolog of SEQ ID NO 776 in the 10/225,066US patent application
  misc_feature: The sequence is a functional homolog of SEQ ID NO 826 in the 10/225,066US patent application
  misc_feature: The sequence is a functional homolog of SEQ ID NO 950 in the 11/435,388US patent application
  misc_feature: The sequence is a functional homolog of SEQ ID NO 96 in the 11/375,241US patent application
  misc_feature: Useful for making plants with modulated biomass
  misc_feature: Useful for making plants with modulated growth and phenotype characteristics
  misc_feature: Functional homolog of the protein sequence given in SEQ ID NO 13416
  misc_feature: The sequence is a functional homolog of SEQ ID NO 156 in the 20040045049 US patent application
  misc_feature: The sequence is a functional homolog of SEQ ID NO 1564 in the 20040045049 US patent application
  misc_feature: The sequence is a functional homolog of SEQ ID NO 1568 in the 20040045049 US patent application
  misc_feature: The sequence is a functional homolog of SEQ ID NO 76 in the 20040045049 US patent application
  misc_feature: The sequence is a functional homolog of SEQ ID NO 764 in the 20040045049 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO. 337 in the 11/188,298 US application
MAQGEESSWCMTSSDHGRAASFSQAIACGSQRRASAAQPANFLELQPAAAPYYFGELEEALIHGTRTSVDHGMIGSDVDTESAGYLAARPPTLEIFPSWPMSHLQQPYSGNSHSVGSTTDSSSGQNSMPQTELVSPGSMRADSGQRQEVLMVTVDDYNYEQGLGAAATTAQIFQQHAAGQDKGKHGSTRKDGKLLDAKTERRLAQNREAARKSRLRKKAYVQQLETSRIRLQQIEQELHGARSQGLFPGGGGAPGDLSSGAVIFDMEYARWLEDDTKHMTELQAVLQPQIIDANLGAIVEECMRHYDELFHLRAMLARSDVFHLMTGLWATTAERCFLWMGGFRPSEILKMLIPQLDPLTEPQLLGMYNLQRSSEQTEEALGQGLQQLHQSLADAVGASPLSDGANVANYTALMALALDRLDTLESFYRQADSLRQQTLHQMRRILTTRQTARCFLSISEYHRRLRALSSVWASRPPTESSVAAAAAAAGAENVSPATGTTSEQAALRPYNHQSQQFPGF

SEQ ID NO: 11729 - DNA, 315 bp, Sorghum bicolor
  misc_feature: Ceres ANNOT ID no. 6030584
  misc_feature: Encodes the peptide sequence at SEQ ID NO 11730
atggcggaagaaaccaatgtaaagaaggaggaagaggagttcagcaccggtcctctctcagtgctcatgatgagcgtcaagaacaatactcaggttcttatcaactgccggaacaacaagaagctgcttggtcgcgtgagagcctttgatcggcattgcaacatggttctcgagaatgttagggagatgtggactgaggtaccaaagaccggtaaaggcaagaagaaggctcttccggtgaacaaagataggttcataagcaagatgttcctccgtggggattcggtcatcattgttctcaggaacccgaactga

SEQ ID NO: 11730 - protein, 104 aa, Sorghum bicolor
  misc_feature: Ceres ANNOT ID no. 6030584
  misc_feature (22)..(101): Pfam Id: LSM Pfam Desc: LSM domain
  misc_feature (1)..(103): NCBI GI: 115463137 NCBI Desc: os05g0314100 [oryza sativa (japonica cultivar-group)]
  misc_feature (1)..(103): NCBI GI: 21592784 NCBI Desc: small nuclear ribonucleoprotein-like protein [arabidopsis thaliana]
  misc_feature (1)..(103): NCBI GI: 60834798 NCBI Desc: small nuclear ribonucleoprotein d2 polypeptide [synthetic construct]
  misc_feature (1)..(103): NCBI GI: 50417589 NCBI Desc: mgc89748 protein [xenopus tropicalis]
  misc_feature (1)..(103): NCBI GI: 29294624 NCBI Desc: small nuclear ribonucleoprotein polypeptide d2 [homo sapiens]
MAEETNVKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPN

SEQ ID NO: 11731 - DNA, 1137 bp, Sorghum bicolor
  misc_feature: Ceres ANNOT ID no. 6030614
  misc_feature: Encodes the peptide sequence at SEQ ID NO 11732
atgatcttcccccctgccttcctggattcctcgagctggaacgataaccagcagcagcagcagcaagcccaccaccagcaccaggttgcggccaacgccggaggaggaggaggaggaggagacgccaatcatgagcttctccagcaatcaatcatggggggaccgcttcccgatggaggaggtggtggtggtggtggcgcgggggggcaggttgttggtggccccgccaagcccatgtccatggcggagcgcgcgcgcctcgcgaggatcccgctgccggagcccgggctcaagtgcccgcgctgcgactccaccaacaccaagttctgctacttcaacaactactccctctcccagccgcgccacttctgccgggcatgccgccgctactggacgcgcggcggcgcgctccgcaacgtgcccgtaggcggcgggtatcgccgccacgccaagcgcgccaagcccaagcagcagcaagcggctggagccggagccggaggcggctccgccgggaccgggaatacagccaccgccaacgccgcgctgcaacatgctcccgctgggtccacagcgtcgtcggccgctgcctgcaccgcgacgacgaccaacgcgctccccggcggcatgctaggcggcggtgggctgtccatgctgccgccgctgctccgcctcgccgacttcgacgccatgagcctcggctccaccttctctgggatatcgtccatggggaagcccggctccattgacgcctactcgcactcggtcggcggcggtggtgctccggccgggctggagcagtggagggtgcagcagatgcagagcttcccgttcctgcatgcgatggaccagggcccgctggggccacctctggccatggcaatggcggcgccagggatgttccagctaggtctagacaccaccagcagtgataatggccatggccgtggcggcggcggtggagaagacgggtcgaccggaggagagcttcatgtgatgcatcaacaagcagccaccaagagggaaagctacccggcaccaagaggcatgtatggcgatcaccaccaccacctcgctgctgctggtggctacacttccgcctattccaccaatgctgctacaggtaaccatctcttgtaa

SEQ ID NO: 11732 - protein, 378 aa, Sorghum bicolor
  misc_feature: Ceres ANNOT ID no. 6030614
  misc_feature (92)..(154): Pfam Id: zf-Dof Pfam Desc: Dof domain, zinc finger
  misc_feature (65)..(378): NCBI GI: 1061308 NCBI Desc: dof3 gene [zea mays]
  misc_feature (24)..(291): NCBI GI: 115456249 NCBI Desc: os03g0821200 [oryza sativa (japonica cultivar-group)]
  misc_feature (54)..(304): NCBI GI: 21538785 NCBI Desc: dof zinc finger protein [hordeum vulgare subsp. vulgare]
  misc_feature (38)..(192): NCBI GI: 21538783 NCBI Desc: dof zinc finger protein [hordeum vulgare subsp. vulgare]
  misc_feature (1)..(298): NCBI GI: 52218808 NCBI Desc: at5g02460 [arabidopsis thaliana]
  misc_feature: The sequence is a functional homolog of SEQ ID NO 1133 in the 10/374,780US patent application
  misc_feature: The sequence is a functional homolog of SEQ ID NO 2748 in the 10/374,780US patent application
  misc_feature: The sequence is a functional homolog of SEQ ID NO 394 in the 10/225,066US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated heat sensitivity
  misc_feature: Useful for making plants with modulated nitrogen use efficiency
  misc_feature: Functional homolog of the protein sequence given in SEQ ID NO 13434
  misc_feature: Functional homolog of the protein sequence given in SEQ ID NO 13468
  misc_feature: The sequence is a functional homolog of SEQ ID NO 394 in the 20050160493 US patent application
  misc_feature: The sequence is a functional homolog of SEQ ID NO 1133 in the 20060162006 US patent application
  misc_feature: The sequence is a functional homolog of SEQ ID NO. 379 in the 11/188,298 US application
  misc_feature: The sequence is a functional homolog of SEQ ID NO. 489 in the 11/188,298 US application
  misc_feature: The sequence is a functional homolog of SEQ ID NO. 486 in the 11/188,298 US application
MIFPPAFLDSSSWNDNQQQQQQAHHQHQVAANAGGGGGGGDANHELLQQSIMGGPLPDGGGGGGGGAGGQVVGGPAKPMSMAERARLARIPLPEPGLKCPRCDSTNTKFCYFNNYSLSQPRHFCRACRRYWTRGGALRNVPVGGGYRRHAKRAKPKQQQAAGAGAGGGSAGTGNTATANAALQHAPAGSTASSAAACTATTTNALPGGMLGGGGLSMLPPLLRLADFDAMSLGSTFSGISSMGKPGSIDAYSHSVGGGGAPAGLEQWRVQQMQSFPFLHAMDQGPLGPPLAMAMAAPGMFQLGLDTTSSDNGHGRGGGGGEDGSTGGELHVMHQQAATKRESYPAPRGMYGDHHHHLAAAGGYTSAYSTNAATGNHLL

SEQ ID NO: 11733 - DNA, 1257 bp, Sorghum bicolor
  misc_feature: Ceres ANNOT ID no. 6030845
  misc_feature: Encodes the peptide sequence at SEQ ID NO 11734
atggcttcctgcaaacaattccgattactatttgttgcaacttacaaccattcttttttgtcctgtagagtccttcagttagacgttcctgcagattctgaagcctctcctaggagaaatgtaccagggagtgtaagtagcccactcatgaatggtgaaaagggtctcttacggaatcagaatgcagggttcactgcacttgcaagtcctgtgaggagagaaattggaaacagatcgttgacaaggtccttctgtgttgatgacaatgacttggaagatggtaaggcctcaaaagaaagggagagctctgcacagtcactcaagctcccaaagattcagaatcaggctttcctatctggtctggcttactgcatatcatcatgcagcatgatcttagtgaacaaatttgttctatctggctatggtttcaatgctccagtatttttgatgctataccagaacattgtatcagtgaccatagtttctacactatccctgtccggtgctgttccaactgaaccattgacatggaatctaatcaaagtttggttgcctgtgaatatcatctttgttggaatgctgatcacaagcatgtttagtttgaagtacattaatgttgcaatgctgactatactgaagaatgtcgccaatgtcctgactgcttctggggaaacttattttttcaagaagcagcatggtactcaagtctggattgctcttttgttgatgataatctctgcagttgcgggaggaataacagatctttcattccatgctgttggatatatctggcagaccttgaactgttttctgacggcgtcatattcgcttacattgcggcatgtaatggacagtgctaagcaagccaccaagtctgggaatttgaatgagctttcaatggtgttgctgaataatgttctttcactgccattgggaattatccttgttcttggtttgaatgaagtggagtaccttttggagacacctctcttaaagatgcctgagttttggctggtcatcactgccagtggagttttggggcttggaatcagctttacttccatgtggtttcttcatcagacaagtgcaacaacatatagccttgtgggctcgttaaacaagatccctctttccattgctggaatcgttctcttcaacgttcgtacaagcatacagaattctttgagcattctgtttggtctattagcaggagtgtttttagccaggtccaaattgcgagataactcgccgacctag

SEQ ID NO: 11734 - protein, 418 aa, Sorghum bicolor
  misc_feature: Ceres ANNOT ID no. 6030845
  misc_feature (87)..(416): NCBI GI: 15487237 NCBI Desc: gdp-mannose transporter [arabidopsis thaliana]
  misc_feature (113)..(412): NCBI GI: 29329819 NCBI Desc: gonst2 golgi nucleotide sugar transporter [arabidopsis thaliana]
  misc_feature (87)..(366): NCBI GI: 25411503 NCBI Desc: probable vanadate resistance protein [imported] - arabidopsis thaliana
  misc_feature (113)..(244): NCBI GI: 8778553 NCBI Desc: f22g5.37 [arabidopsis thaliana]
  misc_feature (113)..(300): NCBI GI: 15222352 NCBI Desc: nucleotide-sugar transporter family protein [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MASCKQFRLLFVATYNHSFLSCRVLQLDVPADSEASPRRNVPGSVSSPLMNGEKGLLRNQNAGFTALASPVRREIGNRSLTRSFCVDDNDLEDGKASKERESSAQSLKLPKIQNQAFLSGLAYCISSCSMILVNKFVLSGYGFNAPVFLMLYQNIVSVTIVSTLSLSGAVPTEPLTWNLIKVWLPVNIIFVGMLITSMFSLKYINVAMLTILKNVANVLTASGETYFFKKQHGTQVWIALLLMIISAVAGGITDLSFHAVGYIWQTLNCFLTASYSLTLRHVMDSAKQATKSGNLNELSMVLLNNVLSLPLGIILVLGLNEVEYLLETPLLKMPEFWLVITASGVLGLGISFTSMWFLHQTSATTYSLVGSLNKIPLSIAGIVLFNVRTSIQNSLSILFGLLAGVFLARSKLRDNSPT

SEQ ID NO: 11735 - DNA, 1413 bp, Sorghum bicolor
  misc_feature: Ceres ANNOT ID no. 6030861
  misc_feature: Encodes the peptide sequence at SEQ ID NO 11736
atggcgtcgtcgaccatggcagcatcagcgtcatccgtcctgccgccgccgacgacatctccctcttggtcgcaactcctccccgagctactcggccgtgtcatcgcccacctaccgttccccgccgaccacgcacgattccgcgccgtctgccgcgcgtggcgcaccgccgcgcatgaccaagtgcgcctgcagcttccttggctcgtcctcccggacggatccttctgcatcaccagcgacgatgacgacaatgggtgcggcggtgtcttcttcgaccgcctccccggactgccggacgccgccgtgacctgtactgtcgtcgtcggctccaccgacgactggcttgcgctggactgcacctgcgacgaggaccacctcaaatacgtcatgggcaacatctgcagctgctgtctcctcgacaaagacgacgacgacgacgtcaagctcaagcgtaagcccagctacctcctgcacaacgccttctcgggagccacagttccgctacccgagctggaagctgtcatctccagtgtctcgagaaggtttcagatccgaaaggtgctgatgcgctcgtcgactcccgatgacgtgatcgccgtcgtgaccaacagctgggactacaacatcatcctgtgccgccccgggaagggcacccatgtactgtactactatgatatctttgatgtcgcgttccttggagactggctatatgggatcacacccaatgaaaaccttgtcggattccgtctcggcgaagacgacgacgatgacggcaaccccgttgttgcgacgacaagacgcttcattacaaacccattgccccaaggggaggaagactattggagctggattgacgagcaggagaatagtgatgacgatgatgatgatgatgatgatgaagcacaggacacagaagaggaggaggagggttgctcttgctcaagtggtgatgggatgataccaaatggtgtggacgttgtgcaagatgaggggtcgtcgctcaatgaacccaaggactacatcgtcaccatccggaaacttgtgaagtcacgagctggggagctgctcatggtgaagcggcagatgcaagcaccttcttcttattccggaccaccgcacactcgcaaggttgacatcttcaaggcggacatcaatgcaggcaaatggctcccggtaactggtaatgattgtttagctgaagatgaggccctcttcctcagcaaatccttcagcaagtcagttcgtgtgcacggagacatcagagcacgtttcgtatattttgatgacacgttagaagcgtttgacaccacatcctcaacctgtatcccatctagtcttggggaccaggtttaccgtctgctgaggtgtagttggctgacgtggattttcccacaagagttggtggtttag

SEQ ID NO: 11736 - protein, 470 aa, Sorghum bicolor
  misc_feature: Ceres ANNOT ID no. 6030861
  misc_feature (21)..(69): Pfam Id: F-box Pfam Desc: F-box domain
  misc_feature (23)..(275): NCBI GI: 116309490 NCBI Desc: osigba0113k06.4 [oryza sativa (indica cultivar-group)]
  misc_feature (23)..(275): NCBI GI: 115457754 NCBI Desc: os04g0329500 [oryza sativa (japonica cultivar-group)]
  misc_feature (23)..(275): NCBI GI: 115457696 NCBI Desc: os04g0317300 [oryza sativa (japonica cultivar-group)]
  misc_feature (18)..(61): NCBI GI: 115466420 NCBI Desc: os06g0148300 [oryza sativa (japonica cultivar-group)]
  misc_feature (348)..(467): NCBI GI: 115437214 NCBI Desc: os01g0530500 [oryza sativa (japonica cultivar-group)]
MASSTMAASASSVLPPPTTSPSWSQLLPELLGRVIAHLPFPADHARFRAVCRAWRTAAHDQVRLQLPWLVLPDGSFCITSDDDDNGCGGVFFDRLPGLPDAAVTCTVVVGSTDDWLALDCTCDEDHLKYVMGNICSCCLLDKDDDDDVKLKRKPSYLLHNAFSGATVPLPELEAVISSVSRRFQIRKVLMRSSTPDDVIAVVTNSWDYNIILCRPGKGTHVLYYYDIFDVAFLGDWLYGITPNENLVGFRLGEDDDDDGNPVVATTRRFITNPLPQGEEDYWSWIDEQENSDDDDDDDDDEAQDTEEEEEGCSCSSGDGMIPNGVDVVQDEGSSLNEPKDYIVTIRKLVKSRAGELLMVKRQMQAPSSYSGPPHTRKVDIFKADINAGKWLPVTGNDCLAEDEALFLSKSFSKSVRVHGDIRARFVYFDDTLEAFDTTSSTCIPSSLGDQVYRLLRCSWLTWIFPQELVV

SEQ ID NO: 11737 - DNA, 2202 bp, Sorghum bicolor
  misc_feature: Ceres ANNOT ID no. 6030867
  misc_feature: Encodes the peptide sequence at SEQ ID NO 11738
atggagatgggaatgactcctgaagtaatgtatggacaaaatgtttttgttcctgctactgcaaatccctaccaatatggttatgcagaagttggatcaccgatggaatggtataaccacccgagctctttaggatatgatggccaagatgtttactatccggctgaaggcatgcaatgcgtatactacgcagccccagacaatggatctatgcaccctacctacagtccttacccttctgatccttctttcgtgcctgatggctcatttatgcctcaggagtatgttgctgaccctgctaactccacatgccaaatagccccgacatcctattacattccagctgttcttccttatgcgcaagatagtgtcccgggaagcgcaaccacacctattcactcctccaatgttgcatttcttcctggcataccaggttatgctgcaacatctgcaaatgcagcatttcctttaattgctccggtcaccacaaaaagggacattgttatgcatccacctgtacagtctactattgtaccttcaaagcagttccaggaccatgcaaaaccaccaaaggttcaactgcacaattcggttccacagaagcaagagttgccggatagatgcatggtgcctgctaaactccctcatgtttctcaggtatcagcacatttgtctggaaacaattgccttggatgtgctgctggatctgatcttcagaagtgggctgccgccgagaaattccagccatcttcaaagtcaagtggtcatctaaatggtactggccaaaaagtgcatagcttagttgattctgagaaaccaagcaatcagagctctgccataattgtgaaatcctacacatcaaggctccctgttggtaatccggatgggacaatcattataagaactgaccagtacaaccgagatgatctccgaatcgactatacgtatgcaaagttctttgttatcaagtcaattggtgaggcagatgtgcacaaatcaataaagtatggtgtatggtcaagttcctccaatggaaacagcaagctagatagtgcattcagggatgctgacaggatatcaaggaggcattctactaaatgtccagttttcttgttcttctctgtaaatggtagtgggcacttttgtggcatggctgagatggttggtcctgttgattttcacaaggacatggacttctggtgtcaggataaatggaccggatgctttcctgtgagatggcacatcgttaaagatatacaaaattgttctttgcagcacatcacactgcagaataatgaaaacaagcctgtgacacatagcagagatacacaggaaataccatacctccctggaatatctatgatcgagatcttcaaaggcatcaaagcgaggttctgcctgtttgatgattttatgaggtatgagacagacgaggcgcgaaagaagccgcacagaaggtgcaagctgagttacaatgctccagattttgtacctgtctcacagcgtacaaaagatgcttctgacactcagcagacaaaatccagcagcgtgctggtagacaaaacatcggaggttcaaaatgtggccgagaagcagcatgatgctaaggtgatcaaacctcaggaaccgtgcgtctctgaaaagcaggccagtgaggctgagaaagagaatggagtacaggaaagtcattgcagtggcaatcacaatcagagccatgacgatgcagccaaaaatgtaaccaaccatccaccagcttcaagcttgaaggcaggtgcagaggggaaacagcagtactggaagaaggttgaaaatccaaagcagcatgcagacagcagtgctgctgcccagggctcactgagagcacctgaaaagcggctaaatggagttagcggctctgtgagagcagttccagagggtggcgaggagcagagggtcaccgccaaacttggttctctcaagatcagttccaaggcagtggaggctgaccataaaactagcacagttggtgtggagaagcggctaaatggagtcagcagctctgtgagcacagttccagagggtggcgaggagcagagggtcactgccaaacttggatccctcaaagtcggttccaaggcagtggaggctgaccgtaagactaacacagttggtgtggtgacaatcggctcgatgccggtccgggttgacagttgtgacgtctag

SEQ ID NO: 11738 - protein, 733 aa, Sorghum bicolor
  misc_feature: Ceres ANNOT ID no. 6030867
  misc_feature (371)..(461): Pfam Id: YTH Pfam Desc: YT521-B-like family
  misc_feature (79)..(662): NCBI GI: 53791334 NCBI Desc: rna-binding protein-like [oryza sativa (japonica cultivar-group)]
  misc_feature (255)..(620): NCBI GI: 8778514 NCBI Desc: f21d18.17 [arabidopsis thaliana]
  misc_feature (243)..(636): NCBI GI: 145332605 NCBI Desc: ect6 (evolutionarily conserved c-terminal region 6) [arabidopsis thaliana]
  misc_feature (24)..(562): NCBI GI: 56202150 NCBI Desc: rubisco subunit binding-protein beta subunit-like [oryza sativa (japonica cultivar-group)]
  misc_feature (24)..(562): NCBI GI: 56202151 NCBI Desc: rubisco subunit binding-protein beta subunit-like [oryza sativa (japonica cultivar-group)]
MEMGMTPEVMYGQNVFVPATANPYQYGYAEVGSPMEWYNHPSSLGYDGQDVYYPAEGMQCVYYAAPDNGSMHPTYSPYPSDPSFVPDGSFMPQEYVADPANSTCQIAPTSYYIPAVLPYAQDSVPGSATTPIHSSNVAFLPGIPGYAATSANAAFPLIAPVTTKRDIVMHPPVQSTIVPSKQFQDHAKPPKVQLHNSVPQKQELPDRCMVPAKLPHVSQVSAHLSGNNCLGCAAGSDLQKWAAAEKFQPSSKSSGHLNGTGQKVHSLVDSEKPSNQSSAIIVKSYTSRLPVGNPDGTIIIRTDQYNRDDLRIDYTYAKFFVIKSIGEADVHKSIKYGVWSSSSNGNSKLDSAFRDADRISRRHSTKCPVFLFFSVNGSGHFCGMAEMVGPVDFHKDMDFWCQDKWTGCFPVRWHIVKDIQNCSLQHITLQNNENKPVTHSRDTQEIPYLPGISMIEIFKGIKARFCLFDDFMRYETDEARKKPHRRCKLSYNAPDFVPVSQRTKDASDTQQTKSSSVLVDKTSEVQNVAEKQHDAKVIKPQEPCVSEKQASEAEKENGVQESHCSGNHNQSHDDAAKNVTNHPPASSLKAGAEGKQQYWKKVENPKQHADSSAAAQGSLRAPEKRLNGVSGSVRAVPEGGEEQRVTAKLGSLKISSKAVEADHKTSTVGVEKRLNGVSSSVSTVPEGGEEQRVTAKLGSLKVGSKAVEADRKTNTVGVVTIGSMPVRVDSCDV

SEQ ID NO: 11739 - DNA, 1656 bp, Sorghum bicolor
  misc_feature: Ceres ANNOT ID no. 6030885
  misc_feature: Encodes the peptide sequence at SEQ ID NO 11740
  misc_feature: Down-regulated in shoot tissues in response to salicylic acid treatment
atggcctccgacggcgccgccagagtccgccctcccaagctccccgtttgggaaggcctggacccatccaacgtcctcacctacaagagacgccgccgcggcaccggcgccaacgcaggccacatcgccgtcacgccgagccccgaccctgtcaagaataagatgagcgcggtggtgcacgccatcaattcccagcaaggtgggcgccaaatgctagacaggcactggagaagctggagggacacgctggagggcgtcctgcaatccactcctgggaaccagagcgccggagggattcagagctgcatccgagatgcgctcagatataatggttgccatcccaaagaacatgggaacttagctgatggccgaggagcaggcggagaggaccctgttggagctgtacattctgaagagaataatgctgcctttcagttagaagatggaacggctgcatctttggaagccaacaaggcagtgtgccataaagctctttttgacattctaatctccgagaagtttgccatgctttgtgatctgctagctgcaacattccatgtcaatacgcctgatgacgtgattggcttgcaaataattgatgccaagatgagaaatggggattatgcacagaaccctgcgctgcttgaccatgatatcaaaaagatatggaagaagattgaacatgttggccaacaaatggctggtctggcaagcagtctctcactgatttcacaagcttctcatcaaaagcaggcttctggcgtttcagaaattgatgtggctgaacacaggatagaggaaacaagtttggttggtgttgcccacaaagccctaagggagttgactcccccttgcgattctggccattctacgataccaaatggaccggatggaatttgcaaggattgtggcagaaaggcagacagcggaggaagaattatctgtgatagatgtgaagccacataccatgtttcatgtctcaagcttgccattgatgaagaggccccagcaaaatggtactgtcccacctgtgttggattagatggaccttcaaagaatgacaacaatggcagatcacatgaaggctgcgatgtatgcgagtggcttgtgttcgagaaacctgaagaaccggctgaggatgttagccaacctgaattggccgtcaaaacacaggagagctcagtgtcaagcatggatgaagatagtgaaccagacctctcaacaactgctctagcaaacttgtgcaagcattgtggcacatgtgaagatgagaacaagaagttcttggtatgcggccatccttattgttcttacaagttctatcatgtgctgtgcatgaaagaaagccagattgcaagtgagaagcagaagaagcaagcatgctggtactgcccgtcttgcctgtgcagatgctgcttcaagaacaaggatgatgaagaaatagtattgtgtgatggctgtgatgatgcttatcacatttactgcactgtcccgccgctcgattctgtcccgagaggtaactggtactgcatgtcatgtaatgcacggaggtcagcgcgtgggatgcagaagtacgaggagtcaatcctgcagaagaccagtcgtgttcctgatgccaaaaggccaaaggtgcaggcagctgctccagaaaaataa

SEQ ID NO: 11740 - protein, 551 aa, Sorghum bicolor
  misc_feature: Ceres ANNOT ID no. 6030885
  misc_feature (299)..(347): Pfam Id: PHD Pfam Desc: PHD-finger
  misc_feature (414)..(470): Pfam Id: PHD Pfam Desc: PHD-finger
  misc_feature (471)..(516): Pfam Id: PHD Pfam Desc: PHD-finger
  misc_feature (284)..(550): NCBI GI: 42563280 NCBI Desc: phd finger family protein [arabidopsis thaliana]
  misc_feature (265)..(538): NCBI GI: 115437402 NCBI Desc: os01g0547200 [oryza sativa (japonica cultivar-group)]
  misc_feature (438)..(508): NCBI GI: 95118482 NCBI Desc: phd finger protein-like protein [musa acuminata]
  misc_feature (411)..(513): NCBI GI: 3540281 NCBI Desc: all-1 related protein [takifugu rubripes]
  misc_feature (405)..(513): NCBI GI: 4808456 NCBI Desc: requiem protein [xenopus laevis]
  misc_feature: Down-regulated in shoot tissues in response to salicylic acid treatment
MASDGAARVRPPKLPVWEGLDPSNVLTYKRRRRGTGANAGHIAVTPSPDPVKNKMSAVVHAINSQQGGRQMLDRHWRSWRDTLEGVLQSTPGNQSAGGIQSCIRDALRYNGCHPKEHGNLADGRGAGGEDPVGAVHSEENNAAFQLEDGTAASLEANKAVCHKALFDILISEKFAMLCDLLAATFHVNTPDDVIGLQIIDAKMRNGDYAQNPALLDHDIKKIWKKIEHVGQQMAGLASSLSLISQASHQKQASGVSEIDVAEHRIEETSLVGVAHKALRELTPPCDSGHSTIPNGPDGICKDCGRKADSGGRIICDRCEATYHVSCLKLAIDEEAPAKWYCPTCVGLDGPSKNDNNGRSHEGCDVCEWLVFEKPEEPAEDVSQPELAVKTQESSVSSMDEDSEPDLSTTALANLCKHCGTCEDENKKFLVCGHPYCSYKFYHVLCMKESQIASEKQKKQACWYCPSCLCRCCFKNKDDEEIVLCDGCDDAYHIYCTVPPLDSVPRGNWYCMSCNARRSARGMQKYEESILQKTSRVPDAKRPKVQAAAPEK

SEQ ID NO: 11741 - DNA, 1764 bp, Sorghum bicolor
  misc_feature: Ceres ANNOT ID no. 6030886
  misc_feature: Encodes the peptide sequence at SEQ ID NO 11742
atgctcgccgccgccggcagggacggcgccgacctcatcctctcgctcccggaggacgtgctggcgctcatctcggcgcacctccgtccccgcgacctcctggcgctctccgccgcgtcgcgccgcctccgccgcgcgctctccgccgacaaggcgtggctggcgcagtgccgccgcctgctgccatccccggcgcacctcctggcctggcgcgccgccgccgcgggcgactccctcgccgtctgccgcttcctccactccgccgcgccgctgctcggactctgggcgcaccagaaccccgagctcggcaacctcgtcgccgcagtccccggattcctctccgtcgtcgccgcacgcgccatcccgcaggagctctccccgcgcctccgctgggcgcccgtcttcgagctcctcgctgacgaccacggccgccccgcgctcctcttcctccacggccaccaccacgcacacctcttccctggcctcctcgcttcactccagccccacgccaacgtcatcttcctcgaggcgcacaccgcccgggatccgctcgcttcctcctcctcctcctcctcctcctcctgcccacagtgcttcgcccgcctctccttcggcgaccgccgccgcctgctcgactccctcgtcgccgcctgccggatcacgctgccgcccgacctcgtcgacgccccgctcttcgcgtgctccgacgacgacctcccgctgctcgccaagcgccgggaggccatgctgcgcctgcacagggaggccgccgggggcatggtgcgcacgcccgaggtccaggggctccttctggaagccaagaagaaggcggcgacgacgccgtcgccgaccgacggtgggcgcaggattccgctgcggaggagcctctcagccgtggccgggtatttcaggaacggcctgcggcagatggtcacacggtcagcttcagcaaattccaggaccgactatgtggacgccaaacatctggcattgtctgacttcctacacgacggtgagagtgtcgggctgagcctccgcggggcaagaatgcggctgtcgacttaccgggcgtggccgagcatgcatgacaaccggttcgcgctctacaagctcacggtgcagacgcccatgccgggaagggagtacgccggcctgtggggaggcacattcggatggccgccagggcggccaagcgatgaatgcaagcccaagaaggctctcttcttcctgctcctctcatatgaggaggacagtgagggcaagcttcagctgatcgcgaccaaggtgttggagggaacacactatgttgtccatcccaatgggtcttcgatgtttatcgcgaggatgggtgagcaatcaacagagccttttccatggcagactgatggggagtcccgaaatgttgatgtcgagagaggcttcgcgggagagggcattgcaaatgggtatggcttcagataccctggctcaaagcctggttcattgtttgtcctccaggatgggttgcttgcatttgtttggaaagagaccggggccgtgcttaccttgcaaagactggatttggaggagttgctgaagaaaggggagcgtgtgcctgcattgcagccagtaccaaactttgcttacctgacaaagtcttactccaatgttttcactggtttccctggcagctcagcttctcccagatgcaagttgacatattgtgtttcttttgatgcattcatcgtcagtgctgtggatgacctttctatgtcaaagatctag

SEQ ID NO: 11742 - protein, 587 aa, Sorghum bicolor
  misc_feature: Ceres ANNOT ID no. 6030886
  misc_feature (11)..(58): Pfam Id: F-box Pfam Desc: F-box domain
  misc_feature (2)..(562): NCBI GI: 42407787 NCBI Desc: f-box protein family-like [oryza sativa (japonica cultivar-group)]
  misc_feature (9)..(552): NCBI GI: 15241773 NCBI Desc: f-box family protein [arabidopsis thaliana]
  misc_feature (13)..(158): NCBI GI: 52430407 NCBI Desc: f-box protein 31 [homo sapiens]
  misc_feature (13)..(158): NCBI GI: 33313161 NCBI Desc: f-box only protein 31 [homo sapiens]
  misc_feature (16)..(158): NCBI GI: 119615809 NCBI Desc: f-box protein 31, isoform cra_d [homo sapiens]
MLAAAGRDGADLILSLPEDVLALISAHLRPRDLLALSAASRRLRRALSADKAWLAQCRRLLPSPAHLLAWRAAAAGDSLAVCRFLHSAAPLLGLWAHQNPELGNLVAAVPGFLSVVAARAIPQELSPRLRWAPVFELLADDHGRPALLFLHGHHHAHLFPGLLASLQPHANVIFLEAHTARDPLASSSSSSSSSCPQCFARLSFGDRRRLLDSLVAACRITLPPDLVDAPLFACSDDDLPLLAKRREAMLRLHREAAGGMVRTPEVQGLLLEAKKKAATTPSPTDGGRRIPLRRSLSAVAGYFRNGLRQMVTRSASANSRTDYVDAKHLALSDFLHDGESVGLSLRGARMRLSTYRAWPSMHDNRFALYKLTVQTPMPGREYAGLWGGTFGWPPGRPSDECKPKKALFFLLLSYEEDSEGKLQLIATKVLEGTHYVVHPNGSSMFIARMGEQSTEPFPWQTDGESRNVDVERGFAGEGIANGYGFRYPGSKPGSLFVLQDGLLAFVWKETGAVLTLQRLDLEELLKKGERVPALQPVPNFAYLTKSYSNVFTGFPGSSASPRCKLTYCVSFDAFIVSAVDDLSMSKI

SEQ ID NO: 11743 - DNA, 1011 bp, Sorghum bicolor
  misc_feature: Ceres ANNOT ID no. 6030902
  misc_feature: Encodes the peptide sequence at SEQ ID NO 11744
atgaacggcggcgggtccggaggggcgagcgggccggactcccgcgtggagaccatctcccgcctggcgcagtggcgcatcgacaccttcggcccctgctcctaccgccgctccgaccccttcaagctcggcatctggaactggtacctgtcggtggagaagagccgctccatcttcgtgcgcctcttcccggagcccggccgggtggccaaggagcagccccctctcgcgcgcttcctgctccgcgtctcctgggccggcccgccgcgacgcacctgcgtctcccctgtgcacgaacatcttctgcgtaccagtgatgactttgtctggcaagttgatgcaatgtcccatgggcgttttacgattgatgttgagtttctggacctgaggatagccaataacaatgctactgaatcattgtcggtatggccaaccgaaggcatggtgcagaagattgcgagcaagagcaccctcgggtgtctctcccgcatgctgacggattccatccacacagacgtgaccatcaacacgacggacggcgtcctgaaggcccacaaggcggtgctggcggcgtgctcccccgtgttcgaaagcatgttcatgcacgacctgagggagaaggagtcgtccacaatcaacatcagcgacatgtgcctggagtcgtgctcggcgctgctgggcttcatctatgggacgatcgagcaggggcagttctggaagcaccggctgccactgctggcggcggccaacaagtacgggattggcgacatcaaggactgctgcgaggagagcctgctggaggatattacctcggcgaacgtccttgagcggctccacgtggcgtggctgtaccagctggagcggctcaagaaagggtgcctcacctacctgtttgtgtttgggaagatttatgatgtgagggacgagatgcacagcttcttccaccacgcggaccgcgagctcatgctcgagatgttccaggaggtcctcagcgtgtggaagcccatgtga

SEQ ID NO: 11744 - protein, 336 aa, Sorghum bicolor
  misc_feature: Ceres ANNOT ID no. 6030902
  misc_feature (161)..(269): Pfam Id: BTB Pfam Desc: BTB/POZ domain
  misc_feature (49)..(336): NCBI GI: 50725708 NCBI Desc: poz domain protein family-like [oryza sativa (japonica cultivar-group)]
  misc_feature (15)..(335): NCBI GI: 92870505 NCBI Desc: btb/poz; traf-like [medicago truncatula]
  misc_feature (15)..(334): NCBI GI: 92874921 NCBI Desc: btb/poz; traf-like [medicago truncatula]
  misc_feature (14)..(333): NCBI GI: 42408860 NCBI Desc: poz domain protein family-like [oryza sativa (japonica cultivar-group)]
  misc_feature (15)..(301): NCBI GI: 8778495 NCBI Desc: f20n2.15 [arabidopsis thaliana]
MNGGGSGGASGPDSRVETISRLAQWRIDTFGPCSYRRSDPFKLGIWNWYLSVEKSRSIFVRLFPEPGRVAKEQPPLARFLLRVSWAGPPRRTCVSPVHEHLLRTSDDFVWQVDAMSHGRFTIDVEFLDLRIANNNATESLSVWPTEGMVQKIASKSTLGCLSRMLTDSIHTDVTINTTDGVLKAHKAVLAACSPVFESMFMHDLREKESSTINISDMCLESCSALLGFIYGTIEQGQFWKHRLPLLAAANKYGIGDIKDCCEESLLEDITSANVLERLHVAWLYQLERLKKGCLTYLFVFGKIYDVRDEMHSFFHHADRELMLEMFQEVLSVWKPM

SEQ ID NO: 11745 - DNA, 2127 bp, Sorghum bicolor
  misc_feature: Ceres ANNOT ID no. 6030941
  misc_feature: Encodes the peptide sequence at SEQ ID NO 11746
atgggggtgaagaacctctgggacatcctcgactcctgcaagaagaagctcccgctccagcacctccagaacaagaaggtgtgcgtggatctttcctgctggctcgtgcagttctgcagcgccaaccgctccccggccttcctcagggataaggtctacctcaagaacctcttccaccgtatccgagccctcctcgccctcaactgcagcctcatctttgtctcagatggggcgattccttcagtcaaattggctacttataggcgccgcctgggattaaatgctgctgaggctactcgagaggaggccaactcacaacctctgacttctttgcgccggaacaagagctcagagttctcacgcatgatcaaagaagccaagcatctcgggttggcccttggcatcccctgcttggatggtgtggaagaggcagaggcacagtgtgcaatgcttaattttgcctccttgtgtgatggctgttttacatcggattccgattcattcctgtttggtgcaaggacagtttatagagatgttttcataggagagggtggttatgtaatttgctatgaaatggaagacattcagaagaagcttggtttcggcaggaactcactgatatcacttgcagttcttcttggcagtgactattctaatggagtccatggctttggcccagaattagcatgccgccttgttaaatctgtgggggatgatgccattcttgatcaaattttgtccgatggagttaaacctgcaaggaaatgtaaaggaaaaaatagtggtgccattgcagggagggttggtggaacatgcccaaaagcgagtacctgtgaggttgggattaaccaagattctggtggtcaatttcgtgacataataaatgcatatctggagccaaaatgtcattcaccagattcagaagccgtgcagagggcatgcagtcagcagccatttcttcggtcacagctgcaacagatatgtgagcaatactttgagtggagccctgtgaaaactgatgaatatatccttccaaagattgctgagagagaacttcgaagattttcaaatctccgctccacgtcttcagatctaggaataaaaccttcactggatgagatgccagtaccgtgccctgtactggcaattgtgaagcagcgaaaagttcaaggaagtgaatattatgaggtttcatggagaaacatagatgggctccaagtttcagttgttccaggggatcttgttagaagtgcttgcccagaaaaaataactgtctttttggaaaacaaggatgctcagaagaagcaaaagaggagagctaggccaaagaaatcaggtcaagctgctgctgccttaaaagacgtggatgcgcagctccaagaattgctacttggaattgaatctgaaagcagtacatttccatgtacagccaatggccctcagactcagacagcagatatgcagatggtggcaccgctccaggattttgttgatctgtcttctccatcaccacctatacgatcttgtaagatggccagatccagaaagttcagtgattcagacgcagtaaccatgggtcagattgatctgcagcaccaaaatctgctgattggatcaatggagtcaaaaggaaatactgttttgtgcggcatgaagaattcgacactagatcatgagccaattgatctttcatcaccctcgccttgcgctgctcataaaccccaggcagctccagaaggaccgccactgtgtatggaagcagaaagaagagccctctgggatataagcaatttgcccgagaaagaaccctcctgttgcaagcatgaacctggaacaagtggctgtgatgtgcaggtggaagaatcaccattgttcaggcatgggactgggatggcaggcaaagctgattcctcacagaggagcgatggacaaagtagtgaagtagtagaacccaccatgatcgatctctcttctccttcaccggttaaagtggataagagtagacggaatggccagaagcctgaccaggattgtgaggctgatgatggcagtcagtctccagaacacgagaggaaagcgagggagctcagattgtttctaaacagtataagagacgagctaaactaa

SEQ ID NO: 11746 - protein, 708 aa, Sorghum bicolor
  misc_feature: Ceres ANNOT ID no. 6030941
  misc_feature (131)..(220): Pfam Id: XPG_I Pfam Desc: XPG I-region
  misc_feature (1)..(103): Pfam Id: XPG_N Pfam Desc: XPG N-terminal domain
  misc_feature (1)..(566): NCBI GI: 16923283 NCBI Desc: single-strand dna endonuclease-1 [oryza sativa (japonica cultivar-group)]
  misc_feature (34)..(258): NCBI GI: 92872033 NCBI Desc: chromo; helix-hairpin-helix motif, class 2 [medicago truncatula]
  misc_feature (76)..(472): NCBI GI: 140061845 NCBI Desc: chromo; helix-hairpin-helix motif, class 2 [medicago truncatula]
  misc_feature (1)..(244): NCBI GI: 60334795 NCBI Desc: riken cdna 5830483c08 gene [mus musculus]
  misc_feature (1)..(247): NCBI GI: 5679043 NCBI Desc: gm10765p [drosophila melanogaster]
MGVKNLWDILDSCKKKLPLQHLQNKKVCVDLSCWLVQFCSANRSPAFLRDKVYLKNLFHRIRALLALNCSLIFVSDGAIPSVKLATYRRRLGLNAAEATREEANSQPLTSLRRNKSSEFSRMIKEAKHLGLALGIPCLDGVEEAEAQCAMLNFASLCDGCFTSDSDSFLFGARTVYRDVFIGEGGYVICYEMEDIQKKLGFGRNSLISLAVLLGSDYSNGVHGFGPELACRLVKSVGDDAILDQILSDGVKPARKCKGKNSGAIAGRVGGTCPKASTCEVGINQDSGGQFRDIINAYLEPKCHSPDSEAVQRACSQQPFLRSQLQQICEQYFEWSPVKTDEYILPKIAERELRRFSNLRSTSSDLGIKPSLDEMPVPCPVLAIVKQRKVQGSEYYEVSWRNIDGLQVSVVPGDLVRSACPEKITVFLENKDAQKKQKRRARPKKSGQAAAALKDVDAQLQELLLGIESESSTFPCTANGPQTQTADMQMVAPLQDFVDLSSPSPPIRSCKMARSRKFSDSDAVTMGQIDLQHQNLLIGSMESKGNTVLCGMKNSTLDHEPIDLSSPSPCAAHKPQAAPEGPPLCMEAERRALWDISNLPEKEPSCCKHEPGTSGCDVQVEESPLFRHGTGMAGKADSSQRSDGQSSEVVEPTMIDLSSPSPVKVDKSRRNGQKPDQDCEADDGSQSPEHERKARELRLFLNSIRDELN

SEQ ID NO: 11747 - DNA, 480 bp, Sorghum bicolor
  misc_feature: Ceres ANNOT ID no. 6031279
  misc_feature: Encodes the peptide sequence at SEQ ID NO 11748
atgatattcatcgtgatgatcacggttggatccgtgctctttgccaagtgctgtgttggggatcgggcgtttatgcgcactgggtatgactttgaaggctatgtgatgcgtaagtgccccgtttgtgtcggccttcccaagccaacacatccccgtgtaaaggaggtagatcctcttcagatgactgagattacagtggaagaggcgaggacatcagagccccctgctcctcctcctgctactgctgcacctcctcctcctcctgctgctgctacacctgctcctcctcctgctacatctgctcctcctcctgctgctgctgctacacctgctcctcctcctactgtaactggagcagtaccggtagctaccaaggaggatgaggaagatgagatcaacgaggatgaggaggaggatgatgaggaggaggagtttgattttgatgcatatgaggaagcggaagctctaggccgtctatga

SEQ ID NO: 11748 - protein, 159 aa, Sorghum bicolor
  misc_feature: Ceres ANNOT ID no. 6031279
  misc_feature (46)..(157): NCBI GI: 61658408 NCBI Desc: modulator of nongenomic actions of the estrogen receptor [xenopus laevis]
  misc_feature (74)..(116): NCBI GI: 46396546 NCBI Desc: chitin-binding lectin 1 precursor (pl-i)
  misc_feature (46)..(124): NCBI GI: 118472224 NCBI Desc: mmps3 protein [mycobacterium smegmatis str. mc2 155]
  misc_feature (48)..(124): NCBI GI: 28572033 NCBI Desc: cg1520-pc, isoform c [drosophila melanogaster]
  misc_feature (42)..(124): NCBI GI: 13265426 NCBI Desc: at2g14890 [arabidopsis thaliana]
MIFIVMITVGSVLFAKCCVGDRAFMRTGYDFEGYVMRKCPVCVGLPKPTHPRVKEVDPLQMTEITVEEARTSEPPAPPPATAAPPPPPAAATPAPPPATSAPPPAAAATPAPPPTVTGAVPVATKEDEEDEINEDEEEDDEEEEFDFDAYEEAEALGRL

SEQ ID NO: 11749 - DNA, 1032 bp, Sorghum bicolor
  misc_feature: Ceres ANNOT ID no. 6031423
  misc_feature: Encodes the peptide sequence at SEQ ID NO 11750
atggcgccgccgcggcgtgtgtgcgtgaccggaggcggagggttcattgcctcctggctcgtcaagctcctcctctcccgcggctacgccgtcccacgccacccttcgcgacccaatgtgggtgctcgttcaggtgatccaaagaatgcccatttgaaggagctggagaaggccccagagaatctgcatctgttcaaggccgacgtgctagactacgacacgctaacacctgcagttgagggatgtgaggggatcttccatctcgccactccggtgcctgaagataagattgttgatcctgagtcagaagtgctcgatactgctgtgaaaggtaccttaaatgtactgaagatctgctccgcttcaaaggttcacaaacttgttgtgatgtcctccaatgctgctgtggattttaacccaaattggcctcaggatgtagtgaaagatgagagttgctggtcagacaaggagttctgcaaggaaaatagggactggtattctgtcgccaagattactgcagaacagatagctttggaatatgcggttgaaaatggcctcaatgttgttacactttgcccgcctttggtttttggcccactgttgcagcctgcagtgaataccagcagcaaattcctcatatatgttataaaaggaggtcctgatgtgatgaacaacagactgtggcacatagtagacgtccgtgatgtggccgacgctttactcctgctgtacgagaagaaagagtcgtcagggagatacatctgctcaccgaatcacatttgcacaaaggatttggtggccttgttgaagaagctgcactcacagtatagctacataactaacatccttgatgtcgatcagaaagcatcgttaacatgtcagaagctgatggacctgggctgggaaccaaggaaactggaggagacgctctcggacagcgtcgagtgctacgaaaaggcagggcttctccgggatgtggccgggcatccttgccgccttccccatctcttccgtctggcatgtgaccagtga

SEQ ID NO: 11750 - protein, 343 aa, Sorghum bicolor
  misc_feature: Ceres ANNOT ID no. 6031423
  misc_feature (7)..(256): Pfam Id: Epimerase Pfam Desc: NAD dependent epimerase/dehydratase family
  misc_feature (8)..(285): Pfam Id: 3Beta_HSD Pfam Desc: 3-beta hydroxysteroid dehydrogenase/isomerase family
  misc_feature (9)..(240): Pfam Id: NAD_binding_4 Pfam Desc: Male sterility protein
  misc_feature (1)..(321): NCBI GI: 145337634 NCBI Desc: cinnamoyl-coa reductase [arabidopsis thaliana]
  misc_feature (7)..(323): NCBI GI: 2960364 NCBI Desc: cinnamoyl coa reductase [populus balsamifera subsp. trichocarpa]
  misc_feature (7)..(323): NCBI GI: 9998901 NCBI Desc: cinnamoyl-coa reductase [populus balsamifera subsp. trichocarpa]
  misc_feature (7)..(323): NCBI GI: 40233135 NCBI Desc: cinnamoyl coa reductase [populus tomentosa]
  misc_feature (7)..(323): NCBI GI: 9964087 NCBI Desc: cinnamoyl coa reductase [lolium perenne]
  misc_feature: Useful for making plants with altered Lignin content
  misc_feature: Useful for making plants with altered cell wall content and/or composition
  misc_feature: Functional homolog of the protein sequence given in SEQ ID NO 13345
  misc_feature: Functional homolog of the protein sequence encoded by LOCUS at2g33600
  misc_feature: Useful for making plants with altered carbohydrate content
  misc_feature: Functional homolog of the protein sequence given in SEQ ID NO 13693
  misc_feature: Useful for making plants with altered cell wall content and/or composition
  misc_feature: Functional homolog of the protein sequence given in SEQ ID NO 13694
MAPPRRVCVTGGGGFIASWLVKLLLSRGYAVPRHPSRPNVGARSGDPKNAHLKELEKAPENLHLFKADVLDYDTLTPAVEGCEGIFHLATPVPEDKIVDPESEVLDTAVKGTLNVLKICSASKVHKLVVMSSNAAVDFNPNWPQDVVKDESCWSDKEFCKENRDWYSVAKITAEQIALEYAVENGLNVVTLCPPLVFGPLLQPAVNTSSKFLIYVIKGGPDVMNNRLWHIVDVRDVADALLLLYEKKESSGRYICSPNHICTKDLVALLKKLHSQYSYITNILDVDQKASLTCQKLMDLGWEPRKLEETLSDSVECYEKAGLLRDVAGHPCRLPHLFRLACDQ

SEQ ID NO: 11751 - DNA, 558 bp, Sorghum bicolor
  misc_feature: Ceres ANNOT ID no. 6031490
  misc_feature: Encodes the peptide sequence at SEQ ID NO 11752
atgtcgaagcggctgctgtcgcggctgctcggcatgttccaatcgcggacgcaggtgggcgtcgacaaggccggcaaccgctacttcacccgcgtcgaggaggtcgacggcgccatgaaggagaggcggtgggtggagttcaagggcgccgaccaggactcgaccaccgttccagtcgagtggatttgctggctgaatggccaaaggaagaaagctccaacaccagaggaattggctgagctggaggcaaggcgtgaacgtgtcaagcaaaacattgcacttctcaaaaagaaagaagaagaggaaagaaaaaccggtatgcgaccagtcaagaaaattgggaaagctgaatctccaaatctccaaagttttgtgaagcagcagttctcaggtactcctccagatcagcagaaagttaacactttaggacctgaggaggtatctaggcctaaggacgcaactcatacagaagatgctacgacagacaatgacaggtcatctgaaccaacaggaactggcgccactttcaagccagggacttggcagccaccaacatga

SEQ ID NO: 11752 - protein, 185 aa, Sorghum bicolor
  misc_feature: Ceres ANNOT ID no. 6031490
  misc_feature (16)..(109): Pfam Id: NDUFA12 Pfam Desc: NADH ubiquinone oxidoreductase subunit NDUFA12
  misc_feature (1)..(185): NCBI GI: 115479965 NCBI Desc: os09g0500200 [oryza sativa (japonica cultivar-group)]
  misc_feature (39)..(185): NCBI GI: 79325281 NCBI Desc: oxidoreductase [arabidopsis thaliana]
  misc_feature (5)..(133): NCBI GI: 50926019 NCBI Desc: zgc:101036 protein [danio rerio]
  misc_feature (19)..(76): NCBI GI: 86573177 NCBI Desc: nadh:ubiquinone oxidoreductase 17.2 kd subunit [rhodopseudomonas palustris haa2]
  misc_feature (19)..(76): NCBI GI: 90424385 NCBI Desc: nadh:ubiquinone oxidoreductase 17.2 kd subunit [rhodopseudomonas palustris bisb18]
MSKRLLSRLLGMFQSRTQVGVDKAGNRYFTRVEEVDGAMKERRWVEFKGADQDSTTVPVEWICWLNGQRKKAPTPEELAELEARRERVKQNIALLKKKEEEERKTGMRPVKKIGKAESPNLQSFVKQQFSGTPPDQQKVNTLGPEEVSRPKDATHTEDATTDNDRSSEPTGTGATFKPGTWQPPT

SEQ ID NO: 11753 - DNA, 597 bp, Sorghum bicolor
  misc_feature: Ceres ANNOT ID no. 6031512
  misc_feature: Encodes the peptide sequence at SEQ ID NO 11754
atgagcactgtcagtggtacaaggcgtgcaccaaggagacagtcgcaagatgggtcagctgataaagtattggtgataatcgaggcaagctcccgggtggcggggagccgtcgtggaccaccgacccctgttcctggcgcacgaaactcacccattgatgtggaggccatcgacgatgaagttcaggcagtatcgccctcacgagtgcccccgccaaggaggaacaggaggaccaggagggaacctataacagtggttgacttggaggttgaatctagcagggaagggaacaaacgccagagggttgtaccagtaggacatcacctctcttcagattcgggagcagggtccagcttgcagtcaaatgccgtacaaaccggcaaagagcctgccaaggaggtccccaaggaaacatttttcacctgcccaatatgttggaataagatggaggagccttccacaacgacttgtggccatgtcttctgcgacacatgcatcaagcaggccatcaagattcagaagaaatgccctacttgcaggaaggggctgaaaatgaatagtgctcatcgcatttaccttccgaaagcttctagttaa

SEQ ID NO: 11754 - protein, 198 aa, Sorghum bicolor
  misc_feature: Ceres ANNOT ID no. 6031512
  misc_feature (142)..(179): Pfam Id: zf-C3HC4 Pfam Desc: Zinc finger, C3HC4 type (RING finger)
  misc_feature (48)..(193): NCBI GI: 24644441 NCBI Desc: cg10981-pb, isoform b [drosophila melanogaster]
  misc_feature (52)..(193): NCBI GI: 125774611 NCBI Desc: ga10686-pa [drosophila pseudoobscura]
  misc_feature (48)..(193): NCBI GI: 21357313 NCBI Desc: cg10981-pa, isoform a [drosophila melanogaster]
  misc_feature (104)..(193): NCBI GI: 20129579 NCBI Desc: cg15150-pa [drosophila melanogaster]
  misc_feature (123)..(192): NCBI GI: 116132180 NCBI Desc: ensangp00000029265 [anopheles gambiae str. pest]
  misc_feature: The sequence is a functional homolog of SEQ ID NO 2446 in the 10/374,780US patent application
  misc_feature: The sequence is a functional homolog of SEQ ID NO 736 in the 10/225,066US patent application
  misc_feature: The sequence is a functional homolog of SEQ ID NO 76 in the 10/666,642US patent application
  misc_feature: Useful for making plants with modulated growth and phenotype characteristics
  misc_feature: The sequence is a functional homolog of SEQ ID NO 736 in the 20050160493 US patent application
  misc_feature: The sequence is a functional homolog of SEQ ID NO 76 in the 20070033671 US patent application
MSTVSGTRRAPRRQSQDGSADKVLVIIEASSRVAGSRRGPPTPVPGARNSPIDVEAIDDEVQAVSPSRVPPPRRNRRTRREPITVVDLEVESSREGNKRQRVVPVGHHLSSDSGAGSSLQSNAVQTGKEPAKEVPKETFFTCPICWNKMEEPSTTTCGHVFCDTCIKQAIKIQKKCPTCRKGLKMNSAHRIYLPKASS

SEQ ID NO: 11755 - DNA, 1092 bp, Sorghum bicolor
  misc_feature: Ceres ANNOT ID no. 6031521
  misc_feature: Encodes the peptide sequence at SEQ ID NO 11756
atgctgcgctgccacacgccaccgcaatgcggccgcgcgccgctccgccaccacggaaggcgggagtcgcctccggcggcggcgcccggggtggtggtgcggtgcgcgcggggtgcgccgcaggtgcccgggatcgaggcggcgtcgccgggccatgcggctgccacggcggctaaggcggaagggggtgacgcgcggcccagtctggccgagcggctgcggctggggagcctcctggaggacgggctctcgtacaaggagagcttcatcgtgcgctgctacgaggtgggcatcaacaagacggccaccgtcgagaccatcgccaatctcctccaggaggtaggatgtaaccatgcacaaagtgttgggttctccactgatggcttcgccacaactactacaatgagaaaacttgggcttatttgggtgacgaatcgaatgcacattgagatctacaagtacccagcctggggtgatgttgttgagatcgaaacatggtgccaagaagatggaagaattggtactcgtcgtgattggatcctcaaggacctggctaatggtgaagttattggaagagctaccagcaagtgggtcatgatgaaccaaaatacacggagacttcagcgagtcagtgatgacgtaagggatgaggtgtttatacattgtccaaagactccaaggttagcattcccagaggaaaataatggcagtttgaagaagattccgaatctttcagatcctgcacaatactcaagactaggactagtgccaagaagagctgatctggacatgaaccaacatgtcaataatgttacttacattggttgggtcctggaaagtatacctcaagatataattgatacacacgagttacaaacaatcactctcgactatagaagagaatgtcaacatgatgacatagttgattcgcttacttacatagaggaaggagaggagaaaagcatgaacggctctgcttccgcagcgcctcacaaagaagagcggcagcagttcctgcattgcttaagatttgcagccaatggggacgagatcaaccgtggccgcacagtgtggaggaagctagctagataa

SEQ ID NO: 11756 - protein, 363 aa, Sorghum bicolor
  misc_feature: Ceres ANNOT ID no. 6031521
  misc_feature (82)..(360): Pfam Id: Acyl-ACP_TE Pfam Desc: Acyl-ACP thioesterase
  misc_feature (75)..(363): NCBI GI: 21262150 NCBI Desc: acyl-[acyl-carrier protein] thioesterase [triticum aestivum]
  misc_feature (88)..(363): NCBI GI: 115480015 NCBI Desc: os09g0505300 [oryza sativa (japonica cultivar-group)]
  misc_feature (1)..(363): NCBI GI: 18653907 NCBI Desc: acyl-acp thioesterase [iris tectorum]
  misc_feature (39)..(360): NCBI GI: 404028 NCBI Desc: oleoyl-acyl carrier protein thioesterase
  misc_feature (68)..(360): NCBI GI: 595957 NCBI Desc: br fata1
MLRCHTPPQCGRAPLRHHGRRESPPAAAPGVVVRCARGAPQVPGIEAASPGHAAATAAKAEGGDARPSLAERLRLGSLLEDGLSYKESFIVRCYEVGINKTATVETIANLLQEVGCNHAQSVGFSTDGFATTTTMRKLGLIWVTNRMHIEIYKYPAWGDVVEIETWCQEDGRIGTRRDWILKDLANGEVIGRATSKWVMMNQNTRRLQRVSDDVRDEVFIHCPKTPRLAFPEENNGSLKKIPNLSDPAQYSRLGLVPRRADLDMNQHVNNVTYIGWVLESIPQDIIDTHELQTITLDYRRECQHDDIVDSLTYIEEGEEKSMNGSASAAPHKEERQQFLHCLRFAANGDEINRGRTVWRKLAR

SEQ ID NO: 11757 - DNA, 2658 bp, Sorghum bicolor
  misc_feature: Ceres ANNOT ID no. 6031542
  misc_feature: Encodes the peptide sequence at SEQ ID NO 11758
atgagagtggcggtggtgggcgccggcgtgagcgggctggcggcggcgcacgagctggcgaggagcggcggcggcggcggcgcgaccgtgaccgtgtacgagaaggaggactacctcggtgggcacgccaggaccgtggccgtcgaggacgacgacgccgacggcggcggcaccgtgcagctcgacctcggcttcatggtcttcaaccgggttacatacccaaacatgctggaatggtttgaagggctcggagtggagatggagatatccgacatgtccttctcagtgagcacacaattggggaccagcgccagcagatgcgagtggggcagccgcaatggtatctcaggcctcttggcacagaaaagcaatgcactgagccctagtttttggcgcatgattcgtgagatactcaagttcaagaacgatgctctcaagtacttggaggaccatgaaaacaaccctgatatggaccggaatgagacccttgggcaattcattcagtctcatggatattctcagttcttccaagaggcttaccttatcccaatctgtgcgtgtatatggtcatgtccatcgcaaggagtgttcggattctctgctttctttgtgctctcattctgccgtaaccatcatcttcttcagttgttcggtcgcccccagtggctcacagtgaaaggtcgttcgcactcctatgtgcacaaggtaagggaggagttggaaagtatgggttgccaaattaaaacaagctgcgaaatcaaatctgtttcaagttctgagggaggtttcagggttacagtgtttgatggttcagaggagacatatgacagagtcatatttggtgtccacgcacctgatgctctaaagattctaggagctgaagcaacacacgaagaattgagaatcctaggagcttttcagtatgtctacagtgatatatacctccattccgataaaagcttgatgccacggagttcgtctgcttggagttcctggaacttcctgggcacgacaagcaagggggtttgtgtaacctactggctaaatctgcttcagaacatagaatctacaggcaggccttttctggtgacactgaatcctcctcatgtcccagatcatgtcttgcttaaatggtacactagccaccctgtcccgtctgtggctgccgcaaaggcttctcttgagcttcatcacattcaaggaaacagaggaatttggttctgcggggcataccaaggttatggcttccatgaagatggactcaaggctgggaaagctgcagctcaaaatttgcttggtaaggagagtggccttttggtgaacccaaaacagatgatcccatcgtggtctgagactggggcacgtcttctggtagcaagatttcttggtcaatatgtatccgtcggcaacttggtcttgcttgaagaaggaggcactatgttcagttttggtgaagtgggcaaacaatgccatgtgaaatctgtcctgcgagtacatgaccccatgttttactggaaggttgcaactgaagcagaccttggcttggcagatgcctacattaacggttatttctcatttgtagacaagagagaaggtcttctaaatcttttcctgattctcattgcaaacagggacgcaaacaagactagtagcagtgctgcaagtaaaaggggttggtggacacccctgctattgacagctggggttgcctccgctaaatacttcctgcgtcacatatcaaggaaaaattctgtcacacaaacacgtcaaaacatctctcaacactatgatctgagtaatgaattcttctcgcttttcctggatccatcaatgacttactcttgcgccatcttcaagacggaggatgaaagcttagaggcagcccagctacggaaagtttgcctcctaatccacaaggctaaagtggagcgagatcaccacgttcttgagattggttgtggctggggcagcttagcaatccaattggtgaagcaaactggttgcaaatacactgggatcacattatcagtggagcaactgaaatatgcacagagaaaagtgaaagaagctggcttagaggaccacataagcttcatgttgtgtgattaccgtcaaataccaacacaccgcaaatacgacaggatcatctcttgcgagatgatcgaaggtgttgggcacgaatacatggacgatttcttcggctgctgcgagacccttttggctcaagatggcatatttgtcctgcagttcatctcaatcccagaagaacggtacgaggaatacaggcgcagctcagacttcatcaaagaatacatcttccccgggggctgcatcccttcgttggcccggatcacgtctgccatgtctgcagcatcaaggctctgcatcgagcaccttgagaacattgggtaccattactacccaacgctgatacagtggagggacaacttcatggtcaataaggatgcaattttggccctgggcttcgatgagaaattcatccgtatatgggaatactacttcatatactgcgccgctggtttcaagtcacggacacttgggaattaccagattgtgttttctcgccctggcaacgacaaactgagcaacaacggcgatccttacgcaagctttccggcagctaatcaagctagctag

SEQ ID NO: 11758 - protein, 885 aa, Sorghum bicolor
  misc_feature: Ceres ANNOT ID no. 6031542
  misc_feature (583)..(862): Pfam Id: CMAS Pfam Desc: Cyclopropane-fatty-acyl-phospholipid synthase
  misc_feature (649)..(748): Pfam Id: Methyltransf_11 Pfam Desc: Methyltransferase domain
  misc_feature (649)..(746): Pfam Id: Methyltransf_12 Pfam Desc: Methyltransferase domain
  misc_feature (10)..(432): Pfam Id: Amino_oxidase Pfam Desc: Flavin containing amine oxidoreductase
  misc_feature (2)..(430): Pfam Id: DAO Pfam Desc: FAD dependent oxidoreductase
  misc_feature (1)..(881): NCBI GI: 18086398 NCBI Desc: at3g23510/mee5_5 [arabidopsis thaliana]
  misc_feature (1)..(882): NCBI GI: 50313464 NCBI Desc: cyclopropane fatty acid synthase [gossypium hirsutum]
  misc_feature (216)..(881): NCBI GI: 9294509 NCBI Desc: mycolic acid methyl transferase-like protein [arabidopsis thaliana]
  misc_feature (281)..(601): NCBI GI: 109676320 NCBI Desc: cyclopropane fatty acid synthase [populus trichocarpa]
  misc_feature (1)..(881): NCBI GI: 50313460 NCBI Desc: cyclopropane fatty acid synthase [gossypium hirsutum]
MRVAVVGAGVSGLAAAHELARSGGGGGATVTVYEKEDYLGGHARTVAVEDDDADGGGTVQLDLGFMVFNRVTYPNMLEWFEGLGVEMEISDMSFSVSTQLGTSASRCEWGSRNGISGLLAQKSNALSPSFWRMIREILKFKNDALKYLEDHENNPDMDRNETLGQFIQSHGYSQFFQEAYLIPICACIWSCPSQGVFGFSAFFVLSFCRNHHLLQLFGRPQWLTVKGRSHSYVHKVREELESMGCQIKTSCEIKSVSSSEGGFRVTVFDGSEETYDRVIFGVHAPDALKILGAEATHEELRILGAFQYVYSDIYLHSDKSLMPRSSSAWSSWNFLGTTSKGVCVTYWLNLLQNIESTGRPFLVTLNPPHVPDHVLLKWYTSHPVPSVAAAKASLELHHIQGNRGIWFCGAYQGYGFHEDGLKAGKAAAQNLLGKESGLLVNPKQMIPSWSETGARLLVARFLGQYVSVGNLVLLEEGGTMFSFGEVGKQCHVKSVLRVHDPMFYWKVATEADLGLADAYINGYFSFVDKREGLLNLFLILIANRDANKTSSSAASKRGWWTPLLLTAGVASAKYFLRHISRKNSVTQTRQNISQHYDLSNEFFSLFLDPSMTYSCAIFKTEDESLEAAQLRKVCLLIHKAKVERDHHVLEIGCGWGSLAIQLVKQTGCKYTGITLSVEQLKYAQRKVKEAGLEDHISFMLCDYRQIPTHRKYDRIISCEMIEGVGHEYMDDFFGCCETLLAQDGIFVLQFISIPEERYEEYRRSSDFIKEYIFPGGCIPSLARITSAMSAASRLCIEHLENIGYHYYPTLIQWRDNFMVNKDAILALGFDEKFIRIWEYYFIYCAAGFKSRTLGNYQIVFSRPGNDKLSNNGDPYASFPAANQAS

SEQ ID NO: 11759 - DNA, 801 bp, Sorghum bicolor
  misc_feature: Ceres ANNOT ID no. 6031553
  misc_feature: Encodes the peptide sequence at SEQ ID NO 11760
atggagcacccatgggtctctgcttttggcattctaggcaacatcatctccttcctggtgttcctcgcaccagtgccgacgttccttcgcgtgtaccggaagaagtcgacggaggggttcagctcggtgccgtacgtggtggccctgttcagctgcacgctgtggatcctgtacgcggtggtgaagaccaactcgagcccgctgctgaccatcaacgccttcggctgcgtggtggaggccacctacatcctgctctacctcatctacgcgccccgggccgccaggctcagggcgctcgccttcttcttcctcctcgacgtggccgccttggcgctcatcgtcgtcgtcgtcgtcgtgctcgtcgcggagccgcaccgcgtaaaagtgctcggcagcatctgcctcgccttctccatggccgtcttcgtcgcgcccctcagcgtcatctttgttgtgatcaggaccaagagtgccgagttcatgcccttcaccctctccttcttcctcaccctcagcgccgtcgcatggttcttgtacggcatcttcaccaaggacccctacgtcacgctcccgaacgtgggcggcttcttcttcggttgcatccagatggtgctctactgctgctaccggaagccctcggcgtccgtggtcctgccgacgacgacggacgccgccgccacggagatggagctgcccctcgccgcccaccaggccgtggccccggtgctggccgagctgcagaagctggaggaggccatggggtcgccgcgcaagcatggcggcgtcgtcaaggtcgtctga

SEQ ID NO: 11760 - protein, 266 aa, Sorghum bicolor
  misc_feature: Ceres ANNOT ID no. 6031553
  misc_feature (7)..(94): Pfam Id: MtN3_slv Pfam Desc: MtN3/saliva family
  misc_feature (128)..(214): Pfam Id: MtN3_slv Pfam Desc: MtN3/saliva family
  misc_feature (1)..(250): NCBI GI: 89892340 NCBI Desc: disease resistant allele xa13 [oryza sativa (indica cultivar-group)]
  misc_feature (1)..(250): NCBI GI: 89892336 NCBI Desc: disease resistant allele xa13 [oryza sativa (indica cultivar-group)]
  misc_feature (1)..(250): NCBI GI: 113624323 NCBI Desc: os08g0535200 [oryza sativa (japonica cultivar-group)]
  misc_feature (9)..(253): NCBI GI: 21593422 NCBI Desc: senescence-associated protein (sag29) [arabidopsis thaliana]
  misc_feature (5)..(241): NCBI GI: 21593109 NCBI Desc: mtn3-like protein [arabidopsis thaliana]
  misc_feature: The sequence is a functional homolog of SEQ ID NO. 328 in the 11/188,298 US application
MEHPWVSAFGILGNIISFLVFLAPVPTFLRVYRKKSTEGFSSVPYVVALFSCTLWILYAVVKTNSSPLLTINAFGCVVEATYILLYLIYAPRAARLRALAFFFLLDVAALALIVVVVVVLVAEPHRVKVLGSICLAFSMAVFVAPLSVIFVVIRTKSAEFMPFTLSFFLTLSAVAWFLYGIFTKDPYVTLPNVGGFFFGCIQMVLYCCYRKPSASVVLPTTTDAAATEMELPLAAHQAVAPVLAELQKLEEAMGSPRKHGGVVKVV

SEQ ID NO: 11761 - DNA, 972 bp, Sorghum bicolor
  misc_feature: Ceres ANNOT ID no. 6031602
  misc_feature: Encodes the peptide sequence at SEQ ID NO 11762
  misc_feature: Down-regulated in shoot tissues in response to salicylic acid treatment
atggcttccgatgagagcaaaaattcgaaaccagagaagctgtcttcagcagctggtgcaggcctccccaatccttttgatttttcttctatgagcagtttgctcaatgacccatcaataagagagatggcggagcaaattgcaagtgaccctgtgttcaaccagatggctgaacaacttcagaaaagtgctcagggtgctggagaacagggtatccctgcattggatcctcaacagtatatggaaacaatgcaacaagtcatgcaaaatcctcagtttgtgtcaatggcagagcgtcttgggaatgctcttatgcaggatcctgctatgtccagtatgctcgagaactttaccagtccagctcataaagagcagcttgaggagaggatggcccgtatcaaggaagatccatccttgaagccaattcttgatgagatagagaatgggggtccatctgcaatggtgaagtattggaatgaccctgaggttcttcaaaagattggccaggcaatgggagttggccttcccggagattctagtgcatccactgcgctctctggacctgaagagactgaggaggaaggaggggacgatgatgagtccattgttcatcacactgcaagtgttggtgatgaagagggtctgaagaaagctttagatggtggagcagacaaggatgaagaagatgccgagggaagaagggctttacattttgcatgtggctatggtgagttgaagtgtgcggaaatccttctggaggcaggggctgcagttgatgcgctagataagaacaagaacactccgttgcattacgctgctgggtatggtcggaaggaatgcgtggatcttctgttgaagtatggtgctgctgtcacgctccagaatctggacgggaaaacacccatcgaggttgccaggctcaacagtcaggatgaggttctcaagttgctagagaaggacgctttcctatag

SEQ ID NO: 11762 - protein, 323 aa, Sorghum bicolor
  misc_feature: Ceres ANNOT ID no. 6031602
  misc_feature (231)..(263): Pfam Id: Ank Pfam Desc: Ankyrin repeat
  misc_feature (264)..(296): Pfam Id: Ank Pfam Desc: Ankyrin repeat
  misc_feature (4)..(323): NCBI GI: 115480107 NCBI Desc: os09g0513000 [oryza sativa (japonica cultivar-group)]
  misc_feature (2)..(323): NCBI GI: 13310811 NCBI Desc: ankyrin-repeat protein hbp1 [nicotiana tabacum]
  misc_feature (2)..(323): NCBI GI: 24637568 NCBI Desc: ankyrin domain protein [nicotiana tabacum]
  misc_feature (2)..(323): NCBI GI: 29826244 NCBI Desc: tgb12k interacting protein 3 [nicotiana tabacum]
  misc_feature (2)..(323): NCBI GI: 29826242 NCBI Desc: tgb12k interacting protein 2 [nicotiana tabacum]
  misc_feature: The sequence is a functional homolog of SEQ ID NO 1839 in the 10/374,780US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO 1839 in the 10/374,780 US patent application
  misc_feature: Down-regulated in shoot tissues in response to salicylic acid treatment
MASDESKNSKPEKLSSAAGAGLPNPFDFSSMSSLLNDPSIREMAEQIASDPVFNQMAEQLQKSAQGAGEQGIPALDPQQYMETMQQVMQNPQFVSMAERLGNALMQDPAMSSMLENFTSPAHKEQLEERMARIKEDPSLKPILDEIENGGPSAMVKYWNDPEVLQKIGQAMGVGLPGDSSASTALSGPEETEEEGGDDDESIVHHTASVGDEEGLKKALDGGADKDEEDAEGRRALHFACGYGELKCAEILLEAGAAVDALDKNKNTPLHYAAGYGRKECVDLLLKYGAAVTLQNLDGKTPIEVARLNSQDEVLKLLEKDAFL

SEQ ID NO: 11763 - DNA, 1515 bp, Sorghum bicolor
  misc_feature: Ceres ANNOT ID no. 6031612
  misc_feature: Encodes the peptide sequence at SEQ ID NO 11764
atggatgctgtcatcgcgttcacctcaggaagccctagccccacgcgcttctactactcagcttcgccgtcgatacgcgtcccccagagcctctctgtctgcggcccatggcgcgggcgtgggcgccccctcctcgcgctccggcatcggtcccagacccaggccaccgcagcggcggccggggcggccgaagtatcccaccacgatgttgtagttgtgggcgctgggatcgtcgggctcgccatcgcgcgccacctcctcctccacacttctctctccgttgccatcgccgacgctgccgtcccctgctccggtgccacaggcgcagggcagggatacatatggatgtcgcaccggaggccggggagtgacacgtgggagctggcgctgcggagcaagcaactttgggaggagctggcggccgaggttgacggccagggaggcggcggtgcacgggagagattgggttggatgaggacaggaagcttgctagttgggagaacttcggaagagctggacacattggaggaaaggaccaaggttctgtctcaggcaggcatacatgtggaattcttgtcagcctcttcattacatgcattagaaccggcactcagtgtagggaaagatggtggtgctatgttcttgccacaagactgtcagattgatgcattccaggctgtctctttgattgagaagtgtctcactgatatttcttggttcattttcttatgcaagaccaataactcatattcctcagaaggaaggtatagggagttctataatgatcctgccatgtcattaataagatcggaggttactggaacagttgaagctgtccaaacttccagaaacatattgtatggcagaaaagcttttataattgcttctggcgcctggactcgatccttattgcatagtttcttagaaccagctttgatgttggatattcctgtcaaaccacgaaagggccatcttcttgtgttggagaaatttgacaaggttaagttgaatcatgccctgatggaggtaggatatgttgaccatcagattgctaagccaaatagcacacacatggcttcagaatctagtgaagatgagcttggtgctttatccgtatcaatgactgcaaccgtagatacaaaggggaatttagttctaggaagcagccgggagttcaaaggtttttcgagggaggttgatagatccgttgttcagtgtatatgggaacgtgcaggagagttttttcctgcaatgaagaatgtttcttttgatattgatcagaatactcaaatcagaatagggcatcgcccatacatgcctgatggaaagccagttattgactttattcctgatctgccaaatattttgattgcaacaggacatgaaggaaatggacttactttggcactaggcactgctgaaatggtcaccgatatgattcttgggaatcctggaaaagtgagccactcacctttctccatcaaacacagattttcaggtaattttggtaaatag

SEQ ID NO: 11764 - protein, 504 aa, Sorghum bicolor
  misc_feature: Ceres ANNOT ID no. 6031612
  misc_feature (69)..(479): Pfam Id: DAO Pfam Desc: FAD dependent oxidoreductase
  misc_feature (50)..(351): NCBI GI: 79612894 NCBI Desc: oxidoreductase [arabidopsis thaliana]
  misc_feature (344)..(493): NCBI GI: 21108820 NCBI Desc: d-amino acid oxidase [xanthomonas axonopodis pv. citri str. 306]
  misc_feature (344)..(493): NCBI GI: 77748662 NCBI Desc: d-amino acid oxidase [xanthomonas axonopodis pv. citri str. 306]
  misc_feature (65)..(230): NCBI GI: 133912410 NCBI Desc: secreted oxidoreductase [saccharopolyspora erythraea nrrl 2338]
  misc_feature (307)..(480): NCBI GI: 126651471 NCBI Desc: sarcosine oxidase, beta subunit [bacillus sp. b14905]
MDAVIAFTSGSPSPTRFYYSASPSIRVPQSLSVCGPWRGRGRPLLALRHRSQTQATAAAAGAAEVSHHDVVVVGAGIVGLAIARHLLLHTSLSVAIADAAVPCSGATGAGQGYIWMSHRRPGSDTWELALRSKQLWEELAAEVDGQGGGGARERLGWMRTGSLLVGRTSEELDTLEERTKVLSQAGIHVEFLSASSLHALEPALSVGKDGGAMFLPQDCQIDAFQAVSLIEKCLTDISWFIFLCKTNNSYSSEGRYREFYNDPAMSLIRSEVTGTVEAVQTSRNILYGRKAFIIASGAWTRSLLHSFLEPALMLDIPVKPRKGHLLVLEKFDKVKLNHALMEVGYVDHQIAKPNSTHMASESSEDELGALSVSMTATVDTKGNLVLGSSREFKGFSREVDRSVVQCIWERAGEFFPAMKNVSFDIDQNTQIRIGHRPYMPDGKPVIDFIPDLPNILIATGHEGNGLTLALGTAEMVTDMILGNPGKVSHSPFSIKHRFSGNFGK

SEQ ID NO: 11765 - DNA, 507 bp, Sorghum bicolor
  misc_feature: Ceres ANNOT ID no. 6031844
  misc_feature: Encodes the peptide sequence at SEQ ID NO 11766
atggcttgcaagccgtactacagcaccaacagctgcacaggccgccaagctactacgaacgcgccgtcatttccacgaccgccggcgccaccccagcctgggctcctgccgctgccagctcagccctcgccgctgtactccttcgagccagcgagccgccggccggctccgcgtgccaacaagaagccacgcggctacgacgccgcgccagctggggcctcggcgccgatcgccgtcgccgaaccgtccaagaagagggtggcgccggcgccggcgactgggctggaggaggaggagttactggagtggacggagacggcggcggactcgctgtactccgtgtccccaccgccgagcagcgtgccgatgcctacgtccctgttgctcactgtcgcggcggccaggaaggcgcccacggcctgcgccgtggaagtggcgaccggcgccggcagcggcggcgtggatgtcggcgccaccgacgagctccgacggatcctcaggctttag

SEQ ID NO: 11766 - protein, 168 aa, Sorghum bicolor
  misc_feature: Ceres ANNOT ID no. 6031844
  misc_feature (17)..(153): NCBI GI: 38565529 NCBI Desc: atherin [homo sapiens]
  misc_feature (14)..(91): NCBI GI: 50508506 NCBI Desc: hydroxyproline-rich glycoprotein -like [oryza sativa (japonica cultivar-group)]
  misc_feature (14)..(91): NCBI GI: 38345924 NCBI Desc: osjnbb0076a11.12 [oryza sativa (japonica cultivar-group)]
  misc_feature (14)..(91): NCBI GI: 38347650 NCBI Desc: osjnba0045o17.9 [oryza sativa (japonica cultivar-group)]
  misc_feature (14)..(91): NCBI GI: 47777375 NCBI Desc: unknow protein [oryza sativa (japonica cultivar-group)]
MACKPYYSTNSCTGRQATTNAPSFPRPPAPPQPGLLPLPAQPSPLYSFEPASRRPAPRANKKPRGYDAAPAGASAPIAVAEPSKKRVAPAPATGLEEEELLEWTETAADSLYSVSPPPSSVPMPTSLLLTVAAARKAPTACAVEVATGAGSGGVDVGATDELRRILRL

SEQ ID NO: 11767 - DNA, 453 bp, Sorghum bicolor
  misc_feature: Ceres ANNOT ID no. 6031912
  misc_feature: Encodes the peptide sequence at SEQ ID NO 11768
atgatcagtgccaagaggcttgttcagatggcaaagaagtggcagagaatggctgccttggcgaggaagcggcttacctcgatgccggcaaaagaaaccgaagcatcctgtgggacgtcgtcgacggcaatggccagcaagggccactgcgttgtgtactctgctgatggaaggcggttcgaggtgccgctggcataccttggcacggtggtcctcggtgagctcctgcgcatgtcgcaggaggagtttgggttcgtgagcgatggtggcaggatcacgctgccctgtgacgccgccgtgatggagtacgccatgcatttggttagaagagatgcttctgaggaggttgtgagggcgctcttgagctccatggtcaggccttgccacactgtcagtgtcattggcgtggcgccatcgatggagctcaagcagcagctagctgtatgtgtataa

SEQ ID NO: 11768 - protein, 150 aa, Sorghum bicolor
  misc_feature: Ceres ANNOT ID no. 6031912
  misc_feature (10)..(109): Pfam Id: Auxin_inducible Pfam Desc: Auxin responsive protein
  misc_feature (1)..(148): NCBI GI: 115480483 NCBI Desc: os09g0545300 [oryza sativa (japonica cultivar-group)]
  misc_feature (1)..(148): NCBI GI: 32187718 NCBI Desc: auxin induced protein [zea mays]
  misc_feature (1)..(98): NCBI GI: 115480493 NCBI Desc: os09g0546200 [oryza sativa (japonica cultivar-group)]
  misc_feature (1)..(149): NCBI GI: 20149052 NCBI Desc: auxin-induced saur-like protein [capsicum annuum]
  misc_feature (1)..(124): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISAKRLVQMAKKWQRMAALARKRLTSMPAKETEASCGTSSTAMASKGHCVVYSADGRRFEVPLAYLGTVVLGELLRMSQEEFGFVSDGGRITLPCDAAVMEYAMHLVRRDASEEVVRALLSSMVRPCHTVSVIGVAPSMELKQQLAVCV

SEQ ID NO: 11769 - DNA, 441 bp, Sorghum bicolor
  misc_feature: Ceres ANNOT ID no. 6031920
  misc_feature: Encodes the peptide sequence at SEQ ID NO 11770
atgatcagtgccaagaggattgtttggatggcaaagaagtggcagagaatggctgccctggcgaggaagcggctcacggcgactccgcggaaagaagacgccgattgtccgtgcagcgcatcgacgtcggtggccgtcaagggccattgtgtcgtgtactcctccgacgggaggcggttcgaggtcccgctggcgtaccttggcacagcggtgttcagcgagctcctgagcatgtcgcgggaggagtttgggtttgccggcgccaatggcaggatcacgttgccctgtgacgccgcggtggtggattacatgatgcatttgcttaggcgagacgcctctgaagagattgcgagggcgttcttgagctccatggccagaccttgccaccacagcgtcagtggcatggcgccatcggtgcgccaatcagctatctgtgtatag

SEQ ID NO: 11770 - protein, 146 aa, Sorghum bicolor
  misc_feature: Ceres ANNOT ID no. 6031920
  misc_feature (1)..(109): Pfam Id: Auxin_inducible Pfam Desc: Auxin responsive protein
  misc_feature (1)..(139): NCBI GI: 32187718 NCBI Desc: auxin induced protein [zea mays]
  misc_feature (1)..(142): NCBI GI: 115480483 NCBI Desc: os09g0545300 [oryza sativa (japonica cultivar-group)]
  misc_feature (1)..(98): NCBI GI: 115480493 NCBI Desc: os09g0546200 [oryza sativa (japonica cultivar-group)]
  misc_feature (1)..(128): NCBI GI: 20149052 NCBI Desc: auxin-induced saur-like protein [capsicum annuum]
  misc_feature (1)..(125): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISAKRIVWMAKKWQRMAALARKRLTATPRKEDADCPCSASTSVAVKGHCVVYSSDGRRFEVPLAYLGTAVFSELLSMSREEFGFAGANGRITLPCDAAVVDYMMHLLRRDASEEIARAFLSSMARPCHHSVSGMAPSVRQSAICV

SEQ ID NO: 11771 - DNA, 792 bp, Sorghum bicolor
  misc_feature: Ceres ANNOT ID no. 6032001
  misc_feature: Encodes the peptide sequence at SEQ ID NO 11772
atgctcctccccctcctcagatcccacccgctgctcctccaccgcgccgcgcgactgtcctccccgcgcacccgcctgctcctccgccgcgacgcgctcccgctcgcgcgctccccgcctatccgcatggcggcctcgtccggctccggcgccagctcccctgccccggcgccgcctgctgccgtggtgcacaagtcaaagatcaaattctgccctgcttgtggaagtccgacgaaattggccatacctgatggtgatgagaagatgagggctgtttgttcttcttgtggaagagttcactacgaaaacccaaaaatggttgttggttgccttgtggagcatgataataaggttctcctttgcagaagaaagattgaaccggcttatggtctttggacacttcctgctggttatttagaggtgggggagtctgctgctgaaggagcctctagagaaacattagaagaagcatgtgcagatgtagagatagtctcaccttttgctcagttggatattccactgattggccaaagttacattattttccgagcaaggttgaagacccccaacttttcacctggggcggagtcgctggaatgtgcactttttgctctggatgatataccatttgattctcttgcattttcttcaatcattgtcaccttaaggatgtatactgaagatgtgagatctggaagcatcaaatttcactattgcactataaacaaaaggttaggagccagcccttcagatcttcggagtttcgatatcgataaccatatagctgtgtga

SEQ ID NO: 11772 - protein, 263 aa, Sorghum bicolor
  misc_feature: Ceres ANNOT ID no. 6032001
  misc_feature (104)..(224): Pfam Id: NUDIX Pfam Desc: NUDIX domain
  misc_feature (66)..(101): Pfam Id: zf-NADH-PPase Pfam Desc: NADH pyrophosphatase zinc ribbon domain
  misc_feature (5)..(177): NCBI GI: 115480573 NCBI Desc: os09g0553300 [oryza sativa (japonica cultivar-group)]
  misc_feature (68)..(241): NCBI GI: 82411713 NCBI Desc: nudix hydrolase [nitrosospira multiformis atcc 25196]
  misc_feature (62)..(237): NCBI GI: 118733330 NCBI Desc: nudix hydrolase [delftia acidovorans sph-1]
  misc_feature (68)..(242): NCBI GI: 120611143 NCBI Desc: nudix hydrolase [acidovorax avenae subsp. citrulli aac00-1]
  misc_feature (68)..(237): NCBI GI: 118038796 NCBI Desc: nudix hydrolase [burkholderia phytofirmans psjn]
MLLPLLRSHPLLLHRAARLSSPRTRLLLRRDALPLARSPPIRMAASSGSGASSPAPAPPAAVVHKSKIKFCPACGSPTKLAIPDGDEKMRAVCSSCGRVHYENPKMVVGCLVEHDNKVLLCRRKIEPAYGLWTLPAGYLEVGESAAEGASRETLEEACADVEIVSPFAQLDIPLIGQSYIIFRARLKTPNFSPGAESLECALFALDDIPFDSLAFSSIIVTLRMYTEDVRSGSIKFHYCTINKRLGASPSDLRSFDIDNHIAV

SEQ ID NO: 11773 - DNA, 2025 bp, Sorghum bicolor
  misc_feature: Ceres ANNOT ID no. 6032017
  misc_feature: Encodes the peptide sequence at SEQ ID NO 11774
atggcggctcccgtcagggccctcccgctcccgtcgcccgtcgcgccccgcatgaccttgcgggaccgcagcagctgcagccggtgccgcgcccccggagttcgcgcggcggcggcggcggcggcggcggcggcgggtgcttcgcgggcgacggagcccgtggaggtggtcggcgtaggcagccggaaggacgccgtcattgacttctgcctgggctcacgcacgctgtcctccacccccatccgcttctggacagtacatgttatggataattctaaagttcagttaatacaaaaaggtcatggaactgatgcagtgttcagagacttggaatctcccttatttcttcatccctgcccgcctgcggttattcttgtttctagtgcaggacaagatgctgatcatattactgcaatggagcttcttagtgctgtcaaatctgctggtaatctggcagcatcaatatttttgaagcccttctgcttcgagggacaaagaaggcaagtagaggcagctgatttgattggcaaacttcaaacgtgctcaaactttcatattgttattgaagctgattcattgcttgagacggaagtggaaactcttgctgaagctttagaaagtgccaataatgctgtcctgtcaactattagcatgatatctatcatgatgtctggttataataagatgttctggagttcccttaatgcacaaattaaagaaattggtcctgaggaagtagccaagctactcagaagctatggggaagctagagttggctttggtgctggttataacatccagtcagcaattaagcaggctgtcttccactgtccatttcttcttggtggcataaaggacttgaacaatgtggttttcctctcccttacaactgctcgggtgttgtctgaaagtgacatgatctccattctgcacatctttcgtcgagttactgggttcatgaaagatattatattttctagaaattctgaacctgatttagagccaaaactgatagtagtatctcttctaactacccgaaaccactatgatgaaagtgtttccacagtacaagagggctttctttcaagtttggcctttcattttccttttatatcctcttttatgggaggagatatccctgaacagaaacaaattaggtcgaagcattcctttaatcgactgcctgagaacagaactaattctgtagaacaagacgaattctcacaactttctaattggtcatctgatgctgctactgttcctaaattatttcctgaagaatttgaggatttggaatctgtgagagacagtaatgacaggaatgagagaataaagccagaatctctggaagataatttggcagttactggagaaatgagcaaagatgatgacagagagcatttagcttcacagcaggaacatcgtttcttgagcaattcccctggttttgatattgcacaattgtgggctaagcagcgtgcgatggcaaatggaagcagtgaaaatgatgagcttgatattgtcacttttcctgttggtgtaaaacttagcaaagttcagtctgatcattctccaaatacgcaacctgaaactcttggtgctgacacaactgttgctactgggcatgctgcctttggagtatcattttctgatgttcctttggagaaagtaatggacatgtgtagttctgcagtcgcatttctgaggaatagaatgaacaggtctcgaaagcatggctcaaactcaatatccagccgggctgccctgatgctcgatgcagaaagagaaccagaaaagacatggagccccatagttgaaatacgttatggagggggaacttatagaggtagatgccaagaaggtgttcctgaaggaaagggacgtctaaccttcagtgacggaagcttttatgatggactctggaggtatggtaagagatctggtttggggactctatttcacagtaacggtgatgtatatcatgggacatggagggatgaccttattcatggaaaggtggattga

SEQ ID NO: 11774 - protein, 674 aa, Sorghum bicolor
  misc_feature: Ceres ANNOT ID no. 6032017
  misc_feature (637)..(659): Pfam Id: MORN Pfam Desc: MORN repeat
  misc_feature (1)..(672): NCBI GI: 115480599 NCBI Desc: os09g0555600 [oryza sativa (japonica cultivar-group)]
  misc_feature (1)..(672): NCBI GI: 49614763 NCBI Desc: arc3 homologue [oryza sativa (japonica cultivar-group)]
  misc_feature (4)..(466): NCBI GI: 5882723 NCBI Desc: f25a4.3 [arabidopsis thaliana]
  misc_feature (611)..(672): NCBI GI: 110637074 NCBI Desc: possible phosphatidylinositol-4-phosphate 5-kinase [cytophaga hutchinsonii atcc 33406]
  misc_feature (611)..(672): NCBI GI: 67612667 NCBI Desc: phosphatidylinositol-4-phosphate 5-kinase, 11335-7537 [cryptosporidium hominis]
MAAPVRALPLPSPVAPRMTLRDRSSCSRCRAPGVRAAAAAAAAAAGASRATEPVEVVGVGSRKDAVIDFCLGSRTLSSTPIRFWTVHVMDNSKVQLIQKGHGTDAVFRDLESPLFLHPCPPAVILVSSAGQDADHITAMELLSAVKSAGNLAASIFLKPFCFEGQRRQVEAADLIGKLQTCSNFHIVIEADSLLETEVETLAEALESANNAVLSTISMISIMMSGYNKMFWSSLNAQIKEIGPEEVAKLLRSYGEARVGFGAGYNIQSAIKQAVFHCPFLLGGIKDLNNVVFLSLTTARVLSESDMISILHIFRRVTGFMKDIIFSRNSEPDLEPKLIVVSLLTTRNHYDESVSTVQEGFLSSLAFHFPFISSFMGGDIPEQKQIRSKHSFNRLPENRTNSVEQDEFSQLSNWSSDAATVPKLFPEEFEDLESVRDSNDRNERIKPESLEDNLAVTGEMSKDDDREHLASQQEHRFLSNSPGFDIAQLWAKQRAMANGSSENDELDIVTFPVGVKLSKVQSDHSPNTQPETLGADTTVATGHAAFGVSFSDVPLEKVMDMCSSAVAFLRNRMNRSRKHGSNSISSRAALMLDAEREPEKTWSPIVEIRYGGGTYRGRCQEGVPEGKGRLTFSDGSFYDGLWRYGKRSGLGTLFHSNGDVYHGTWRDDLIHGKVD

SEQ ID NO: 11775 - DNA, 1299 bp, Sorghum bicolor
  misc_feature: Ceres ANNOT ID no. 6032072
  misc_feature: Encodes the peptide sequence at SEQ ID NO 11776
atgttccgccgcctcctcccccaccgcagccacttctccacctcgtccgcatccaactccaccccgaccctctactctgaaggaacaatcccattctccctcctctcgtggggtcgtggcgcttccggacagctcggcggcggcaaggaggagcgccgcctctacccatcccccgtcgcccacctccttctccccgaatcagacccacgccttgcgcccacccccggacgccttccctctgcaggggagacgtctggagtggaggttgggatctcctgtgggctcttccactccgcgctcctcgtcgaaggaagcgtctgggtgtggggcaagggcgacggaggccgcctcggcctcggtgacgagtcttccgccttcgtgccccgccctaaccccaacctccgcgatctccgcctcctcgcgctcggcggcatccactccgccgcactgaccacctctggtgacgtcttcacctggggttatggtggatttggagctctggggcactatgtataccatagggagcttttgccaaggcaagtgaatggcccttgggaagggaagataacacacatttctactagtggagcacatactgcagcaatcaccgactcaggtgaactttacacttggggtcgtgatgaaggtgatggtaggctggggcttgggagtggaggtggtccaggtgaagctggctccctcagtgttccttccaaggtgaatgcattgcctgttccagttgccgctgtagcttgtggtggcttcttcacaatggctcttacttcagatggacagttatggagttggggagcaaattcaaacttcgaactgggtagaggaagcaatttcagtgattggaggccacagcttgtccctagtctgaaaagtatccgtgtaatccaagtagcatgtggcggatatcattctttagctttgactgatgaaggtgaagttctctcttgggggcatggtgggcacggacaacttgggcatcccacccttcaaaatcatagaatcccacttgccatcaaagctttatctgatgagcgaattgtccatatagcctgtggaggatcaacctctgctgctatatcagaaaaaggtgacttgtacatgtggggaaatgcaagagactgccagctaggcgtccctggtttgccagaagttcagccactcccagtcaaggtgaatttcctcagagatggtgatgaagatttgggtccttctcgtgtcatctccgttgcaataggagcctcccatgccatgtgcttggtctccatgcaacaaactgagaaatag

SEQ ID NO: 11776 - protein, 432 aa, Sorghum bicolor
  misc_feature: Ceres ANNOT ID no. 6032072
  misc_feature (205)..(260): Pfam Id: RCC1 Pfam Desc: Regulator of chromosome condensation (RCC1)
  misc_feature (263)..(312): Pfam Id: RCC1 Pfam Desc: Regulator of chromosome condensation (RCC1)
  misc_feature (315)..(364): Pfam Id: RCC1 Pfam Desc: Regulator of chromosome condensation (RCC1)
  misc_feature (3)..(424): NCBI GI: 124359876 NCBI Desc: regulator of chromosome condensation/beta-lactamase-inhibitor protein ii [medicago truncatula]
  misc_feature (54)..(426): NCBI GI: 42573750 NCBI Desc: regulator of chromosome condensation (rcc1) family protein [arabidopsis thaliana]
  misc_feature (1)..(241): NCBI GI: 52077045 NCBI Desc: herc2 -like [oryza sativa (japonica cultivar-group)]
  misc_feature (160)..(426): NCBI GI: 62320260 NCBI Desc: uvb-resistance protein uvr8 - like [arabidopsis thaliana]
  misc_feature (91)..(382): NCBI GI: 91201899 NCBI Desc: similar to chromosomal condensation regulatory protein [candidatus kuenenia stuttgartiensis]
MFRRLLPHRSHFSTSSASNSTPTLYSEGTIPFSLLSWGRGASGQLGGGKEERRLYPSPVAHLLLPESDPRLAPTPGRLPSAGETSGVEVGISCGLFHSALLVEGSVWVWGKGDGGRLGLGDESSAFVPRPNPNLRDLRLLALGGIHSAALTTSGDVFTWGYGGFGALGHYVYHRELLPRQVNGPWEGKITHISTSGAHTAAITDSGELYTWGRDEGDGRLGLGSGGGPGEAGSLSVPSKVNALPVPVAAVACGGFFTMALTSDGQLWSWGANSNFELGRGSNFSDWRPQLVPSLKSIRVIQVACGGYHSLALTDEGEVLSWGHGGHGQLGHPTLQNHRIPLAIKALSDERIVHIACGGSTSAAISEKGDLYMWGNARDCQLGVPGLPEVQPLPVKVNFLRDGDEDLGPSRVISVAIGASHAMCLVSMQQTEK

SEQ ID NO: 11777 - DNA, 348 bp, Sorghum bicolor
  misc_feature: Ceres ANNOT ID no. 6032090
  misc_feature: Encodes the peptide sequence at SEQ ID NO 11778
atggagcggcccaaattggaccaagcaaacaggcggggcgggctggagctgctcctagagaactccaccaaggtgcacaaggtggagatcaccacgtccaaggacggccaaggcaaggtcaccacgcccaaggagggccaagacaaggtcacgatgaagtcgctgctttcttgggtcaaggacaatctgatcaaggagcgcccggagatgttcgtcaagggcgattccgtgaggcctggggttcttgtccttgtaaatgactgtgattgggagctgtgtggtggtcttgatgcagagttggaagagaaggatgttgtggttttcatctccactttgcatggtggttag

SEQ ID NO: 11778 - protein, 115 aa, Sorghum bicolor
  misc_feature: Ceres ANNOT ID no. 6032090
  misc_feature (13)..(115): Pfam Id: Urm1 Pfam Desc: Urm1 (Ubiquitin related modifier)
  misc_feature (13)..(115): NCBI GI: 21624374 NCBI Desc: ubiquitin-related modifier-1 [oryza sativa (indica cultivar-group)]
  misc_feature (13)..(115): NCBI GI: 20146104 NCBI Desc: rurm1 [oryza sativa]
  misc_feature (39)..(115): NCBI GI: 119608188 NCBI Desc: chromosome 9 open reading frame 74, isoform cra_a [homo sapiens]
  misc_feature (35)..(115): NCBI GI: 56554614 NCBI Desc: chain a, solution structure of ubiquitin like protein from mus musculus
  misc_feature (13)..(115): NCBI GI: 95102780 NCBI Desc: ubiquitin related modifier [bombyx mori]
MERPKLDQANRRGGLELLLENSTKVHKVEITTSKDGQGKVTTPKEGQDKVTMKSLLSWVKDNLIKERPEMFVKGDSVRPGVLVLVNDCDWELCGGLDAELEEKDVVVFISTLHGG

SEQ ID NO: 11779 - DNA, 954 bp, Sorghum bicolor
  misc_feature: Ceres ANNOT ID no. 6032091
  misc_feature: Encodes the peptide sequence at SEQ ID NO 11780
atgaacgcgcaacactactctccatctgccggcgccgtcgtcgcttggcatcgtcgtccggctccatcacccgccatctcgcgctgcgctcgcattatccggccgtctccactcgctctgtcgtcggccgcggcgaccacgggcacgcgcaccgccccggccacgacgcccgatcccgaggcgccgccgctccagcggctcctccgcagcggggtgcgggcggagtcgctgccgcggcacgtcgggctggtgatcgacgggcacgcgcgatgggcgcgcgcccgggggctgtcggtgtcggagggccacgcggtggggcggcgcacggtggagcgcacggtgcggctgtcgcgagcgtggggcatccgcgccctcaccgtcttcgcctgctcccacgagaacatgacccgccccaaggaggagatcgacttcttcatgaagctgtacaaggggttcatccgtgacaacgtcgacgagttctgcagggagggaatccggctgcacctcatcggcgactcgccggggcggccagcgtcgctgctgcgcgcggcgagggaagcccacgaggccacgcggggcaactcggagatggtcctgatgctggcgatcggctacagcgggcggcgggacatcctgcgggcgtgccgagagctcgccgcggaggtgcagcgcgacctgctgaggcccgaggacatcgacgaggcgctcatcgccgggaagctggggaccagcgtcgccgccggcggcgagctctcctgccccgaccccgacctcgtcatcaggaccagcggcgagctgaggctgagcaacttcctgctgtggcagtccgcgttctcggagctcttcttctctgacgtcatgtggccggattttggagaggacgagtacctccgggcgttgcgttcctaccagaccagacgacggcgcttcggtcaacgaattccgtgtccctaa

SEQ ID NO: 11780 - protein, 317 aa, Sorghum bicolor
  misc_feature: Ceres ANNOT ID no. 6032091
  misc_feature (84)..(312): Pfam Id: Prenyltransf Pfam Desc: Putative undecaprenyl diphosphate synthase
  misc_feature (61)..(311): NCBI GI: 16078716 NCBI Desc: undecaprenyl pyrophosphate synthetase [bacillus subtilis subsp. subtilis str. 168]
  misc_feature (61)..(311): NCBI GI: 3183468 NCBI Desc: undecaprenyl pyrophosphate synthetase (upp synthetase) (di-trans-poly-cis-decaprenylcistransferase) (undecaprenyl diphosphate synthase) (uds)
  misc_feature (58)..(312): NCBI GI: 42559830 NCBI Desc: undecaprenyl pyrophosphate synthetase (upp synthetase) (di-trans-poly-cis-decaprenylcistransferase) (undecaprenyl diphosphate synthase) (uds)
  misc_feature (58)..(312): NCBI GI: 21673106 NCBI Desc: undecaprenyl diphosphate synthase [chlorobium tepidum tls]
  misc_feature (75)..(312): NCBI GI: 42559974 NCBI Desc: undecaprenyl pyrophosphate synthetase (upp synthetase) (di-trans-poly-cis-decaprenylcistransferase) (undecaprenyl diphosphate synthase) (uds)
MNAQHYSPSAGAVVAWHRRPAPSPAISRCARIIRPSPLALSSAAATTGTRTAPATTPDPEAPPLQRLLRSGVRAESLPRHVGLVIDGHARWARARGLSVSEGHAVGRRTVERTVRLSRAWGIRALTVFACSHENMTRPKEEIDFFMKLYKGFIRDNVDEFCREGIRLHLIGDSPGRPASLLRAAREAHEATRGNSEMVLMLAIGYSGRRDILRACRELAAEVQRDLLRPEDIDEALIAGKLGTSVAAGGELSCPDPDLVIRTSGELRLSNFLLWQSAFSELFFSDVMWPDFGEDEYLRALRSYQTRRRRFGQRIPCP

SEQ ID NO: 11781 - DNA, 609 bp, Sorghum bicolor
  misc_feature: Ceres ANNOT ID no. 6032130
  misc_feature: Encodes the peptide sequence at SEQ ID NO 11782
atgttcgcgctgagccagatcgagcacgacctgccgatgccgccgcacctgctgagccgccccctccccgacgccatcaaagccgagctcgagaggctcttcttggacaaggtaatcgcaaaccttgggctgtgcgtgtctgtctatgatatccgatccattgaaggcggttccatccatccaggacagggctgctcgacctataaagtttcatttcgtttgctaatgttcaagccttttaatggggaggttcttgttgggaggattattggatatgatgataaggggttgcaggtttcacttgatttcttcagtgacatttccatacctggacacttgatgcagtttggcacagtaaggggaccagatggtaggtggatgctgaagactgaagatggcgatgagctttatctagatctagatgatgagataaggttcttggtttctagcacaaaatacccacgtatcccaattgaccaaaaggaggatgacccaccatttgctccaatgcaaattgttggaagtattaaaggagatggccttggtcttcttgcttggtgggcagctgatgaagaggagggggaggaggcggcagagcaagagcaatag

SEQ ID NO: 11782 - protein, 202 aa, Sorghum bicolor
  misc_feature: Ceres ANNOT ID no. 6032130
  misc_feature (79)..(187): Pfam Id: RNA_pol_Rbc25 Pfam Desc: RNA polymerase III subunit Rpc25
  misc_feature (8)..(77): Pfam Id: RNA_pol_Rpb7_N Pfam Desc: RNA polymerase Rpb7-like, N-terminal domain
  misc_feature (1)..(175): NCBI GI: 42571371 NCBI Desc: rna polymerase rpb7 n-terminal domain-containing protein [arabidopsis thaliana]
  misc_feature (1)..(149): NCBI GI: 50540012 NCBI Desc: zgc:92878 [danio rerio]
  misc_feature (1)..(164): NCBI GI: 44981491 NCBI Desc: acr049wp [eremothecium gossypii]
  misc_feature (1)..(164): NCBI GI: 45185736 NCBI Desc: acr049wp [eremothecium gossypii]
  misc_feature (1)..(162): NCBI GI: 112490176 NCBI Desc: chain d, x-ray structure of rna polymerase iii subcomplex c17-c25.
MFALSQIEHDLPMPPHLLSRPLPDAIKAELERLFLDKVIANLGLCVSVYDIRSIEGGSIHPGQGCSTYKVSFRLLMFKPFNGEVLVGRIIGYDDKGLQVSLDFFSDISIPGHLMQFGTVRGPDGRWMLKTEDGDELYLDLDDEIRFLVSSTKYPRIPIDQKEDDPPFAPMQIVGSIKGDGLGLLAWWAADEEEGEEAAEQEQ

SEQ ID NO: 11783 - DNA, 1665 bp, Sorghum bicolor
  misc_feature: Ceres ANNOT ID no. 6032191
  misc_feature: Encodes the peptide sequence at SEQ ID NO 11784
atggcggccgcagccgccgcccggctgctccgcctggccccgcgccggctccaggttcccaagggctccccgctcgccgcgctctcgttcccactcccgcgtacggcgccgctcgccgccgctgcctcggggcggcggcagcgtttctgcgccgcggcgcaggcctccgcctccgcccccgcagccgcggcgacgggggcggcgggcgaggccgtgggggagttcaggaagcggctgcgggtggcggacgtgaagggcggggaggacgagggcgccgcgtgggtgggcaaggagctcaccgtgcgcggctgggtgcgcacctgccgcgcccagaggaccgtcaccttcgtcgaggtcaatgatggctcttgcttgtccaatatgcaatgtgtattgactcctgacacagaaggctatgaccagatagactctgtcactactggagcatctgtactagttgagggagttgttgcaagcagccaaggtggtaagcaaaaagtggagctgaaggtttcaaagatcactgtgattggtaagagtgaccccacatcttttcctatacagaagaagcgggcatcaagagaattccttagaactgtagcccatctccgtcctcggacaaacacttttggtgcagtggcaagagtgagaaatgctctggcatatgcaactcataaattctttcaagacaatggatttgtttgggtttcaagcccaattattactgcctcagattgtgaaggagctggggagcagttttatgtgactactttgctttcaaacagcgctgaaggtggttccctactcaaagatattcctgctaccaaggatggaagggttgattggtcacaggatttcttctgcaaaccagcatttctgacagtctctggacagcttaatggtgaaacatatgcttcagctctatctgatatttacacttttggtccaacgttcagggctgaaaattcaaacactgcaaggcatctggctgaattttggatgattgaacctgagcttgcctttgccgatctaaacgatgacatggcttgtgcaactgcatatctccagtatgtagtaggtgtaaagtacattctagagaactgcaaagaggatatggatttcttcaatacatgggttgagaaaggcatcatagatcgattaaatgatgtagtagagaagaacttcattcacttgtcttacactgatgctgtcgagctacttcttgggtccaagaaggaattcgagttcccggtaaagtggggtttggatcttcaaagtgagcatgagcgatatatcacagaagttgccttgggtgggcgccctgtaataattagagattacccaaaggaaatcaaagctttctatatgagagaaaataatgatgggaagacagttgctgcaatggatctgttggttcctcgggttggtgaacttattggaggaagccagagggaagagcgcctcgattaccttgaagctcgattagacgagcaaaatctgaacaaggagagctactggtggtatttggacctacggcgatatggatcagttccccacgctggtttcggtcttggatttgagcggcttgtacagtttgctactggaatagacaacatcagagatgccatcccatttccccgagttcctggctctgctgagttttag

SEQ ID NO: 11784 - protein, 554 aa, Sorghum bicolor
  misc_feature: Ceres ANNOT ID no. 6032191
  misc_feature (193)..(550): Pfam Id: tRNA-synt_2 Pfam Desc: tRNA synthetases class II (D, K and N)
  misc_feature (99)..(177): Pfam Id: tRNA_anti Pfam Desc: OB-fold nucleic acid binding domain
  misc_feature (1)..(517): NCBI GI: 115472117 NCBI Desc: os07g0485400 [oryza sativa (japonica cultivar-group)]
  misc_feature (23)..(554): NCBI GI: 19310458 NCBI Desc: at4g17300/dl4685w [arabidopsis thaliana]
  misc_feature (23)..(554): NCBI GI: 2664210 NCBI Desc: asparaginyl-trna synthetase [arabidopsis thaliana]
  misc_feature (29)..(554): NCBI GI: 140051314 NCBI Desc: aspartyl-trna synthetase, class iib; trna synthetase, class ii (d, k and n) [medicago truncatula]
  misc_feature (78)..(554): NCBI GI: 59798542 NCBI Desc: asparaginyl-trna synthetase (asparagine--trna ligase) (asnrs)
  misc_feature (23)..(554): SWISSPROT Homolog: EC 6.1.1.22 Asparaginyl-tRNA synthetase, chloroplast/mitochondrial precursor
  misc_feature: Useful for making plants with modulated biomass
  misc_feature: Functional homolog of the protein sequence given in SEQ ID NO 13551
MAAAAAARLLRLAPRRLQVPKGSPLAALSFPLPRTAPLAAAASGRRQRFCAAAQASASAPAAAATGAAGEAVGEFRKRLRVADVKGGEDEGAAWVGKELTVRGWVRTCRAQRTVTFVEVNDGSCLSNMQCVLTPDTEGYDQIDSVTTGASVLVEGVVASSQGGKQKVELKVSKITVIGKSDPTSFPIQKKRASREFLRTVAHLRPRTNTFGAVARVRNALAYATHKFFQDNGFVWVSSPIITASDCEGAGEQFYVTTLLSNSAEGGSLLKDIPATKDGRVDWSQDFFCKPAFLTVSGQLNGETYASALSDIYTFGPTFRAENSNTARHLAEFWMIEPELAFADLNDDMACATAYLQYVVGVKYILENCKEDMDFFNTWVEKGIIDRLNDVVEKNFIHLSYTDAVELLLGSKKEFEFPVKWGLDLQSEHERYITEVALGGRPVIIRDYPKEIKAFYMRENNDGKTVAAMDLLVPRVGELIGGSQREERLDYLEARLDEQNLNKESYWWYLDLRRYGSVPHAGFGLGFERLVQFATGIDNIRDAIPFPRVPGSAEF

SEQ ID NO: 11785 - DNA, 1902 bp, Sorghum bicolor
  misc_feature: Ceres ANNOT ID no. 6032244
  misc_feature: Encodes the peptide sequence at SEQ ID NO 11786
  misc_feature: Up-regulated in root tissues in response to salicylic acid treatment
atggtggctcgccgcttcgtggtccggcatggccccgccgccgcagccggtggctccgtcgagcgggaggaggaggaggagcacgaggtggagtacgatacggagcacggcctcgacgtcctccgcctccagatcttctccctcaccgccgtcccgcccgacctccagaagatcgtggtggaggcggatgggttggtggtggacgacggcaccgatctggaaaccgtctctgagcgcctgcgcctcctcgctatcggcgaggaggaggaagacgccgccgcagcggccagggcgcaggaaaagtccgatgaggaattcgcacggatgctacaggcggaggaagaggcacttctcctacaacagtacagtatacaaaatgatggtggagatgtgtttagacagagagttgagccttacatgcaccaggttctgatgtatgaagatccagtgggacaagaggcagcacgtaagacagttccaatatgcgaactggaggagaaggcattggtttcactggccaaggaagggaatttcaatccttcgaatgatgaagagaagcatggctttctgctgcaattgcttttctggtttaagcaatcattcagatgggttaatgcagcaccttgtgacagctgtggtcgtgagacatccaatgttggaatgggcaccccacttacctcagaaatcaaatttggcgcttcacgtgttgagatttataggtgtaaccattgttctagtatcacccgtttcccaaggtacaacgatccacgtaagcttatacaaactaggagaggtcgctgtggagaatgggcaaattgcttcacattctactgtcgagcttttggatatgatgctcgtttgattctggatttcactgatcacgtgtggacagaatgtttttcaaacttgtacgggaggtggatgcacctagatccatgcgaaggagtctacgacaatcccctactgtatgagaaagggtggaacaagaagttagattatgttattgcgatttctaaagatggagtacgtgacgtaacaaaacgctacaccagaaagtggcatgaggttctctctaggcgaacaattacctctgaagaaactgttgtggctgttctatcatctataacagggaagtatcgcactggtttgtcaactgatgctctatcagtcatagaaaatcgtgaaaaggaggagtctgaggaacttagcaaatctgcttatcttcaagttgaaacagctttatccttacctggaaggctaagtggttctgtggaatggaggaaagcaaggtcagagttgggccaagcagattcactcagttgctcatcctgccctattcggaaatgtgtggatgctcatgtttcaaatatatatgatgctctttctgcttttctttcacatttttgtgacaaaaaagtccctaaagaaagaattattgaagtttttgacacattgaagactttgatgctaactcttaaaaattccaacttcaagagcagaagtgctacactagaccagaaaacacaccatctatttgaggagatatttccttcctttgaaagactgttatctgctatttcactgaaagcagaactgggaagtgctggacaccaatctgtgactgtagctggaaatccaatacactcatccttagcgttaccagtagcactggatgcagttaatgagatattgagtaattataagaataatacctctttcacagaaggcaaccatttcccaagagggaacagagtatgctcaggttcagtccttgcaagcagggaacagcttccaatcggaattgtatgtgaatgcaatttgttcatttttgtagtatccattgctcggtgttttccatacattagtatgtttgaaaatatttcaggcaacagcagcttttga

SEQ ID NO: 11786 - protein, 633 aa, Sorghum bicolor
  misc_feature: Ceres ANNOT ID no. 6032244
  misc_feature (262)..(313): Pfam Id: Transglut_core Pfam Desc: Transglutaminase-like superfamily
  misc_feature (1)..(429): NCBI GI: 75139181 NCBI Desc: peptide-n(4)-(n-acetyl-beta-glucosaminyl)asparagine amidase (peptide:n-glycanase)
  misc_feature (1)..(601): NCBI GI: 27808626 NCBI Desc: at5g49570 [arabidopsis thaliana]
  misc_feature (45)..(434): NCBI GI: 30517852 NCBI Desc: peptide n-glycanase [mus musculus]
  misc_feature (72)..(432): NCBI GI: 114152094 NCBI Desc: peptide-n(4)-(n-acetyl-beta-glucosaminyl)asparagine amidase (pngase) (peptide:n-glycanase) (n-glycanase 1)
  misc_feature (140)..(434): NCBI GI: 33878911 NCBI Desc: ngly1 protein [homo sapiens]
  misc_feature (1)..(429): SWISSPROT Homolog: EC 3.5.1.52 Peptide-N(4)-(N-acetyl-beta-glucosaminyl)asparagine amidase
  misc_feature: Up-regulated in root tissues in response to salicylic acid treatment
MVARRFVVRHGPAAAAGGSVEREEEEEHEVEYDTEHGLDVLRLQIFSLTAVPPDLQKIVVEADGLVVDDGTDLETVSERLRLLAIGEEEEDAAAAARAQEKSDEEFARMLQAEEEALLLQQYSIQNDGGDVFRQRVEPYMHQVLMYEDPVGQEAARKTVPICELEEKALVSLAKEGNFNPSNDEEKHGFLLQLLFWFKQSFRWVNAAPCDSCGRETSNVGMGTPLTSEIKFGASRVEIYRCNHCSSITRFPRYNDPRKLIQTRRGRCGEWANCFTFYCRAFGYDARLILDFTDHVWTECFSNLYGRWMHLDPCEGVYDNPLLYEKGWNKKLDYVIAISKDGVRDVTKRYTRKWHEVLSRRTITSEETVVAVLSSITGKYRTGLSTDALSVIENREKEESEELSKSAYLQVETALSLPGRLSGSVEWRKARSELGQADSLSCSSCPIRKCVDAHVSNIYDALSAFLSHFCDKKVPKERIIEVFDTLKTLMLTLKNSNFKSRSATLDQKTHHLFEEIFPSFERLLSAISLKAELGSAGHQSVTVAGNPIHSSLALPVALDAVNEILSNYKNNTSFTEGNHFPRGNRVCSGSVLASREQLPIGIVCECNLFIFVVSIARCFPYISMFENISGNSSF

SEQ ID NO: 11787 - DNA, 1896 bp, Sorghum bicolor
  misc_feature: Ceres ANNOT ID no. 6032363
  misc_feature: Encodes the peptide sequence at SEQ ID NO 11788
atggagtacatatcccctgagagaaatctggaggggacttgtggagatcctgggccattatttggagaccaaggtggcagcctgttggaccacttgggttatcaaggaggaggaattccacaacatgagtctccaacactggatcatggacttttggttgatccagctgatgcaattccgtatttatctacagattctccgcccttcatgaatgatcaaatcacttgtaatgtaatgaaatctgcttcagctagtccagaatcttcgatgaaacaacctcaagaacctcttaatatagaatctgatgtacagaatgatgcagctgaacaaaatgttcacaattgtaactctgaagaacagatcacttctctgggctgtgatgaacatcagaacacagaagtgattggtgcagtgttgcctccaaagcttcttgaaagcagtggtaatgatatatcaaactttcaaccagaaactacatattctgatgcctaccatggtgactctttgttaactgaaaatagtagtaagggttaccagcttaacaatagtggggctcctgctgatgatattccaaactctcctgcgcttcagatggaaaatgaggagatggaaaagttacatgagacttctcacaatgaaaacagtgggtcagaggatgatcaaatgaatggtaggaaacctttccccattaatggtcgagacaatgagaagtttaacacttcagctgtacctccttcttgggaacagacagagcagaaaaatcctggtactagaaatggaagttcaactccagacaatcaatttgattctccaccggacaggtttgcaagactggaaagggacacaccatctccagatgggagagtatcccctgaaaggtttgcaagactggaaagggataccccatctccagacgggaggatatctcctccagttgaaggttcacatgcccatcaatctgagaagatggagtcacaatatcgtgccaaagatgttggtgagttagctcattctgaaagcccatcgataagacatcggtcccgatcttctgaaaaacatgaccccagccgcaaaagagcctcgtcaagggagttatctccacacgcgcgacatagttctcctgtagaaaggaaaagacggagagagtctcgacatggtgatgtgtcgcctcgacaaagatctgcatctcctcgaagaagatctacaccccctcgaagaagatctatatcccctcgaaggtcctcacacaagaggagggaatcaccaagaaggggagactcacctaggaggaggcactcacctaggaggagggagtcaccaaggaagagagattcaccaaggaggagagactcaccaaggaggagagactcaccaaggaggagagactcaccaaaaaggagggattccccaaggaggagggataggtcaaaatcaaggtcaccttcaagaaaacatgatacctctagacatagaaaagaacatgatagatctcggtccaggtctccccactcgagggatcatcacaggcgatctccaagaaggcattcgccaaggcgcagatcacccccaactagtcatcgccatcgttcaccaagaagacattggtcaccacctgccaacaggaagactggattgggtaagcctggaaagaatctctttattgcaggatttagctatgccaccactgagcgagatttggagaagaaatttggcaagtttggacgtgtaacaagtgcacgtgttgttcgtgataaacgaactggagattcccgtggctttggattcttatccttggagaaggatgaggatgctgatgcagcaatccgtgcttgtgacgagactgagtggaatgggaggatcattcttgtggagaagtcaaaggcacctgcatggtga

SEQ ID NO: 11788 - protein, 631 aa, Sorghum bicolor
  misc_feature: Ceres ANNOT ID no. 6032363
  misc_feature (552)..(623): Pfam Id: RRM_1 Pfam Desc: RNA recognition motif. (a.k.a. RRM, RBD, or RNP domain)
  misc_feature (1)..(541): NCBI GI: 57900228 NCBI Desc: peptidylprolyl cis-trans isomerase-like protein [oryza sativa (japonica cultivar-group)]
  misc_feature (1)..(263): NCBI GI: 15528675 NCBI Desc: p0560b06.2 [oryza sativa (japonica cultivar-group)]
  misc_feature (1)..(263): NCBI GI: 115436566 NCBI Desc: os01g0367300 [oryza sativa (japonica cultivar-group)]
  misc_feature (80)..(541): NCBI GI: 114152161 NCBI Desc: serine/arginine repetitive matrix protein 2
  misc_feature (80)..(541): NCBI GI: 126157504 NCBI Desc: serine/arginine repetitive matrix 2 [mus musculus]
  misc_feature: The sequence is a functional homolog of SEQ ID NO. 339 in the 11/188,298 US application
MEYISPERNLEGTCGDPGPLFGDQGGSLLDHLGYQGGGIPQHESPTLDHGLLVDPADAIPYLSTDSPPFMNDQITCNVMKSASASPESSMKQPQEPLNIESDVQNDAAEQNVHNCNSEEQITSLGCDEHQNTEVIGAVLPPKLLESSGNDISNFQPETTYSDAYHGDSLLTENSSKGYQLNNSGAPADDIPNSPALQMENEEMEKLHETSHNENSGSEDDQMNGRKPFPINGRDNEKFNTSAVPPSWEQTEQKNPGTRNGSSTPDNQFDSPPDRFARLERDTPSPDGRVSPERFARLERDTPSPDGRISPPVEGSHAHQSEKMESQYRAKDVGELAHSESPSIRHRSRSSEKHDPSRKRASSRELSPHARHSSPVERKRRRESRHGDVSPRQRSASPRRRSTPPRRRSISPRRSSHKRRESPRRGDSPRRRHSPRRRESPRKRDSPRRRDSPRRRDSPRRRDSPKRRDSPRRRDRSKSRSPSRKHDTSRHRKEHDRSRSRSPHSRDHHRRSPRRHSPRRRSPPTSHRHRSPRRHWSPPANRKTGLGKPGKNLFIAGFSYATTERDLEKKFGKFGRVTSARVVRDKRTGDSRGFGFLSLEKDEDADAAIRACDETEWNGRIILVEKSKAPAW

SEQ ID NO: 11789 - DNA, 1191 bp, Sorghum bicolor
  misc_feature: Ceres ANNOT ID no. 6032443
  misc_feature: Encodes the peptide sequence at SEQ ID NO 11790
atgggccgttcatatgaccgggataatttctacgtctatggaccaacggatctgactcaaatcgaggttgactggaacaatgaggagcaccgccggtgcatcaccgcctgtcttgttaaaggcacttacattctggagagcgagcatcaaatcaggcggaaggaggagggcaagggcaaattcgcggcagcgtggtgggagaacttccacttccgcctccatcatgtgcttcagtctgagtgcaactgcgtctgctgcaagatccgccgccgactggagttgtcggaccaaagcaccatcaggtcgttcgtgtacggagctatcttcgaatacgtgcccccagacgacgtcaagaaccgccgccgccacccgtcggctccgcgcttcgtcgttgcctttcgaggcaccatgccacgagacgccacggccgtcggcgacatgcgactcaacctcatggtccttctcaacaggcagaggttctgtagccgcttcacggaagcacgcaagcacgttatctccctcctcagctccattcctcctcctccaccagctgctgctggtggtagtggtggtcgtgcagtagccggcggcggcacggcgaactcgaactccgtaggcgtgtggctcgccggccactcgctcggggcgtcgatagcgctatacgtggggcgggacatggtgaccacaagagggtgcagtctcccaaccttcctcttcaacccgccgcatgtttctgcggcgccgttgatcgacgccgccgtcatgtcgtcggaggcggcgaagatgtatctgtacatgtccagctacgtcatcaagtgcgtgctggggatgacttttctgaaatcccacaggaaagatatggagaaactcttcgagcagctgtccccgtgggtgccgaacctgtacgtgcaccggaaggacatcatctgcaagggcttcatcgactacttcgagcagcgggagaaggcgaaggagttgtccacccgcgtgggcaactcggctgccacactgtcgtaccgcgacatggtgtactctgtgttcaacaagcacagcgggcggcagcacctcctaccatgcgcagtgttgtggatctcgcacggcgacaacccgcacgcgctccggcagtggtggcgacccacaggcccggagcaggacttgaggcgccaagaatacagctggactttaagatag

SEQ ID NO: 11790 - protein, 396 aa, Sorghum bicolor
  misc_feature: Ceres ANNOT ID no. 6032443
  misc_feature (202)..(369): NCBI GI: 115472475 NCBI Desc: os07g0527900 [oryza sativa (japonica cultivar-group)]
  misc_feature (16)..(156): NCBI GI: 50508611 NCBI Desc: lipase (class 3) family -like protein [oryza sativa (japonica cultivar-group)]
  misc_feature (207)..(395): NCBI GI: 47847721 NCBI Desc: lipase class 3-like [oryza sativa (japonica cultivar-group)]
  misc_feature (207)..(379): NCBI GI: 18461216 NCBI Desc: p0690b02.1 [oryza sativa (japonica cultivar-group)]
  misc_feature (200)..(379): NCBI GI: 145358378 NCBI Desc: triacylglycerol lipase [arabidopsis thaliana]
MGRSYDRDNFYVYGPTDLTQIEVDWNNEEHRRCITACLVKGTYILESEHQIRRKEEGKGKFAAAWWENFHFRLHHVLQSECNCVCCKIRRRLELSDQSTIRSFVYGAIFEYVPPDDVKNRRRHPSAPRFVVAFRGTMPRDATAVGDMRLNLMVLLNRQRFCSRFTEARKHVISLLSSIPPPPPAAAGGSGGRAVAGGGTANSNSVGVWLAGHSLGASIALYVGRDMVTTRGCSLPTFLFNPPHVSAAPLIDAAVMSSEAAKMYLYMSSYVIKCVLGMTFLKSHRKDMEKLFEQLSPWVPNLYVHRKDIICKGFIDYFEQREKAKELSTRVGNSAATLSYRDMVYSVFNKHSGRQHLLPCAVLWISHGDNPHALRQWWRPTGPEQDLRRQEYSWTLR

SEQ ID NO: 11791 - DNA, 936 bp, Sorghum bicolor
  misc_feature: Ceres ANNOT ID no. 6032485
  misc_feature: Encodes the peptide sequence at SEQ ID NO 11792
atggatcacactgccgagcatctcgaccccaccggcccgacggctgcctcctcctccgccgtcgccggggtaaatgcgtggctggactccctcgccgcggaggccgggcgcggggcgggatggcgaggcggcggcggaggtgcggcctcggagctttcgctggggcccgactccacaccgcgcggggtggcctacctccgcacgctggccgcggtgtcgcaggcgcggtcgcgcgccgccggaatagcggctgcggggctgcgcgcgcaggcagccgagtatcgcgccgaggcggcgcggttgcgggaggctctagagcgggcggggctcgcgagggacgcgctcccatcaaccgcagcagcggcggcgcacgctgtcgctgccgttgccaaccttctcgccatccgtgataccgacatgagcagctttgtggtggcaagtgcagacttgtctatgaggcgagcagaggtaggggagaagagggacaaagtgcataaggagtcaaatacgctgcttgattacacacggaaggccataaacaagcatatggagctgaagaagatgctggagaaatttaaaaatgatgtggagaagcaacaagctgagcaaatgacgggttggcagacaaagcttgttatgatggactcgaaggaacgacagtatatcctccaagtctcaaattataaggcaatgcttaaccgagtggcttatacaccagagatcaatcatggtgtgttaatggaaatggctgagcataagaaggatcttgagaggaggacaaaacccatagctgatacattaagaagctaccaggatttacctcctgataaagctctggctgcactggctatagaggataaaaggaggcagtatgctgctgcagagaagtacctagaagacgtgttgcaatctgctttaaccacaactgccctataa

SEQ ID NO: 11792 - protein, 311 aa, Sorghum bicolor
  misc_feature: Ceres ANNOT ID no. 6032485
  misc_feature (1)..(229): NCBI GI: 115475475 NCBI Desc: os08g0240600 [oryza sativa (japonica cultivar-group)]
  misc_feature (59)..(229): NCBI GI: 140059868 NCBI Desc: helix-turn-helix, arac type [medicago truncatula]
  misc_feature (61)..(298): NCBI GI: 119850966 NCBI Desc: coiled-coil domain containing 5 [rattus norvegicus]
  misc_feature (60)..(298): NCBI GI: 34328690 NCBI Desc: enhancer of invasion-cluster [homo sapiens]
  misc_feature (13)..(137): NCBI GI: 120402605 NCBI Desc: nlp/p60 protein [mycobacterium vanbaalenii pyr-1]
  misc_feature: The plant flowers significantly late compared to wild-type.
  misc_feature: Useful for making plants with modulated flowering time
  misc_feature: GREAT-hit functional homolog of the protein sequence given in SEQ ID NO 12906
  misc_feature: Useful for making plants with modulated flowering time
  misc_feature: Functional homolog of the protein sequence given in SEQ ID NO 12906
MDHTAEHLDPTGPTAASSSAVAGVNAWLDSLAAEAGRGAGWRGGGGGAASELSLGPDSTPRGVAYLRTLAAVSQARSRAAGIAAAGLRAQAAEYRAEAARLREALERAGLARDALPSTAAAAAHAVAAVANLLAIRDTDMSSFVVASADLSMRRAEVGEKRDKVHKESNTLLDYTRKAINKHMELKKMLEKFKNDVEKQQAEQMTGWQTKLVMMDSKERQYILQVSNYKAMLNRVAYTPEINHGVLMEMAEHKKDLERRTKPIADTLRSYQDLPPDKALAALAIEDKRRQYAAAEKYLEDVLQSALTTTAL

SEQ ID NO: 11793 - DNA, 219 bp, Sorghum bicolor
  misc_feature: Ceres ANNOT ID no. 6032545
  misc_feature: Encodes the peptide sequence at SEQ ID NO 11794
atgccgaagcagatccacgagatcaaggacttcctgctgacggcgcggcggaaggacgcgcggtcggtgcggatcaagcgtgccaaggacgccgtcaagttcaaggtgcgctgctccaagtacctctacaccctctgcgtccacgacgccgacaaggccaacaagctcaagcagtcgctcccgccagcttgttgtgatgtccagagatgtttcaactga

SEQ ID NO: 11794 - protein, 72 aa, Sorghum bicolor
  misc_feature: Ceres ANNOT ID no. 6032545
  misc_feature (2)..(70): Pfam Id: Ribosomal_L38e Pfam Desc: Ribosomal L38e protein family
  misc_feature (1)..(62): NCBI GI: 23507773 NCBI Desc: at3g59540/t16l24_90 [arabidopsis thaliana]
  misc_feature (1)..(62): NCBI GI: 77745467 NCBI Desc: ribosomal protein l38-like [solanum tuberosum]
  misc_feature (1)..(62): NCBI GI: 313027 NCBI Desc: ribosomal protein l38 [lycopersicon esculentum]
  misc_feature (1)..(62): NCBI GI: 92896721 NCBI Desc: ribosomal l38e protein [medicago truncatula]
  misc_feature (1)..(62): NCBI GI: 15825507 NCBI Desc: ribosomal protein l38 [branchiostoma belcheri]
MPKQIHEIKDFLLTARRKDARSVRIKRAKDAVKFKVRCSKYLYTLCVHDADKANKLKQSLPPACCDVQRCFN

SEQ ID NO: 11795 - DNA, 1227 bp, Sorghum bicolor
  misc_feature: Ceres ANNOT ID no. 6032606
  misc_feature: Encodes the peptide sequence at SEQ ID NO 11796
atggcctcgccggcgcagctcaccgacgacctcttgtcggacatcttcctccgtcttccggagccggccgacctcgttcgcgccggggccgcctgcgtccccttccgccgcctcgtcgccgaccgcgcgttcctctgccggttccgctcgctccaccccgcgccgctcctcggcttcctggaccacaacggcttccacccggcgctcccaccccacgcatccgcccccgctgcgcgagccgtctcgctcgccgcggatttctccttctcgttcctccccacctcctccacgggccgcggctgggtcgtgcgcgacgtccgcgacggccgcgtcctcctcgaccggacccccgaggacggaggcgacaagccgcaggtcttcacggagatagcggtgtgcgaccccttgcaccggcgcagcgtccttctccccctgatccccgacgacctggccacagcggtggagcacccgctccgcttggagttcgaccgttggtgcgagcccttcctcgccccccgcggtgccgacggcggggacccagaggatgagacttcgttcggagtgatctgtatggtgcagtgcaaagccaagctcgtcgccttcgccttctcttccaccactgggcaatggcgagccgtcgcgtccctggcctggcgcgatctgatggccggcctgggcgtgtcgtcaaggagccctgcgttctccgggcgccagtacgctcgcggctgcttctattgggttatggattggcgggacaagtttctcgtgcttgacgctgggaggatggaattatccattgctgacgtcccacctggctgccataggcgacagatcgccattgtggaggcaggggaaggcagggttgggatgtttgcgctccgcgaccatgttgcagatggtgcagttagcctccattatactgtaaggcgagacgatgccgatggttccaaccagtggcaggtggagaaaacaatcccgctggatcctgggtttcggtattacatcaggggtgctatggagaggtacatgctcctgctaaggtttcctgaacacctaagcttagcaggagtgcatgtaagctcatcggcggagattgaagacttggaatgtttttcgatggacagcaggactttgcagcttgagagagtgtgcgaattgaagcaccacattttgcgtgcctacatatataccaactttccaccatccttgtcgccgcagagtatctaa

SEQ ID NO: 11796 - protein, 408 aa, Sorghum bicolor
  misc_feature: Ceres ANNOT ID no. 6032606
  misc_feature (1)..(408): NCBI GI: 116308909 NCBI Desc: osigba0107a02.1 [oryza sativa (indica cultivar-group)]
  misc_feature (7)..(408): NCBI GI: 115481050 NCBI Desc: os10g0135300 [oryza sativa (japonica cultivar-group)]
  misc_feature (5)..(158): NCBI GI: 115462089 NCBI Desc: os05g0147700 [oryza sativa (japonica cultivar-group)]
  misc_feature (3)..(79): NCBI GI: 115481076 NCBI Desc: os10g0137700 [oryza sativa (japonica cultivar-group)]
  misc_feature (105)..(224): NCBI GI: 115472723 NCBI Desc: os07g0555400 [oryza sativa (japonica cultivar-group)]
MASPAQLTDDLLSDIFLRLPEPADLVRAGAACVPFRRLVADRAFLCRFRSLHPAPLLGFLDHNGFHPALPPHASAPAARAVSLAADFSFSFLPTSSTGRGWVVRDVRDGRVLLDRTPEDGGDKPQVFTEIAVCDPLHRRSVLLPLIPDDLATAVEHPLRLEFDRWCEPFLAPRGADGGDPEDETSFGVICMVQCKAKLVAFAFSSTTGQWRAVASLAWRDLMAGLGVSSRSPAFSGRQYARGCFYWVMDWRDKFLVLDAGRMELSIADVPPGCHRRQIAIVEAGEGRVGMFALRDHVADGAVSLHYTVRRDDADGSNQWQVEKTIPLDPGFRYYIRGAMERYMLLLRFPEHLSLAGVHVSSSAEIEDLECFSMDSRTLQLERVCELKHHILRAYIYTNFPPSLSPQSI

SEQ ID NO: 11797 - DNA, 1242 bp, Sorghum bicolor
  misc_feature: Ceres ANNOT ID no. 6032607
  misc_feature: Encodes the peptide sequence at SEQ ID NO 11798
atggctccaccgacgcagccaaccccgcgccgcctccaatcccctgcggacctcgccgacgatgccctcggggagatcttcctccacctcgactctgccctggacctcgcccgcgcctccttcgcttgcgccagcttccgtcgcgtcatcacagaccacggtttcctccgccgctaccacgccctccacccgccgccgctcctcggcatcctcgccagcggctttatccccgcgcagccgccccacacctccgccatcgccgcccgagccttcgcgcaagccgatgccgcagacttctcgttctccttcctccccattccgcaccgctggcgccgccgcgacacccgcgacggccgcttcctcctctccggggtccccacgggtaggggataccgtcgcggcgatcttctctggatcacggatcttgccgtctgcgaccctgtgcaccggcgctacctcctgctaccggccatcccagccgacctaaccgccgctgtccatcagccagacatcgttgatttcgagaccttccttgcccctgctgctgaggatgacaaggactcgtcattcagggtgatctgcctggcgcaatgcgcaatcaagctggtcctcttcgtcttctcatctggagaagggcgatggcatactgttacatttaacgactggagtgctctgattacagggaccggaaacccagcttcaacagggactgccaatcctgcttcaggatcagagttgtcccaacgctactatgcccacagatgcttctattggttgatgcatcggaggaacaaattgcttttgctcaacacaagtgggatggagttctctactgttgagctcccacatgactacaccggagagattgccattgtggaggcagggaaaggaaaggttgggatgctttctctctacagtcttccacatggcacggttcatctctcgtatgccatcttgcaaaatgatggtgagatcgcaaaccaatggcagcctgaggaggtgctcctgttgcctgagaaccatcgctatgacattgtgggtgtagctgggggatatttgctccttcaagggattccagatggcgtgtctcttttgcatcccccaaagaatccaaacttaacctgtttttcgctggacgtcaagacactgcaccttgagttgttctgtcaaactaaccactccatcttacatgctgaactgtatgccggtcacccaccatctttgtctccaccaagtgtatga

SEQ ID NO: 11798 - protein, 413 aa, Sorghum bicolor
  misc_feature: Ceres ANNOT ID no. 6032607
  misc_feature (9)..(413): NCBI GI: 115481050 NCBI Desc: os10g0135300 [oryza sativa (japonica cultivar-group)]
  misc_feature (15)..(413): NCBI GI: 116308909 NCBI Desc: osigba0107a02.1 [oryza sativa (indica cultivar-group)]
  misc_feature (114)..(228): NCBI GI: 115472723 NCBI Desc: os07g0555400 [oryza sativa (japonica cultivar-group)]
  misc_feature (16)..(197): NCBI GI: 115462089 NCBI Desc: os05g0147700 [oryza sativa (japonica cultivar-group)]
  misc_feature (1)..(218): NCBI GI: 38347670 NCBI Desc: osjnba0054d14.5 [oryza sativa (japonica cultivar-group)]
MAPPTQPTPRRLQSPADLADDALGEIFLHLDSALDLARASFACASFRRVITDHGFLRRYHALHPPPLLGILASGFIPAQPPHTSAIAARAFAQADAADFSFSFLPIPHRWRRRDTRDGRFLLSGVPTGRGYRRGDLLWITDLAVCDPVHRRYLLLPAIPADLTAAVHQPDIVDFETFLAPAAEDDKDSSFRVICLAQCAIKLVLFVFSSGEGRWHTVTFNDWSALITGTGNPASTGTANPASGSELSQRYYAHRCFYWLMHRRNKLLLLNTSGMEFSTVELPHDYTGEIAIVEAGKGKVGMLSLYSLPHGTVHLSYAILQNDGEIANQWQPEEVLLLPENHRYDIVGVAGGYLLLQGIPDGVSLLHPPKNPNLTCFSLDVKTLHLELFCQTNHSILHAELYAGHPPSLSPPSV

SEQ ID NO: 11799 - DNA, 1434 bp, Sorghum bicolor
  misc_feature: Ceres ANNOT ID no. 6033153
  misc_feature: Encodes the peptide sequence at SEQ ID NO 11800
atggcgccagaccagcagcagccacctgcaggggcaggggcaggggcctcctcgacgacgggctcgacatctcctcgcctccgcgtacacgtacacgacaccaccctcgtgccgccgtctccgtcaccgccggagacttccctcccgctcaccttcttcgacgtcttctggctccagtcccatcccgtcgagcgcctcttcctctaccgcctcgcccacgacgctgacgtcgaagccatcatctccaacctccggagctccttgcacaaggccctcgccgccttctacccgctcgccggccgcgtccgcctcacccccggcacgtccgaccgctacgagctgcactaccgcccgggagacgccgtcaccttcaccgtcgcggagtgcgacgacgacgtggacggcgacgcgcacttcgacgccctcgccaccgacgagccccgggaggttgccaagatcgccgcgctcgtgccgacgctgccgcggggcggaaggctgctcgccgttcgggccacgctccttcccgcgcgccgcggcctcgccatcggcgtcaccctgcaccacgccgcctgcgacggctcgggctccacgcacttcctgcacacctgggcggccacctgcagaggtggcggcgccgaatcgccgccgccgcctgtcatcgaccggactctcctcgccgacccaaggcgcctgtacgacgcctttgtccaaaccgcgccgagcagtgaagagtatgagttcgtcaagatgtccgccgaccagctcttcgccacgttcacactgtccaaggacgacctcaagcgcgtcaaggacgccgtggccgacgaggctgcgcggcgcggcgtcgcgccgccccggtgctcgtctctcgttgccaccttcggcctcgtctggtcgtgctaccagcgaggcaaggagggaagcggcggcggcgccggagagggctcgatggcctgcatggccttccccgtcgaccaccggtcgcggatgaagcctcccctgccggagaagtacctgggcaactgcgtcggcccagcgttcgcgctggcaccaacgggcgagctggccgcggccggcgcaggagggctcttcagcgcgtgcgccgccgtcgcgtccgccatcgacgaagctgtacgcgacatcgggacgtcgagcatggacgcgtggatggaccgcatcagggaggtgctcccgatgggtttactcaccgtggccggctcgccgaggttccgcgtctacgacctggacttcggattcggccggccggcgaaggtggacatcgtgtccgtggcgaggaccggcgcagtggcggtggcggagagccggagtggcgacggcgggatagaggtgggggtctctctgcagccggcggctatggagaggtacaggaagtgcttcgcggatgctaccctgtggctccaccagaagacatga

SEQ ID NO: 11800 - protein, 477 aa, Sorghum bicolor
  misc_feature: Ceres ANNOT ID no. 6033153
  misc_feature (27)..(469): Pfam Id: Transferase Pfam Desc: Transferase family
  misc_feature (34)..(469): NCBI GI: 38346915 NCBI Desc: osjnbb0015n08.15 [oryza sativa (japonica cultivar-group)]
  misc_feature (14)..(439): NCBI GI: 115446153 NCBI Desc: os02g0483800 [oryza sativa (japonica cultivar-group)]
  misc_feature (38)..(234): NCBI GI: 47847909 NCBI Desc: anthocyanin 5-aromatic acyltransferase-like protein [oryza sativa (japonica cultivar-group)]
  misc_feature (224)..(472): NCBI GI: 115446159 NCBI Desc: os02g0485000 [oryza sativa (japonica cultivar-group)]
  misc_feature (38)..(466): NCBI GI: 45790002 NCBI Desc: quercetin 3-o-glucoside-6''-o-malonyltransferase [verbena x hybrida]
MAPDQQQPPAGAGAGASSTTGSTSPRLRVHVHDTTLVPPSPSPPETSLPLTFFDVFWLQSHPVERLFLYRLAHDADVEAIISNLRSSLHKALAAFYPLAGRVRLTPGTSDRYELHYRPGDAVTFTVAECDDDVDGDAHFDALATDEPREVAKIAALVPTLPRGGRLLAVRATLLPARRGLAIGVTLHHAACDGSGSTHFLHTWAATCRGGGAESPPPPVIDRTLLADPRRLYDAFVQTAPSSEEYEFVKMSADQLFATFTLSKDDLKRVKDAVADEAARRGVAPPRCSSLVATFGLVWSCYQRGKEGSGGGAGEGSMACMAFPVDHRSRMKPPLPEKYLGNCVGPAFALAPTGELAAAGAGGLFSACAAVASAIDEAVRDIGTSSMDAWMDRIREVLPMGLLTVAGSPRFRVYDLDFGFGRPAKVDIVSVARTGAVAVAESRSGDGGIEVGVSLQPAAMERYRKCFADATLWLHQKT

SEQ ID NO: 11801 - DNA, 726 bp, Sorghum bicolor
  misc_feature: Ceres ANNOT ID no. 6033154
  misc_feature: Encodes the peptide sequence at SEQ ID NO 11802
atggagatcgggcagtaccccgtgagcagctgctccaaggagcaccagaagatctaccaggagtggttcgcgctcgcggacgcagatggggatggccgcatcacaggacccgacgcgatcaagtttttcggcatgtccaagctctcccgccccgacctcaagcaggtctgggctatctcggacaccagacggcaggggtacctgggtttccctgaattcgtcacggcgatgcagctagtctctctggcacaagcagggaatgagattactcaagatagccttaagcgagatgatttgataagtttgaatccacctgttatggaaggtttggatgccctacttgcgaaatctaagcatttggtgaagcgtgttgatccagaaatggatggatatcctcaagaacaatctactttaacgaacaaatggttcagctcaaagtcatcaaagaagatacctctgactgctgttacctctgtcatcgatggcttgaaaaaactttatatcgaaaaactgaagcctttggaagttacatacaagttcaatgattttgtctcccctttgctgacaagtagtgattttgatgcaaagccaatggttatgctcttaggtcaatattctactggtaaaacaacttttattaagcatctgctaagaacaagctatccaggtgcccatattggaccagagccaacaacagacagatttgtagttgtcatggtaaactga

SEQ ID NO: 11802 - protein, 241 aa, Sorghum bicolor
  misc_feature: Ceres ANNOT ID no. 6033154
  misc_feature (13)..(238): NCBI GI: 38345297 NCBI Desc: osjnba0043a12.19 [oryza sativa (japonica cultivar-group)]
  misc_feature (12)..(239): NCBI GI: 92878920 NCBI Desc: eps15 homology (eh); actin-binding, actinin-type [medicago truncatula]
  misc_feature (12)..(239): NCBI GI: 92884328 NCBI Desc: eps15 homology (eh); dynamin; actin-binding, actinin-type [medicago truncatula]
  misc_feature (8)..(239): NCBI GI: 42572841 NCBI Desc: calcium-binding ef hand family protein [arabidopsis thaliana]
  misc_feature (8)..(239): NCBI GI: 42566321 NCBI Desc: calcium-binding ef hand family protein [arabidopsis thaliana]
MEIGQYPVSSCSKEHQKIYQEWFALADADGDGRITGPDAIKFFGMSKLSRPDLKQVWAISDTRRQGYLGFPEFVTAMQLVSLAQAGNEITQDSLKRDDLISLNPPVMEGLDALLAKSKHLVKRVDPEMDGYPQEQSTLTNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMVN

SEQ ID NO: 11803 - DNA, 1209 bp, Sorghum bicolor
  misc_feature: Ceres ANNOT ID no. 6033386
  misc_feature: Encodes the peptide sequence at SEQ ID NO 11804
atggcggtggggcctgattccgccggcagtagcagccacatccctgatgacatactcttttgtaaaattctcatactactccctgtgaaatgtcttgtgcgcttccagtcagtatgcaagagttggcgcagaactatactcagtactcattttacccgctgccacctggagcattctaggactaggttgtcaatggtggttgttccccgagggtaccagaaggactataggaacagtagcattgagggtgtcagtttctacagtttccagcctgggcaaagcaaggttgctgaactcatcctagagaagaggtgtcccggtggaatcccgatcttcaccattcctttgcattgtgatgggctcattctgatcccttgctttatgggacggatgtttgtgtgtaacccggcaaccagggagtttgttgaattgccacaaggaagccatagtactgctggggatagcagggtcgcctttggtgttgacccttgtactggtaagtacaaggtcgctaggcacttctaccgctcatatgccgaaatcccacagacagatggggaaggcatagttctggaatacagtgctgggcatgagatcttgaccattggtgatggagcagatgcttggaaatggaaggctaccgtggacccaccttatgctatcagtgccaagactccgatttgtctacctgggttcttctactggagcgctctccactccatcaccagacatggcatccgcaaggtcagttcacatgtcatcctaaagtttagcttgcatgatgaaacgttcaccgtgcattcccacccgccaacctatgggtttctaaccaataatgacaccctgtgcaatcttggtggtaagctatgctatgttgggtcttcctcgccgtgggaagtggaaatttggttggcagaggatggtccaaaccttgcttggctgcggcattgttgcatctgcttgccagtgccaaggctactgaaggtttttgcttgtgcttcaggcgatagaaacaagatattcctgtcaattgatgcctttcgcctttcgagatgtgatctgcgcgatggatctcttgaggaaataatcgagatggcacaggacttgttgtatgaccatcggaatggaataaaattcagcactggactccattctgttgcccattacatggttccttgtgtggaatcgcttttgtgtatcagaccatga

SEQ ID NO: 11804 - protein, 402 aa, Sorghum bicolor
  misc_feature: Ceres ANNOT ID no. 6033386
  misc_feature (9)..(57): Pfam Id: F-box Pfam Desc: F-box domain
  misc_feature (7)..(248): NCBI GI: 115477310 NCBI Desc: os08g0518300 [oryza sativa (japonica cultivar-group)]
  misc_feature (14)..(303): NCBI GI: 38347475 NCBI Desc: osjnba0084n21.13 [oryza sativa (japonica cultivar-group)]
  misc_feature (14)..(365): NCBI GI: 115476200 NCBI Desc: os08g0382800 [oryza sativa (japonica cultivar-group)]
  misc_feature (40)..(321): NCBI GI: 115483534 NCBI Desc: os10g0567900 [oryza sativa (japonica cultivar-group)]
  misc_feature (90)..(317): NCBI GI: 108708334 NCBI Desc: f-box domain containing protein [oryza sativa (japonica cultivar-group)]
  misc_feature: The sequence is a functional homolog of SEQ ID NO. 456 in the 11/188,298 US application
MAVGPDSAGSSSHIPDDILFCKILILLPVKCLVRFQSVCKSWRRTILSTHFTRCHLEHSRTRLSMVVVPRGYQKDYRNSSIEGVSFYSFQPGQSKVAELILEKRCPGGIPIFTIPLHCDGLILIPCFMGRMFVCNPATREFVELPQGSHSTAGDSRVAFGVDPCTGKYKVARHFYRSYAEIPQTDGEGIVLEYSAGHEILTIGDGADAWKWKATVDPPYAISAKTPICLPGFFYWSALHSITRHGIRKVSSHVILKFSLHDETFTVHSHPPTYGFLTNNDTLCNLGGKLCYVGSSSPWEVEIWLAEDGPNLAWLRHCCICLPVPRLLKVFACASGDRNKIFLSIDAFRLSRCDLRDGSLEEIIEMAQDLLYDHRNGIKFSTGLHSVAHYMVPCVESLLCIRP

SEQ ID NO: 11805 - DNA, 1155 bp, Sorghum bicolor
  misc_feature: Ceres ANNOT ID no. 6033441
  misc_feature: Encodes the peptide sequence at SEQ ID NO 11806
atgggcatttgggattccattctccccggcggcagccggcgcttcatcaagcgcaaggacagcgacgccggcgaggcaggtcgggcactagaggaactgaggggctcactgtacaatgactttcatacttcagaaggggccaagcgtcagcagcagagactttgtggccctattgttgcgctgacattcaactttgtggttgctgttgggatcatcatggcaaacaaaatggtgatgggcactgttggatttaacttcccagtcgcactgtcgttaattcattacctatttgctttggctttaatggctgttctcaaggcattatacttgctgccagttgctcctccttcaaaatccactcctttctcatcattatttgctttaggtgctgtcatgtctttctccactgggcttgccaatatcagcttaaagcataacagtgtaggtttttatcagatggctaagatagctgtaactccaaccatagtagtagcagaatttattcttttcaagaaaagagtttcccttcgaaaggttatcacgctggttgttgtctcatttggtgtggccattgcaactgttactgatttggagttcaatttttttggtgcttgtgtagcactagcttggattattcctagtgctgtaaacaaaatcctgtggtcaaatttacaacagagtggaaactggacagctcttgcgttaatgtggaagacaaccccaattaccatatttttctttgttgttttgatgccactgttggatcctccaggccttttatctttcaattgggacttgaagaacagcagcgcaattatcacatctgctttgttcggtttccttcttcagtggtctggtgctttggcacttggggcaacctcggctctcgctcatgttgtgctaggtcagttcaagacgattgttataatgctctctggttatctggtatttaaatctgatcctggattcaccagcctctgtggagctgtcattgcccttgcagggatgtcagtgtatacttacctagggatgaaagagtcagccaccagcagtaggagaaattccttaaattcaaggcagaattctcatgtgatgaagtccaaggttattgtagatggagaaaagccagaaacaaagcccatggattttgtgtaa

SEQ ID NO: 11806 - protein, 384 aa, Sorghum bicolor
  misc_feature: Ceres ANNOT ID no. 6033441
  misc_feature (203)..(341): Pfam Id: TPT Pfam Desc: Triose-phosphate Transporter family
  misc_feature (27)..(384): NCBI GI: 45736011 NCBI Desc: glucose-6-phosphate/phosphate-tranlocator-like [oryza sativa (japonica cultivar-group)]
  misc_feature (1)..(146): NCBI GI: 115467676 NCBI Desc: os06g0297600 [oryza sativa (japonica cultivar-group)]
  misc_feature (64)..(356): NCBI GI: 145343050 NCBI Desc: dmt family transporter: phosphate/phosphoenolpyruvate dmt [ostreococcus lucimarinus cce9901]
  misc_feature (56)..(356): NCBI GI: 48717036 NCBI Desc: phosphate translocator-like [oryza sativa (japonica cultivar-group)]
  misc_feature (60)..(373): NCBI GI: 50509221 NCBI Desc: transporter-related-like [oryza sativa (japonica cultivar-group)]
  misc_feature: The sequence is a functional homolog of SEQ ID NO. 484 in the 11/188,298 US application
  misc_feature: The sequence is a functional homolog of SEQ ID NO. 360 in the 11/188,298 US application
MGIWDSILPGGSRRFIKRKDSDAGEAGRALEELRGSLYNDFHTSEGAKRQQQRLCGPIVALTFNFVVAVGIIMANKMVMGTVGFNFPVALSLIHYLFALALMAVLKALYLLPVAPPSKSTPFSSLFALGAVMSFSTGLANISLKHNSVGFYQMAKIAVTPTIVVAEFILFKKRVSLRKVITLVVVSFGVAIATVTDLEFNFFGACVALAWIIPSAVNKILWSNLQQSGNWTALALMWKTTPITIFFFVVLMPLLDPPGLLSFNWDLKNSSAIITSALFGFLLQWSGALALGATSALAHVVLGQFKTIVIMLSGYLVFKSDPGFTSLCGAVIALAGMSVYTYLGMKESATSSRRNSLNSRQNSHVMKSKVIVDGEKPETKPMDFV

SEQ ID NO: 11807 - DNA, 1302 bp, Sorghum bicolor
  misc_feature: Ceres ANNOT ID no. 6033656
  misc_feature: Encodes the peptide sequence at SEQ ID NO 11808
atgggtatctcatccaagtggattaaatctttggttggcataaggaagcaagaaaaagggcagaatgcagaaaagcaagaaaaaggacgaaatgctgagagcagtgaaactatgagctctgctaatgaatcgctgcacaaacagaaacattctttggttcctggaggtgcacttgcagtcgaagaaattgcagtacaaagtggagcattgactgatgacaaaagcacacagatgatttcaaattcaatttgttcagacaatacatcacttgatgtgcaaatttctcaggctgaacatcatagtaaagaagatttggccgcaactgttgtccagtctgcgtttcgagcgttcttggctaggcgtgctttacgagctttgaaaggaatagttctacttcaagcccttattaggggtcattctgttagaaggcaaacaacagagacacttcaatgtatgcaagcgctggtaaaagcacaagctcgtgtccgagcaagacaggttcgtgttgccttagagaatcaagtggcaaggaaaaagattcctgaacaagatgatcatgagaaccatgtccgagaagtcgagggaggctggtgtggcagtattggttccatggaggaaatgcaagctaaagcattgaaaaggcgagaagctgctgctaagcgtgagagggcaatggcatacgctttgactcatcagcggcaagctggttccaagcaacaaatttctacgagtctacaaggtcttgaacttggtgagaaccactgggggtcaaattggttagacaggtggatggctgtacgtccatgggaaaacaggttacttgactgtaatgccaaagagagtctgccaacgcatgaagataagaaggatgaggaagcaaattctcagatcacaccaaagggtaaagtgtcaacttcaaatactcctggtctgagcaagaagaaaggtgtaaaccacaaaaagtcatattcagatgttagttgtacttcatttgcacgacaggcaaatgtattgccatccacatctttaggatcatccaaacagaaggcaaaggttacggatgaagtttttgaggaagtcagctcccagccaacagatataggttctaaggctgtgcgcaatccaaaagataagcttgtgcaagtgaatgcaccagccaagaagcggttatccctcccaaataatgttggcagggaagcagggaagggaccaacccacaggaattcgattaacaggtctggtccaaaagcacaggcagacgctcctaaccagggtggggagcctgttgagttacaggcctga

SEQ ID NO: 11808 - protein, 433 aa, Sorghum bicolor
  misc_feature: Ceres ANNOT ID no. 6033656
  misc_feature (104)..(124): Pfam Id: IQ Pfam Desc: IQ calmodulin-binding motif
  misc_feature (1)..(431): NCBI GI: 140062699 NCBI Desc: iq calmodulin-binding region [medicago truncatula]
  misc_feature (1)..(431): NCBI GI: 92876066 NCBI Desc: iq calmodulin-binding region [medicago truncatula]
  misc_feature (1)..(395): NCBI GI: 15233296 NCBI Desc: calmodulin-binding family protein [arabidopsis thaliana]
  misc_feature (102)..(344): NCBI GI: 115465173 NCBI Desc: os05g0541100 [oryza sativa (japonica cultivar-group)]
  misc_feature (94)..(306): NCBI GI: 92868235 NCBI Desc: iq calmodulin-binding region [medicago truncatula]
MGISSKWIKSLVGIRKQEKGQNAEKQEKGRNAESSETMSSANESLHKQKHSLVPGGALAVEEIAVQSGALTDDKSTQMISNSICSDNTSLDVQISQAEHHSKEDLAATVVQSAFRAFLARRALRALKGIVLLQALIRGHSVRRQTTETLQCMQALVKAQARVRARQVRVALENQVARKKIPEQDDHENHVREVEGGWCGSIGSMEEMQAKALKRREAAAKRERAMAYALTHQRQAGSKQQISTSLQGLELGENHWGSNWLDRWMAVRPWENRLLDCNAKESLPTHEDKKDEEANSQITPKGKVSTSNTPGLSKKKGVNHKKSYSDVSCTSFARQANVLPSTSLGSSKQKAKVTDEVFEEVSSQPTDIGSKAVRNPKDKLVQVNAPAKKRLSLPNNVGREAGKGPTHRNSINRSGPKAQADAPNQGGEPVELQA

SEQ ID NO: 11809 - DNA, 687 bp, Sorghum bicolor
  misc_feature: Ceres ANNOT ID no. 6033676
  misc_feature: Encodes the peptide sequence at SEQ ID NO 11810
atggcggccgtccagtccaacagggcccacccgcaccgccgctccgaggcgtcctccccggcgacctccgtggccgtggcggcggcgagagccgacgacgctcagcgccagcgtcgtccgagggtgccggtgcaggtccgggagcagggcccgctggcggtggggcatcatcatccacaccaccagctgcggcggtcagcggcattcccgccgcgccgcccaggtgcagtgcctgcagtgcgccgccctcctcagcgctgcgacagcgacctcaacatcagggagcaccgcacctgcagcgaggtggccggcggcaccgcggcgggctgcgccgccgtgtgctgctgcttcccctgcgtcatggtggaggtcgtggtgctcgccacggtgcgcgcgcccgcggcgctgtgccgtaaggccgcccgcgtgcgcaaggctggccggcggcgctccgcttccgcggggcaggccacggagatctacgagctcctcgtggacgacgccgccgtcgtcgaggtggacgccacgggcgccgccgacgcggccgtggcgctgccggtggtgaagcccgccttggagctggaggacaccggggagctggagaaggaggtgtgggcgaggttctacggcaccggcttctggaggagcccgtcgcagctcgacgacttggacgacgacagcagctga

SEQ ID NO: 11810 - protein, 228 aa, Sorghum bicolor
  misc_feature: Ceres ANNOT ID no. 6033676
  misc_feature (51)..(222): NCBI GI: 115489628 NCBI Desc: os12g0621400 [oryza sativa (japonica cultivar-group)]
  misc_feature (99)..(219): NCBI GI: 19455 NCBI Desc: pollen preferential protein [lilium longiflorum]
  misc_feature (101)..(218): NCBI GI: 115455369 NCBI Desc: os03g0750500 [oryza sativa (japonica cultivar-group)]
  misc_feature (97)..(218): NCBI GI: 87240560 NCBI Desc: tonb box, n-terminal [medicago truncatula]
  misc_feature: Useful for making plants with modulated nitrogen use efficiency
  misc_feature: Functional homolog of the protein sequence given in SEQ ID NO 12930
MAAVQSNRAHPHRRSEASSPATSVAVAAARADDAQRQRRPRVPVQVREQGPLAVGHHHPHHQLRRSAAFPPRRPGAVPAVRRPPQRCDSDLNIREHRTCSEVAGGTAAGCAAVCCCFPCVMVEVVVLATVRAPAALCRKAARVRKAGRRRSASAGQATEIYELLVDDAAVVEVDATGAADAAVALPVVKPALELEDTGELEKEVWARFYGTGFWRSPSQLDDLDDDSS

SEQ ID NO: 11811 - DNA, 294 bp, Sorghum bicolor; identical to SEQ ID NO: 11249
  misc_feature: Ceres ANNOT ID no. 6033738
  misc_feature: Encodes the peptide sequence at SEQ ID NO 11812

SEQ ID NO: 11812 - protein, 97 aa, Sorghum bicolor; identical to SEQ ID NO: 11250
  misc_feature: Ceres ANNOT ID no. 6033738
  misc_feature (1)..(80): Pfam Id: SPC12 Pfam Desc: Microsomal signal peptidase 12 kDa subunit (SPC12)
  misc_feature (1)..(97): NCBI GI: 108862603 NCBI Desc: microsomal signal peptidase 12 kda subunit family protein [oryza sativa (japonica cultivar-group)]
  misc_feature (1)..(97): NCBI GI: 115488412 NCBI Desc: os12g0438900 [oryza sativa (japonica cultivar-group)]
  misc_feature (1)..(97): NCBI GI: 30102562 NCBI Desc: at4g40042 [arabidopsis thaliana]
  misc_feature (1)..(72): NCBI GI: 5138926 NCBI Desc: hspc033 [homo sapiens]
  misc_feature (1)..(72): NCBI GI: 20140350 NCBI Desc: microsomal signal peptidase 12 kda subunit (spase 12 kda subunit) (spc12) (hspc033)

SEQ ID NO: 11813 - DNA, 600 bp, Sorghum bicolor
  misc_feature: Ceres ANNOT ID no. 6033805
  misc_feature: Encodes the peptide sequence at SEQ ID NO 11814
atggacgagccagccggcgacggcggcgtgcacgggcagcgacgggacggagggcggcagcacgcgccggcggtggtgtcgctgcgggagctgagcctggcggacgcggacgtggacgccttcatgtcgtgggcgtcggacgaccgcgtgatgcggtacctggtgaagcggccgcggtgcgacactcgagagcaggccgtggcgcagatccgggacaccgtgctgggccacccgtggttccgcgccgtctgcgtcggcggcggcgacggccgccccgtgcccgtggggcaggtgtccgtgtggccgtacgccgacgagggaggacgcagggccaacatcggctacgccctcgcgcacgaccagtggggccggggcatcgccgtcgccgccatcaggatggtggtgggcagggtgttcgacgacctgccggggctggagcggctggaggcggtgacggacgtggagaacgtgcggtcgcagagggtgctggagaaggccggcttccacagggagggggtgctgcgccgctacatcgccggacgcggcggcgaggccagagacgcggtgatgtatagcttcttgtcgtccgaccgtgcgtga

SEQ ID NO: 11814 - protein, 199 aa, Sorghum bicolor
  misc_feature: Ceres ANNOT ID no. 6033805
  misc_feature (86)..(169): Pfam Id: Acetyltransf_1 Pfam Desc: Acetyltransferase (GNAT) family
  misc_feature (13)..(133): NCBI GI: 115454479 NCBI Desc: os03g0665000 [oryza sativa (japonica cultivar-group)]
  misc_feature (19)..(198): NCBI GI: 115455875 NCBI Desc: os03g0794300 [oryza sativa (japonica cultivar-group)]
  misc_feature (26)..(197): NCBI GI: 11994288 NCBI Desc: alanine acetyl transferase-like protein [arabidopsis thaliana]
  misc_feature (26)..(197): NCBI GI: 92886889 NCBI Desc: gcn5-related n-acetyltransferase [medicago truncatula]
  misc_feature (26)..(197): NCBI GI: 92886886 NCBI Desc: gcn5-related n-acetyltransferase [medicago truncatula]
MDEPAGDGGVHGQRRDGGRQHAPAVVSLRELSLADADVDAFMSWASDDRVMRYLVKRPRCDTREQAVAQIRDTVLGHPWFRAVCVGGGDGRPVPVGQVSVWPYADEGGRRANIGYALAHDQWGRGIAVAAIRMVVGRVFDDLPGLERLEAVTDVENVRSQRVLEKAGFHREGVLRRYIAGRGGEARDAVMYSFLSSDRA

SEQ ID NO: 11815 - DNA, 1227 bp, Sorghum bicolor
  misc_feature: Ceres ANNOT ID no. 6033912
  misc_feature: Encodes the peptide sequence at SEQ ID NO 11816
atgggaaagcaaggaccctgccgtcattgcggagtcacaagtacccccctttggcgaaatgggccaccagataagccagtgctctgcaatgcatgtggctcaagatggaggacaaagggttcattggcaaactacattccaatgcatcgcaaggatgatgtggatgatgatgaacctagagttagtaggctaaagccaccaacatcaaagtcaaagtcccagaagaaaaaatcaaatcacatcataatggagaatgggccattttcttgtcagaatttccaaaagatgggggatgctgacccaagcaattggtctagttctggatctgcagtatcatactctgagagttgtgttgctgatgcaagtgaaatgactggttcagcacaatcacatgcttgggaatccctagtgccatcaagaaagaggagctgtgtcactcttctgaagacttcatctgtagaaaagcttgcaaaagatcttaactccatcatgcatgaagagcagttatactacctttcaggatcatcagaggaagacctactgtaccatagtgaaactcctgttggttcatttgagattggctctggaagtgtgcttctaaggcatccgaactcaaaatcactggaggaagaatcagaagcaagctccattcctgcagataataaatcatacattacaagtgaatcctattcagggtctgtgtcctttgtctctcatagtggaaacaaggcagcaatcaacttaaatgctggaactttgagaccaaaaaggtcaccactgtgtattgaagataatggtagaagtggatcaaaaggctttaccaagtctacaataaaaccagtcaaaagatcccgtgacgacaaccactttcagagcaactcagaactagatggtaccatgaggagtcctataagagctctaaaatctggagctttgactcctcaatttaaaaactcatctttgccaaaatctggctatgccagcaaagattcaacttgcactgaaggagcacttaacttactcatgttacccccagaaaagttatcattatttgtcccttctcagtatgccaactctgatcaagacttgctgctggagattcctctcaatgcacggcacccagaggcagaacttctttgtcagccatctcagctgagctcaataacccacagctccacctctgtggatggggttgctgacggggaggggcatctgaagcaaccatag

SEQ ID NO: 11816 - protein, 408 aa, Sorghum bicolor
  misc_feature: Ceres ANNOT ID no. 6033912
  misc_feature (7)..(42): Pfam Id: GATA Pfam Desc: GATA zinc finger
  misc_feature (1)..(267): NCBI GI: 38345953 NCBI Desc: osjnbb0038f03.10 [oryza sativa (japonica cultivar-group)]
  misc_feature (1)..(224): NCBI GI: 89257582 NCBI Desc: gata zinc finger containing protein [brassica oleracea]
  misc_feature (1)..(242): NCBI GI: 89257425 NCBI Desc: gata zinc finger containing protein [brassica oleracea]
  misc_feature (1)..(232): NCBI GI: 89257552 NCBI Desc: gata zinc finger containing protein [brassica oleracea]
  misc_feature (14)..(45): NCBI GI: 144924872 NCBI Desc: zinc finger, gata-type [medicago truncatula]
  misc_feature: The sequence is a functional homolog of SEQ ID NO 1835 in the 11/479,226US patent application
  misc_feature: The sequence is a functional homolog of SEQ ID NO 2640 in the 10/374,780US patent application
  misc_feature: The sequence is a functional homolog of SEQ ID NO 4 in the 11/375,241US patent application
  misc_feature: Useful for making plants with modulated growth and phenotype characteristics
  misc_feature: The sequence is a functional homolog of SEQ ID NO 2640 in the 20060162006 US patent application
  misc_feature: The sequence is a functional homolog of SEQ ID NO 1835 in the 20070022495 US patent application
MGKQGPCRHCGVTSTPLWRNGPPDKPVLCNACGSRWRTKGSLANYIPMHRKDDVDDDEPRVSRLKPPTSKSKSQKKKSNHIIMENGPFSCQNFQKMGDADPSNWSSSGSAVSYSESCVADASEMTGSAQSHAWESLVPSRKRSCVTLLKTSSVEKLAKDLNSIMHEEQLYYLSGSSEEDLLYHSETPVGSFEIGSGSVLLRHPNSKSLEEESEASSIPADNKSYITSESYSGSVSFVSHSGNKAAINLNAGTLRPKRSPLCIEDNGRSGSKGFTKSTIKPVKRSRDDNHFQSNSELDGTMRSPIRALKSGALTPQFKNSSLPKSGYASKDSTCTEGALNLLMLPPEKLSLFVPSQYANSDQDLLLEIPLNARHPEAELLCQPSQLSSITHSSTSVDGVADGEGHLKQP

SEQ ID NO: 11817 - DNA, 360 bp, Sorghum bicolor
  misc_feature: Ceres ANNOT ID no. 6033990
  misc_feature: Encodes the peptide sequence at SEQ ID NO 11818
atgaacgtggaggaggaggtcgggaaactcaaggaggagatccagaggctgggccagcagcagcccgatggctcctacaaggtcaagtttggtgtcctcttcaacgatgatcggtgtgcaaatatttttgaagcactagttggcaccttgagggccgccaagaagaggaaggttttgacctatgatggcgagctgcttctgcaaggcgttcatgacaatgtggagataaccctgttgcctcctcccgcaagcgccacaaagttctcaattccatacacctcgtatgcttgtatttcaccctgcctagattctcatgaaccatttggtattcccagaagactgctattgtgtgatgtatga

SEQ ID NO: 11818 - protein, 119 aa, Sorghum bicolor
  misc_feature: Ceres ANNOT ID no. 6033990
  misc_feature (1)..(79): NCBI GI: 24980968 NCBI Desc: 3110003a17rik protein [mus musculus]
  misc_feature (1)..(79): NCBI GI: 6841210 NCBI Desc: hspc280 [homo sapiens]
  misc_feature (1)..(79): NCBI GI: 119568287 NCBI Desc: hcg1640751 [homo sapiens]
  misc_feature (2)..(79): NCBI GI: 51571939 NCBI Desc: zgc:92005 [danio rerio]
  misc_feature (2)..(79): NCBI GI: 94732716 NCBI Desc: novel protein [danio rerio]
  misc_feature: Useful for making plants with modulated nitrogen use efficiency
  misc_feature: GREAT-hit functional homolog of the protein sequence given in SEQ ID NO 13015
  misc_feature: Useful for making plants with modulated nitrogen use efficiency
  misc_feature: Functional homolog of the protein sequence given in SEQ ID NO 13015
MNVEEEVGKLKEEIQRLGQQQPDGSYKVKFGVLFNDDRCANIFEALVGTLRAAKKRKVLTYDGELLLQGVHDNVEITLLPPPASATKFSIPYTSYACISPCLDSHEPFGIPRRLLLCDV

SEQ ID NO: 11819 - DNA, 1350 bp, Sorghum bicolor
  misc_feature: Ceres ANNOT ID no. 6034095
  misc_feature: Encodes the peptide sequence at SEQ ID NO 11820
atggccgccgcgacagagaagacggccgaggacatccgccgcgagctccaggagctccagcgccagcaccgcgagatcaccgagcgcctgcgcgacccccgtggccttcgccgcggcgcccccggccctggtcctggacctgggggggcccgcccgctccgcggcttcgtgagaccccctgtgggtgcggaatcgggggatcagcctccgcagaagcgtcggcttctatcggccgtagttaaggtggatggcgctgaaaataataataatgaggaaggcacaaaggatgtagatgtggaggggcacgagccaagttcaggtgtcactgaaggcagtgacaggaggggtttcaacaatggtgggttcagaagggatggtaacctgaggatgcagaggagggtggactataattcgctgccagagccagctccaagggagcttcccaggaatgaagacccgaatttggtgagaaggaataagaggatgctggggcagcttcttgtcggtacattagagaaatttcaacaagaggataaaaagttatccaactctgaggcttttctgcgcagatcagagactcagcgaaaggctgagcaaaaggttcgtgaagaaagtgaaaggttgcgacagcaggaacgtgagcaaattgcagagaagcgtaagcgtgatatgacacttcgcgcacgtgtagccgctaaggcagaagaaaagaggttggagctgttgtacattcaatggactgagcatcataaaaggctgtccaatttcttaaggacaaaaactgaaccacctatttactacatgccaactaaaccaattattgatgatccggccattgttgagcagaacaaggaagtggcattcgaagaatggaagtctatgcgcagggctgagctgactcagttccaaaagcaagtggaggagcaatatctttcaaatgtggagaggcagttggagaagatccagaatgcccggaatgctcggaaggcgaatgggcctgctaacatgcaagaaatggacaaggagctggacacacacagggcggagcatggtccaaagactcggcgagttcctgaggagggtggcaatgacgatgacgaagatgcagaggacatggctgcggaagatgagctgatggatgaagttctgggcatcaacgatggaatcaatgaggacccatccaagccgtccgaagaagccactactgaaggcggtgggcctgcacccgaggaagcgtaccattccgtatgcttagttgccgtcttgttgggaactgcttgtacgtgtatttttgttagacgttccccactggttaggctgtgttttaatattgctgttttggctttttga

SEQ ID NO: 11820 - protein, 449 aa, Sorghum bicolor
  misc_feature: Ceres ANNOT ID no. 6034095
  misc_feature (151)..(288): Pfam Id: Pinin_SDK_memA Pfam Desc: pinin/SDK/memA/ protein conserved region
  misc_feature (3)..(411): NCBI GI: 124360421 NCBI Desc: pinin/sdk/mema protein [medicago truncatula]
  misc_feature (4)..(383): NCBI GI: 5103819 NCBI Desc: est gbh77143 comes from this gene. [arabidopsis thaliana]
  misc_feature (149)..(415): NCBI GI: 49522306 NCBI Desc: pinin, desmosome associated protein [xenopus tropicalis]
  misc_feature (149)..(415): NCBI GI: 3021600 NCBI Desc: nuclear protein sdk2 [xenopus laevis]
  misc_feature (149)..(415): NCBI GI: 3021598 NCBI Desc: nuclear protein [xenopus laevis]
MAAATEKTAEDIRRELQELQRQHREITERLRDPRGLRRGAPGPGPGPGGARPLRGFVRPPVGAESGDQPPQKRRLLSAVVKVDGAENNNNEEGTKDVDVEGHEPSSGVTEGSDRRGFNNGGFRRDGNLRMQRRVDYNSLPEPAPRELPRNEDPNLVRRNKRMLGQLLVGTLEKFQQEDKKLSNSEAFLRRSETQRKAEQKVREESERLRQQEREQIAEKRKRDMTLRARVAAKAEEKRLELLYIQWTEHHKRLSNFLRTKTEPPIYYMPTKPIIDDPAIVEQNKEVAFEEWKSMRRAELTQFQKQVEEQYLSNVERQLEKIQNARNARKANGPANMQEMDKELDTHRAEHGPKTRRVPEEGGNDDDEDAEDMAAEDELMDEVLGINDGINEDPSKPSEEATTEGGGPAPEEAYHSVCLVAVLLGTACTCIFVRRSPLVRLCFNIAVLAF

SEQ ID NO: 11821 - DNA, 291 bp, Sorghum bicolor
  misc_feature: Ceres ANNOT ID no. 6034198
  misc_feature: Encodes the peptide sequence at SEQ ID NO 11822
atggcgttctggcaggcgcgcgattttctcttctgcggcgtatgcggcaccctcctcaccttcgactccgtccactccgcctcctgccctctatgcggcttcaagcgcggtgccaaagagatggaagggaaacaaatacagtacaccatgaccgccgaggacattcgaagagggttaaagacactgacggaggaaattgttgtgcaaagaccaaagatgcgttcagcagatgagggagagacgatattctacacatgtacaaaatgtgaaaaaaatttcaaagacgactga

SEQ ID NO: 11822 - protein, 96 aa, Sorghum bicolor
  misc_feature: Ceres ANNOT ID no. 6034198
  misc_feature (8)..(95): NCBI GI: 8778992 NCBI Desc: contains a weak similarity to transcription elongation factor s-ii from drosophila melanogaster gi135660 and contains a transcription factor s-ii domain pf01096. [arabidopsis thaliana]
  misc_feature (72)..(96): NCBI GI: 71153713 NCBI Desc: dna-directed rna polymerase i subunit 12 (nuclear rna polymerase i small specific subunit rpa12) (zinc ribbon domain containing protein 1)
  misc_feature (72)..(96): NCBI GI: 56805536 NCBI Desc: transcription-associated zinc ribbon protein [sus scrofa]
  misc_feature (72)..(96): NCBI GI: 115392099 NCBI Desc: zinc ribbon domain containing 1 [pan troglodytes]
  misc_feature (72)..(96): NCBI GI: 86197925 NCBI Desc: zinc ribbon domain containing, 1 [homo sapiens]
MAFWQARDFLFCGVCGTLLTFDSVHSASCPLCGFKRGAKEMEGKQIQYTMTAEDIRRGLKTLTEEIVVQRPKMRSADEGETIFYTCTKCEKNFKDD

SEQ ID NO: 11823 - DNA, 2718 bp, Sorghum bicolor
  misc_feature: Ceres ANNOT ID no. 6034290
  misc_feature: Encodes the peptide sequence at SEQ ID NO 11824
  misc_feature: Up-regulated in root tissues in response to salicylic acid treatment
atggagcccaagccgtcttcggcggcgcatggtgacgcgcccgcggtcgaggccccccgccgccgtggcggcggcggcaagcgcaagtcggccgggtcctcgtttacgccgtcgaagcggcaggccaaggagcggaacgcttccttccacgtgccgccgcatcttctgcacagcgggccgctcacccgcgccgcgcgccagtcgccgcacaagctcgcgggcacgccgccggagtcggggccagcgtcgtcggcggccgcaactggggacggggtgagcggcgggaaggcgggggttgatgcgatccggcccgagacggcggagacgccggccccggagctgccgctggtggacgagatgttcgaggccgtccgatcccgtggcgccggcgtccatgtggtccctacctttgctggatggttttcatggaaagaaatccacccggttgagaagcagaccttgccttctttttttaatggaaaatctgagaagcggacacctgaggtatatttggcgattagaaattcgatcgtgatgaaatttcatgccaatcctcaatgtcagctggagtccaaagatctggctgagttttcaatcggggagaccgatgctcggcaggaagtcttggaattcttggatcactggggcttgataaatttccaccctttcccacctgctggacatgaggagagtaagccagaggagagccaagacaattctaatgatgagaaagcttctttgatcgagcagctgtttaaatttgaatcagttcaatcatatatgatgcctttaccaaagaaagaagatgtgggagctccgccacctctgcctagcttgtttcctgaacctgtactcattgaagatgtggttgcagcagctgagccttctgttgagtaccactgcaactcctgttcagttgattgctcgcggaagcgctatcattgtcggacccaggcagattttgacctctgttgtgattgctataatgaagggaagtttgatccaggcatggccaaaactgatttcatcctcatggattctgctgaagtttcaggtgctagtggtactagttggactgatgaggagacgttacttcttttagaaggtttggaaatttttggtggaaaatgggctgagattgctgaacatgttgctactaagacaaaagcacaatgcatgttgcactttcttcaaatgcaaattgaagaccgcttccatgatggcgaagatattaatcaaaacataccagtacgtacagagcaagccacaacggagaaagtcattgctgaaacatctgagaaaatggaagttgaagataaagcagaaggaagagatactgcggatgagaatgccttagagaaaacagagggaaactgtgtagaaacaaaaactgaagatgcaagtgttgttgtaaataaagatactcagaattcgggtggcaaagattcaggtgtatctccaagcactgaagagccaaagcaatcttctgatgagcagcctatagtaaaggaaaattctgtagatgtagatacttctggtgaaaaactatcaaatgttgctattgatatcctaaaatctgcatttgaggctgctggtcacagcccagaatatgaaggttcatttgctgatgcaggaaatccagttatggcactagcagcgtatttaactggtcttatggacgatgataacactaccacttcattccgtggttcactaaaagctatatctgaggtgtctcctgcactccaattagcaagtaggcactgttttattcttgaggacccaccaaatgaactcaaagacatttgtgctagtgtaagtaagaaaaatacagatggtgatcaaccaaaagatgaggatatgattcaaaattcaattgatactgagaaaaaggtgatcaatgagaaagaagataagtctttgtctgtggaaaagaaaaacaattcatccacgtcacaaaatgaccaccaagaaacagacattaagagtgtctcacatgatgactgctccttagtggagccaaaaaccaataatgctaaggagtcaggtgattcaactgctattggggatacgagtgcaaccgacactacaaaaggtaatactaaacaagtgaatgacttaccaagtgttgaggtgggggctcctgatgattcatctttaaaaggcaaggataagctcaataagactgaagatgcagtggcgacaccagctaccgtacaggaacagaaacagaaacagaaacacagccaagcattggaaaatggtgataagaaaggacctaacaacattgaaagtgtaattgtcgatgaagagaagggatctatagtgactgccaaccaaaatgattccataactaggctcaaacgagcagcagccactgctgtttcagcagctgctgtgaaagctaagtttctcggtgatcaggaggaatatcaaattcgaaggctgacagcacttatgattgaaaagctgttccaaaaaatagaagtgaagatgtcgttgttttcagagattgagcaggtggtccttcgaacaagagagtataccgagaagaccagaaagaagctcctaatggaacgaaatgccattattgcagctcggatgggtgcattgccgtctaggccaaaccagcctggtgtagccggaaacaggttaccacctggatatagcaaccctcctgtaaggcctccaaacgcaatgccgcggcctaccagctga

SEQ ID NO: 11824 - protein, 905 aa, Sorghum bicolor
  misc_feature: Ceres ANNOT ID no. 6034290
  misc_feature (132)..(220): Pfam Id: SWIRM Pfam Desc: SWIRM domain
  misc_feature (355)..(400): Pfam Id: Myb_DNA-binding Pfam Desc: Myb-like DNA-binding domain
  misc_feature (295)..(339): Pfam Id: ZZ Pfam Desc: Zinc finger, ZZ type
  misc_feature (76)..(889): NCBI GI: 90265155 NCBI Desc: h0201g08.8 [oryza sativa (indica cultivar-group)]
  misc_feature (76)..(889): NCBI GI: 38345579 NCBI Desc: osjnba0027h06.15 [oryza sativa (japonica cultivar-group)]
  misc_feature (380)..(905): NCBI GI: 115455015 NCBI Desc: os03g0722100 [oryza sativa (japonica cultivar-group)]
  misc_feature (7)..(751): NCBI GI: 30690036 NCBI Desc: dna-binding family protein [arabidopsis thaliana]
  misc_feature (7)..(794): NCBI GI: 42573171 NCBI Desc: dna-binding family protein [arabidopsis thaliana]
  misc_feature: Up-regulated in root tissues in response to salicylic acid treatment
  misc_feature: The sequence is a functional homolog of SEQ ID NO. 492 in the 11/188,298 US application
MEPKPSSAAHGDAPAVEAPRRRGGGGKRKSAGSSFTPSKRQAKERNASFHVPPHLLHSGPLTRAARQSPHKLAGTPPESGPASSAAATGDGVSGGKAGVDAIRPETAETPAPELPLVDEMFEAVRSRGAGVHVVPTFAGWFSWKEIHPVEKQTLPSFFNGKSEKRTPEVYLAIRNSIVMKFHANPQCQLESKDLAEFSIGETDARQEVLEFLDHWGLINFHPFPPAGHEESKPEESQDNSNDEKASLIEQLFKFESVQSYMMPLPKKEDVGAPPPLPSLFPEPVLIEDVVAAAEPSVEYHCNSCSVDCSRKRYHCRTQADFDLCCDCYNEGKFDPGMAKTDFILMDSAEVSGASGTSWTDEETLLLLEGLEIFGGKWAEIAEHVATKTKAQCMLHFLQMQIEDRFHDGEDINQNIPVRTEQATTEKVIAETSEKMEVEDKAEGRDTADENALEKTEGNCVETKTEDASVVVNKDTQNSGGKDSGVSPSTEEPKQSSDEQPIVKENSVDVDTSGEKLSNVAIDILKSAFEAAGHSPEYEGSFADAGNPVMALAAYLTGLMDDDNTTTSFRGSLKAISEVSPALQLASRHCFILEDPPNELKDICASVSKKNTDGDQPKDEDMIQNSIDTEKKVINEKEDKSLSVEKKNNSSTSQNDHQETDIKSVSHDDCSLVEPKTNNAKESGDSTAIGDTSATDTTKGNTKQVNDLPSVEVGAPDDSSLKGKDKLNKTEDAVATPATVQEQKQKQKHSQALENGDKKGPNNIESVIVDEEKGSIVTANQNDSITRLKRAAATAVSAAAVKAKFLGDQEEYQIRRLTALMIEKLFQKIEVKMSLFSEIEQVVLRTREYTEKTRKKLLMERNAIIAARMGALPSRPNQPGVAGNRLPPGYSNPPVRPPNAMPRPTS

SEQ ID NO: 11825 - DNA, 1389 bp, Sorghum bicolor
  misc_feature: Ceres ANNOT ID no. 6034355
  misc_feature: Encodes the peptide sequence at SEQ ID NO 11826
atggatcgcgacacgagcacagtagcccgaggacggaggcgaggcccacctctgcccgtccgcgccccacacgggcgctggcgtgacacaccaccgccgtcggtggcttgggtgcaggcaaggcgttcgacagaacgccccccggctaccgagccggcaaggcccagcgccgggcgcgagccggagctcctgtcgtgggcggacctcccggcggacatcctggggctcgtggtcggtcgcctccctcgcgtcgacgaccgcgccaggctgcgctccgtctgccgggcgtggcgcgccgcggcgcgcgttcacggacggccgccgtcgccgctcccgctgctcgtgctctccgacttctccttctccgccttctgcgctgacggggctatggcggacgtgcgacgcatccctctgccctcacgggagatggcggctggcgtccgctgcgtgggctcctttcacgggtggctcgtcggcgtgcagctcaacaaaggtcgctactttggtgacggccggtgcttcctgatgaatgctttctaccaggacgtcgtccgcctcccgccgccttccgtaaacacccactccctcgatgcctatagtaaatctctccccatcgccaatggctctggtgcagtgcaatgcacggtcaatggcgcccagtatgtgatgtcgttctgcaaggtagtcttgtcctcctcaccggaccatgatggcaagtgcatcgtggctgctgtctccgtgcacaggagcacagctagccttgcactctggcgccctgggatgacgtcgtggtgcgtctgccaaggtggctgcatcagtaagttcagtgacattgcattgtaccagggaaaggtctacatgtttagcaaggtcaccacgaacctctttgtctttgacatctcagaagatgagagtggcctgatggtttctggtgtcgagcgctgtgtgactgaactgtctgaggtcagggatagctacggacagaggtggaacatagttgagtggcatgggaaactattgctggttgtgatatacctgggacttgaaggctggcgcaatatttgtaagattggggtatttgaggtggacctgagcacaaaccctttcagattcactgagatcaacagcttagatggtgactgcattttcattagcccctgcagcagcaattcgtttcgtgcatgtttgtatgagggagttgaagatgatctcatctacttcattgatggtggcctcaaccactctagaaatgcgtctccttttgataagtttgtgtacaacatgagggatggtacattggcgccatttgctgtggaaataacagacgataatcttcgggcaccagatggcaacctgatgaatccaacatggctctttccttgtgaatga

SEQ ID NO: 11826 - protein, 462 aa, Sorghum bicolor
  misc_feature: Ceres ANNOT ID no. 6034355
  misc_feature (64)..(112): Pfam Id: F-box Pfam Desc: F-box domain
  misc_feature (66)..(462): NCBI GI: 115457754 NCBI Desc: os04g0329500 [oryza sativa (japonica cultivar-group)]
  misc_feature (66)..(462): NCBI GI: 116309490 NCBI Desc: osigba0113k06.4 [oryza sativa (indica cultivar-group)]
  misc_feature (66)..(432): NCBI GI: 115457696 NCBI Desc: os04g0317300 [oryza sativa (japonica cultivar-group)]
  misc_feature (120)..(446): NCBI GI: 115457694 NCBI Desc: os04g0316800 [oryza sativa (japonica cultivar-group)]
  misc_feature (142)..(462): NCBI GI: 38345090 NCBI Desc: osjnba0050f15.1 [oryza sativa (japonica cultivar-group)]
MDRDTSTVARGRRRGPPLPVRAPHGRWRDTPPPSVAWVQARRSTERPPATEPARPSAGREPELLSWADLPADILGLVVGRLPRVDDRARLRSVCRAWRAAARVHGRPPSPLPLLVLSDFSFSAFCADGAMADVRRIPLPSREMAAGVRCVGSFHGWLVGVQLNKGRYFGDGRCFLMNAFYQDVVRLPPPSVNTHSLDAYSKSLPIANGSGAVQCTVNGAQYVMSFCKVVLSSSPDHDGKCIVAAVSVHRSTASLALWRPGMTSWCVCQGGCISKFSDIALYQGKVYMFSKVTTNLFVFDISEDESGLMVSGVERCVTELSEVRDSYGQRWNIVEWHGKLLLVVIYLGLEGWRNICKIGVFEVDLSTNPFRFTEINSLDGDCIFISPCSSNSFRACLYEGVEDDLIYFIDGGLNHSRNASPFDKFVYNMRDGTLAPFAVEITDDNLRAPDGNLMNPTWLFPCE

SEQ ID NO: 11827 - DNA, 1431 bp, Sorghum bicolor
  misc_feature: Ceres ANNOT ID no. 6034408
  misc_feature: Encodes the peptide sequence at SEQ ID NO 11828
  misc_feature: Up-regulated in shoot tissues in response to salicylic acid treatment
  misc_feature: Up-regulated in root tissues in response to salicylic acid treatment
atgactatggacgccgctccggtggcgaacggcgccgcggccggcgctggcgggggcgcgaatcggcggggcggaaggttgtggtacgcggccgccggcgccctcctcgtggccctcctcgccgtggccgtgagctaccgcagcttcccggacatcccctcctcgtcaccaggaagctgcggctgccctgctgcgaggaagtacacggggatggtggaggactgctgctgcgactatgagacggtggacgccatcaacgaggaggtcctgcatcccatcctacaggaactcgttaagttgcccttcttcaggtacttcaaggttaaattgtggtgtgactgccctttttggcccgatgatggaatgtgcaagcttagagattgtagtgtctgtgagtgcccggagaatgagttccctgaaccattcaggaaaccttacagtggactttctccagatagtatgatgtgccaagaaggaaaaccacaggctgctgttgataaaacccttgacagcaaggttttcaaaggatgggttgaaactgacaatccgtggacatctgatgacgagactgataataatgagatgacttatgtgaatcttcaactgaatcctgaacgatacactggatatactggtgattcagcaagaaggatatgggatgccatttacaaagagaactgtccaaaatatccctctgaagaactgtgccatgagaagaaggccttgtacaagcttatttcagggttgcactcctcaatttcagtgcatattgcttatgattatcttcttgacgaatcgactaactcatggggacaaaatcttcctttgttgtatgaccgtgtcctgaagtacccagaacgtgtccagaatctgtacttcacttacctgtttgttcttcgggccgtgacaaaggctgagtacaatactgacaaccctgaagacgacttgaagacagaatctcttgtgaagcaattgctttacaattccaagttaagatctgcatgtccattgccttttgatgaagccaaactctggcaaggagaaaatggtcctgagctaaagcaagagattcagaagcaatttagaaacattagtgcaattatggactgtgttggatgcgagaagtgccgtctgtggggaaagctccaagttcttggtcttggaactgcactgaaaattcttttctccgttgatggagacagccatttgaatcagccactgcagcgaaatgaggtcattgcattgttcaatcttctgaacaggctctcagagtctgtcaaatttgtacatgaaaaaggatcatcaattgaagaagtcattaaggaacagatcccttcaacttttcaaaagggtgcttccaagcccaatcttaaactggtcggggtcctacgtccagtctcagagatgattgagtgtatgttcctcacttga

SEQ ID NO: 11828 - protein, 476 aa, Sorghum bicolor
  misc_feature: Ceres ANNOT ID no. 6034408
  misc_feature (88)..(430): Pfam Id: ERO1 Pfam Desc: Endoplasmic Reticulum Oxidoreductin 1 (ERO1)
  misc_feature (5)..(408): NCBI GI: 115455149 NCBI Desc: os03g0733800 [oryza sativa (japonica cultivar-group)]
  misc_feature (15)..(439): NCBI GI: 63003842 NCBI Desc: at2g38960 [arabidopsis thaliana]
  misc_feature (15)..(439): NCBI GI: 42571127 NCBI Desc: endoplasmic reticulum oxidoreductin 1 (ero1) family protein [arabidopsis thaliana]
  misc_feature (223)..(427): NCBI GI: 18250366 NCBI Desc: oxidoreductase ero1-l [rattus norvegicus]
  misc_feature (233)..(427): NCBI GI: 109730421 NCBI Desc: ero1-like beta (s. cerevisiae) [mus musculus]
  misc_feature: The sequence is a functional homolog of SEQ ID NO 2 in US patent 7064247
  misc_feature: Up-regulated in shoot tissues in response to salicylic acid treatment
  misc_feature: Up-regulated in root tissues in response to salicylic acid treatment
MTMDAAPVANGAAAGAGGGANRRGGRLWYAAAGALLVALLAVAVSYRSFPDIPSSSPGSCGCPAARKYTGMVEDCCCDYETVDAINEEVLHPILQELVKLPFFRYFKVKLWCDCPFWPDDGMCKLRDCSVCECPENEFPEPFRKPYSGLSPDSMMCQEGKPQAAVDKTLDSKVFKGWVETDNPWTSDDETDNNEMTYVNLQLNPERYTGYTGDSARRIWDAIYKENCPKYPSEELCHEKKALYKLISGLHSSISVHIAYDYLLDESTNSWGQNLPLLYDRVLKYPERVQNLYFTYLFVLRAVTKAEYNTDNPEDDLKTESLVKQLLYNSKLRSACPLPFDEAKLWQGENGPELKQEIQKQFRNISAIMDCVGCEKCRLWGKLQVLGLGTALKILFSVDGDSHLNQPLQRNEVIALFNLLNRLSESVKFVHEKGSSIEEVIKEQIPSTFQKGASKPNLKLVGVLRPVSEMIECMFLT

SEQ ID NO: 11829 - DNA, 798 bp, Sorghum bicolor
  misc_feature: Ceres ANNOT ID no. 6034423
  misc_feature: Encodes the peptide sequence at SEQ ID NO 11830
atggcggcggagcccgcggcggacgaccacggtccccggccacccctggcggatggcgccgtcgctgccggcgggggcgacgcctcctcggccgcggcggcggcggaggcgctgatgagcgcggcgtcggagcagctcacgctggtgtaccagggcgacgtcttcatcttcgaccccgtcccgccccaaaaggttcaggctgttcttttagtacttggagggtacgaggttccgcctggtttggtaaacatggctgttcctacggcaaatgatgagaagaatacaactgtggctgctagaagggttgcttccttaatgagattccgtgagaagagaaaggaaagatgtttcgataaaaggattagatacagtgtgcgcaaggaggtcgcccaaaagatgaaacggcgtaaaggtcaatttgctgggagatcagattttggtgatggtgccacttcttctgcagcttgtgtctgtccaactaacggcgaggatgatcatttgcgagaaacccattgccaaaattgtggcatcagctcaaggcttactccagccatgcgccggggcccagctggtccaaggtcgctctgcaacgcttgcggcttaatgtgggcaaataagggtactctaagaagtcctctgaatgcacccaaaatgactcagcagcagcttgccaatccaagtaaaatgggagatactgatgtcaaaaactcaattgttcttcctgtggagatgccaaaacaggagcagaaactggacacacgcccgcccaccgaagaagatatcaaggcagtttcatga

SEQ ID NO: 11830 - protein, 265 aa, Sorghum bicolor
  misc_feature: Ceres ANNOT ID no. 6034423
  misc_feature (101)..(145): Pfam Id: CCT Pfam Desc: CCT motif
  misc_feature (172)..(209): Pfam Id: GATA Pfam Desc: GATA zinc finger
  misc_feature (84)..(265): NCBI GI: 126506754 NCBI Desc: gata-type zinc finger protein [triticum aestivum]
  misc_feature (8)..(218): NCBI GI: 47174868 NCBI Desc: male-specific transcription factor m88b7.2 [marchantia polymorpha]
  misc_feature (18)..(233): NCBI GI: 115469738 NCBI Desc: os06g0698900 [oryza sativa (japonica cultivar-group)]
  misc_feature (35)..(255): NCBI GI: 140071757 NCBI Desc: zinc finger, gata-type; zim; cct [medicago truncatula]
  misc_feature (12)..(238): NCBI GI: 8918531 NCBI Desc: zim [arabidopsis thaliana]
  misc_feature: The sequence is a functional homolog of SEQ ID NO. 370 in the 11/188,298 US application
MAAEPAADDHGPRPPLADGAVAAGGGDASSAAAAAEALMSAASEQLTLVYQGDVFIFDPVPPQKVQAVLLVLGGYEVPPGLVNMAVPTANDEKNTTVAARRVASLMRFREKRKERCFDKRIRYSVRKEVAQKMKRRKGQFAGRSDFGDGATSSAACVCPTNGEDDHLRETHCQNCGISSRLTPAMRRGPAGPRSLCNACGLMWANKGTLRSPLNAPKMTQQQLANPSKMGDTDVKNSIVLPVEMPKQEQKLDTRPPTEEDIKAVS

SEQ ID NO: 11831 - DNA, 618 bp, Sorghum bicolor; identical to SEQ ID NO: 11251
  misc_feature: Ceres ANNOT ID no. 6034444
  misc_feature: Encodes the peptide sequence at SEQ ID NO 11832

SEQ ID NO: 11832 - protein, 205 aa, Sorghum bicolor; identical to SEQ ID NO: 11252
  misc_feature: Ceres ANNOT ID no. 6034444
  misc_feature (65)..(187): Pfam Id: CBS Pfam Desc: CBS domain pair
  misc_feature (12)..(205): NCBI GI: 47027028 NCBI Desc: cbs1 [hyacinthus orientalis]
  misc_feature (1)..(205): NCBI GI: 118162023 NCBI Desc: cbs domain-containing protein [solenostemon scutellarioides]
  misc_feature (53)..(203): NCBI GI: 84352379 NCBI Desc: cog0517: fog: cbs domain [burkholderia cenocepacia pc184]
  misc_feature (55)..(203): NCBI GI: 83650393 NCBI Desc: cbs domain protein [burkholderia thailandensis e264]
  misc_feature (55)..(203): NCBI GI: 53717172 NCBI Desc: cbs domain protein [burkholderia mallei atcc 23344]

SEQ ID NO: 11833 - DNA, 1542 bp, Sorghum bicolor
  misc_feature: Ceres ANNOT ID no. 6034458
  misc_feature: Encodes the peptide sequence at SEQ ID NO 11834
  misc_feature: Down-regulated in shoot tissues in response to salicylic acid treatment
atggccatggcgacggccctccgcaagctctccgccaacgcgctgcgccgccagccgctctcccgcatgacgccgctccactacatggcgtcccttccggcgacagaggagagatccggaatcacctggccgaagcagctgaacgcgccgctcgaagaggtcgaccccgagatttttgacattatcgagcacgagaaggcccgccaatggaaggggctggagctcatcccgtcagagaatttcacgtcggtgtcagtgatgcaggcagttggttccgtcatgaccaacaagtacagcgaggggtaccctggcgcaagatactacggtggaaatgaatttattgatatggctgaatccttgtgtcagaaacgtgctttggaggctttccgtttggacccagcgaagtggggagtgaatgtgcaacctctatccggttcgcctgccaatttccaagtatacactgcgctcttgaagccacatgaaaggataatggctttggatcttcctcacggtggacatctttctcatggttaccagactgacactaagaagatatctgcaacctcgatattctttgagacaatgccttacagattggatgaaagcactggattgattgattatgatcagttggagaaaagcgctattcttttcaggccaaagttgatagttgctggtgctagtgcatatgctcggctatacgattatgaccgtatgcggaagatatgcaacaagcagaaggcagtacttctagcagacatggcacatatcagtgggcttgttgcagctggtgttattccatctccttttgattatgcagatgtagtgactaccactactcacaaatcactccgtgggccacgtggagccatgatcttttataggaaggggttgaaagaaataaataagcaagggaaagaggttatgtatgattttgaggacaagatcaatgctgccgtctttcctggtctgcaaggtgggcctcataatcataccattactggcttggctgttgcgcttaaacaggcaactactccagagtacagagcttaccaagagcaagttatcactaactgtgctaaatttgcgcagagcctgactgcaaaaggatatgaactcgtctccggtgggactgacaaccatttagttctggtgaatctcaagaataaggggatagatggttcgagggtggagaaggttttagaaagcgtgcatattgcagcaaacaagaacacagttcctggtgatgtttcggctatggtaccaggaggcatcaggatgggaaccccagctcttacgtccagaggatttgttgaggaagatttcgctaaggttgctgacttcttcgatgcagcagtgaatctggctgtgaagattaaggctgcaacgacaggtggaacaaagctgaaggactttgttgctactttgcaatctgatagcatccaagctgagattgcaaagcttcgccatgatgtggaggaatatgcaaaacagttcccaacaattggatttgagaaggagaccatgaaatacaagaactga

SEQ ID NO: 11834 - protein, 513 aa, Sorghum bicolor
  misc_feature: Ceres ANNOT ID no. 6034458
  misc_feature (51)..(449): Pfam Id: SHMT Pfam Desc: Serine hydroxymethyltransferase
  misc_feature (1)..(513): NCBI GI: 438247 NCBI Desc: glycine hydroxymethyltransferase [solanum tuberosum]
  misc_feature (1)..(513): NCBI GI: 30102486 NCBI Desc: at4g37930/f20d10_50 [arabidopsis thaliana]
  misc_feature (1)..(513): NCBI GI: 15809972 NCBI Desc: at4g37930/f20d10_50 [arabidopsis thaliana]
  misc_feature (1)..(511): NCBI GI: 92876895 NCBI Desc: glycine hydroxymethyltransferase [medicago truncatula]
  misc_feature (1)..(513): NCBI GI: 437995 NCBI Desc: glycine hydroxymethyltransferase [flaveria pringlei]
  misc_feature (1)..(513): SWISSPROT Homolog: EC 2.1.2.1 Serine hydroxymethyltransferase, mitochondrial precursor
  misc_feature: Useful for making plants with modulated nitrogen use efficiency
  misc_feature: Functional homolog of the protein sequence given in SEQ ID NO 13702
  misc_feature: Down-regulated in shoot tissues in response to salicylic acid treatment
MAMATALRKLSANALRRQPLSRMTPLHYMASLPATEERSGITWPKQLNAPLEEVDPEIFDIIEHEKARQWKGLELIPSENFTSVSVMQAVGSVMTNKYSEGYPGARYYGGNEFIDMAESLCQKRALEAFRLDPAKWGVNVQPLSGSPANFQVYTALLKPHERIMALDLPHGGHLSHGYQTDTKKISATSIFFETMPYRLDESTGLIDYDQLEKSAILFRPKLIVAGASAYARLYDYDRMRKICNKQKAVLLADMAHISGLVAAGVIPSPFDYADVVTTTTHKSLRGPRGAMIFYRKGLKEINKQGKEVMYDFEDKINAAVFPGLQGGPHNHTITGLAVALKQATTPEYRAYQEQVITNCAKFAQSLTAKGYELVSGGTDNHLVLVNLKNKGIDGSRVEKVLESVHIAANKNTVPGDVSAMVPGGIRMGTPALTSRGFVEEDFAKVADFFDAAVNLAVKIKAATTGGTKLKDFVATLQSDSIQAEIAKLRHDVEEYAKQFPTIGFEKETMKYKN

SEQ ID NO: 11835 - DNA, 414 bp, Sorghum bicolor
  misc_feature: Ceres ANNOT ID no. 6034472
  misc_feature: Encodes the peptide sequence at SEQ ID NO 11836
atggcggcagactctggcgctcgcaggcagccaaccttcaccaaggtcgatcagctgcgccctggaacccacggccacaacctcatcgtcaaggttgttgactccaagatggtcgtccagagaggccgcgacggagggccccagggaaggcagatgaggattgccgagtgcttggttggcgatgaaaccggcatcattgtcttcactgcaagaaacgatcaagtggatgtaatgaagcctggaacaactgttgaactgaggaatgcaaagattgacatgttcaagggttcaatgcggcttgcagtggacaagtggggaattgtgaaagctgctgaaagctcagctgagttcacagtcaaggaggacaacaacctgtccttaattgagtttgagctggtgaccgtggtggagtga

SEQ ID NO: 11836 - protein, 137 aa, Sorghum bicolor
  misc_feature: Ceres ANNOT ID no. 6034472
  misc_feature (1)..(135): NCBI GI: 5091555 NCBI Desc: t10o24.24 [arabidopsis thaliana]
  misc_feature (1)..(74): NCBI GI: 6573753 NCBI Desc: f20b24.1 [arabidopsis thaliana]
  misc_feature (2)..(135): NCBI GI: 57900332 NCBI Desc: dna-binding protein-related-like [oryza sativa (japonica cultivar-group)]
  misc_feature (22)..(137): NCBI GI: 115465884 NCBI Desc: os06g0103400 [oryza sativa (japonica cultivar-group)]
  misc_feature (14)..(131): NCBI GI: 48477745 NCBI Desc: replication factor a, large subunit [picrophilus torridus dsm 9790]
  misc_feature: Useful for making plants with modulated drought sensitivity
  misc_feature: Functional homolog of the protein sequence given in SEQ ID NO 13526
  misc_feature: Useful for making plants with modulated drought sensitivity
  misc_feature: Useful for making plants with modulated water use efficiency
  misc_feature: Functional homolog of the protein sequence given in SEQ ID NO 13526
MAADSGARRQPTFTKVDQLRPGTHGHNLIVKVVDSKMVVQRGRDGGPQGRQMRIAECLVGDETGIIVFTARNDQVDVMKPGTTVELRNAKIDMFKGSMRLAVDKWGIVKAAESSAEFTVKEDNNLSLIEFELVTVVE

SEQ ID NO: 11837 - DNA, 1197 bp, Sorghum bicolor
  misc_feature: Ceres ANNOT ID no. 6034570
  misc_feature: Encodes the peptide sequence at SEQ ID NO 11838
  misc_feature: Up-regulated in root tissues in response to methyl jasmonate treatment
  misc_feature: Up-regulated in shoot tissues in response to methyl jasmonate treatment
atggcgtccccggggttggtggccgcggcgctgctggtggcggcgctggcggcgttctgcggcacggacccgctgcggatgggcagcatggtggacttcccggggttcgaggcgcacttcgtccacctacccgatcccgccgagatgccgccgcacgcggacgaacgggagcggctccgtggggccgaggtgcggttccgcggcgaggtgcagggccccgagagcgtcgccttcgacccgcagggccgcgggccgtacacgggcgtcgccgacggccgggtcgtcttctgggacggcgagaggtgggtccccttcgcgacggcctccccgcgttggacgcaggagctctgcggcgggcccaaggcctcgccgctggagtacctccccaatgagcacatctgcggccgtccgctcgggctccgtttcgataagaagaccggggacctgtacatcgccgacgcctacttcggcctgctcaaggtcggccccgagggcgggctggccacgccgctcgcaacggaggccgagggcgtgcgcctcaacttcaccaacgacctcgacctcgacgacgagggcaacgtctacttcaccgactccagcatccactaccagagacggaatttcatgcagttagttttctctggggatccctctgggagacttctgaaatataacccacagacaaaggaaacgactgtactgcatcgcaacctccaatttcccaatggtgtgtccatgagcaaggatggctcattcttcgttttctgtgaaggatcacgaggcaggttgagcaggtactggttgaaaggtgagaaggcaggcactgtggatcttttcgctatcttgcctggattcccagacaatgtgaggacgaatgagaagggcgagttttgggtggcgatccactgcaggcgaagcctgtatgcgcggctcatgagccgctatgtcaagatgaggaagttttttctcagcctcccgatcccggccaagtaccactacctgatgcagatcggtggcaagctgcacgcggtgatcataaagtacagccccgagggccaggtgcttgacatcttggaggacaccaagggagaggtggtgagagctgtcagcgaagtggaggagaaggacggcaagctctggatagggtccgtcctgatgccgttcatcgctgtctttgacctggcgaaggcgtcttag

SEQ ID NO: 11838 - protein, 398 aa, Sorghum bicolor
  misc_feature: Ceres ANNOT ID no. 6034570
  misc_feature (184)..(271): Pfam Id: Str_synth Pfam Desc: Strictosidine synthase
  misc_feature (65)..(347): Pfam Id: SGL Pfam Desc: SMP-30/Gluconolaconase/LRE-like region
  misc_feature (1)..(398): NCBI GI: 115455371 NCBI Desc: os03g0750700 [oryza sativa (japonica cultivar-group)]
  misc_feature (10)..(394): NCBI GI: 140040327 NCBI Desc: strictosidine synthase [medicago truncatula]
  misc_feature (6)..(263): NCBI GI: 6664319 NCBI Desc: t27g7.16 [arabidopsis thaliana]
  misc_feature (115)..(394): NCBI GI: 124359771 NCBI Desc: strictosidine synthase [medicago truncatula]
  misc_feature (50)..(394): NCBI GI: 30694556 NCBI Desc: strictosidine synthase family protein [arabidopsis thaliana]
  misc_feature: Useful for making plants with modulated nitrogen use efficiency
  misc_feature: Functional homolog of the protein sequence given in SEQ ID NO 13193
  misc_feature: Up-regulated in root tissues in response to methyl jasmonate treatment
  misc_feature: Up-regulated in shoot tissues in response to methyl jasmonate treatment
MASPGLVAAALLVAALAAFCGTDPLRMGSMVDFPGFEAHFVHLPDPAEMPPHADERERLRGAEVRFRGEVQGPESVAFDPQGRGPYTGVADGRVVFWDGERWVPFATASPRWTQELCGGPKASPLEYLPNEHICGRPLGLRFDKKTGDLYIADAYFGLLKVGPEGGLATPLATEAEGVRLNFTNDLDLDDEGNVYFTDSSIHYQRRNFMQLVFSGDPSGRLLKYNPQTKETTVLHRNLQFPNGVSMSKDGSFFVFCEGSRGRLSRYWLKGEKAGTVDLFAILPGFPDNVRTNEKGEFWVAIHCRRSLYARLMSRYVKMRKFFLSLPIPAKYHYLMQIGGKLHAVIIKYSPEGQVLDILEDTKGEVVRAVSEVEEKDGKLWIGSVLMPFIAVFDLAKAS

SEQ ID NO: 11839 - DNA, 1695 bp, Sorghum bicolor
  misc_feature: Ceres ANNOT ID no. 6034596
  misc_feature: Encodes the peptide sequence at SEQ ID NO 11840
atgtcgtgggggcggttcagattcacccctcacagcgggctcagccggacgcggtggacgcgggtcttccccgcgcagaagtccgcgccttgcaccgtggtgcttagcgatgaggacgatgatggtgacgatacctccgactcggatgttctcataatcgacgacgcagctgcgggagaatcagcttctgcggcgggacgtggatctcaagccaggaaagggaaccactcctccagtaacgtgatcaacatagatgatgatgaagacgaggaagatggtaccagaggggataaagcaggtcccagcatgtcccgtgcttctgggtctccagcagctatgacaccgggtcggggttctccacggaacagatatgggattgggatgaatgggatggattccatgtccgacagctctgagagcgatcttactgaaggatgggactcttacactgatgatggcagctctgattgtgagattctcgatgacacttacactgatgatggcagctctgattgtgagattctcgatgacactggtacagcacgtaagatgtgggagacagctgcttccagaaaaaagccagctaacggtgtccatgagtgtaaggatgctgggactactgcatttgaatcacgtgctgggttggagacacaaccaggtaaaaactctgagcatctctttggtgccgaatgccatccagacgagagtatgtctcggttttgcagcgctgcaagcaagtatgactctcaaaatagtagtagcggaacaaaggaatgccctgggcgtgctcaaagtagtgctggcaatgcaaatggttccaatggcccttctgtgccaaatgccgaagatgtgccaaatgataccagcaggtcaaaggatggccatgaccaatcttcagtgccaaatgtcgagaaatgttcaatggttggttctgaaaaagcttcagaaggtgttcaatcgcctcggctggatgaaaactctgcgtgtaactttgcctctgcaaataggtttttttctgggatctcatcaacgagcaggaaagatggaagtcctccaatttctgtcagcactcctgaaaaggttgatgagaaaatacctgatcagtcgccacctgaagcttcctttaacacaaatatttattctgctcaagataatggtcctgtcaggggtaaggatttgcttcaagatcccgaggacttggggctatttgcttcattgattggtgaacgtgaaaaacacaaagaatctgttgagtacaagcgggcagcagaggaggagtgggcatcgagacagcggcaattacaaatacaggctgaggaagcaaagaaattgcgaaagagaaagaaagctgaagctcaacgattgcttgacatggagaagagacaaaagcaaagactgcaagaagtccgtgaatcacagagaaagaatgaagaagctatacagcttaaggagcagtatcggggtgtagtcagaaaggaactggaagatttggaaaggagacattgggatatgacttcaatattgcatgcgctaggcatctctgttgaaggtggtgaggttaaagccttcaagcaagctcttctgaaattccatcccgacagggtatcaagaaatgatatttatcaacaagtaaaagcagaggagacatttaagttcatttcgcggctgaaggagaagctacctcggctatcctaa

SEQ ID NO: 11840 - protein, 564 aa, Sorghum bicolor
  misc_feature: Ceres ANNOT ID no. 6034596
  misc_feature (410)..(559): NCBI GI: 6730632 NCBI Desc: f4n2.3 [arabidopsis thaliana]
  misc_feature (36)..(385): NCBI GI: 4322670 NCBI Desc: dentin phosphoryn [homo sapiens]
  misc_feature (36)..(378): NCBI GI: 89001107 NCBI Desc: dentin sialophosphoprotein preproprotein [homo sapiens]
  misc_feature (38)..(385): NCBI GI: 19923672 NCBI Desc: dentin sialophosphoprotein [rattus norvegicus]
  misc_feature (36)..(399): NCBI GI: 17865470 NCBI Desc: dentin sialophosphoprotein precursor [contains: dentin phosphoprotein (dentin phosphophoryn) (dpp); dentin sialoprotein (dsp)]
MSWGRFRFTPHSGLSRTRWTRVFPAQKSAPCTVVLSDEDDDGDDTSDSDVLIIDDAAAGESASAAGRGSQARKGNHSSSNVINIDDDEDEEDGTRGDKAGPSMSRASGSPAAMTPGRGSPRNRYGIGMNGMDSMSDSSESDLTEGWDSYTDDGSSDCEILDDTYTDDGSSDCEILDDTGTARKMWETAASRKKPANGVHECKDAGTTAFESRAGLETQPGKNSEHLFGAECHPDESMSRFCSAASKYDSQNSSSGTKECPGRAQSSAGNANGSNGPSVPNAEDVPNDTSRSKDGHDQSSVPNVEKCSMVGSEKASEGVQSPRLDENSACNFASANRFFSGISSTSRKDGSPPISVSTPEKVDEKIPDQSPPEASFNTNIYSAQDNGPVRGKDLLQDPEDLGLFASLIGEREKHKESVEYKRAAEEEWASRQRQLQIQAEEAKKLRKRKKAEAQRLLDMEKRQKQRLQEVRESQRKNEEAIQLKEQYRGVVRKELEDLERRHWDMTSILHALGISVEGGEVKAFKQALLKFHPDRVSRNDIYQQVKAEETFKFISRLKEKLPRLS

SEQ ID NO: 11841 - DNA, 1920 bp, Sorghum bicolor
  misc_feature: Ceres ANNOT ID no. 6034611
  misc_feature: Encodes the peptide sequence at SEQ ID NO 11842
atggacccgccgccggcgaggcgggcggcgtccaagcggcgggaccgccgacggcgcctgcggcagcggcaggctgcagccacggcaacggatgccggtgcggtcgtgctggccgtggagccgcagagcgcagcggtcacagccccggtgactccggccggtgctgcttcgacgccggcggcgacggcgaggggcaggaaccggagaaggcctcggagacggcgtcatcggagcgccggaccggcagcggcggcggacgaagcaccggctgcgtcccccgttgtagatgccatttcaattcaagaagatcctgccccacaagcaagttgcgctttggaagcaacggcagcacatctgagcgatattgtgctgcaaactacgactgagaagataatgagctcagataaaacaagaaagagaaattttcaggctggaagtaaggcgctaaaagattctgcggctgatggtgctgcttgctcttctcttgcccgccctgaacattctatcagagaaaatgaagcctcaaggagcaagatatttaagagatcagatgtaagattcccgattgatagttgcactgcacaaggaactgatatggattatcacaagatgaagagtgctgatttgccagggaacctggaaaaagtataccagaaaagaacatgtcctggccacctctctttgcagaagtcggaagaatatagggaaaatgaaaatgtaccttctctcaactccagcagcttacaggagggaaaaaagagaaggaaaaaaagaggcgggaaaaggcataatcgtcgcaaaaaagctactttacaggattctccagcaccaactgctgctgataattctggtttgatgaagttcctttctgagaactgtacttcaggtcttaaaccagaggaacagaggaagaagcaagatcagaacaaggcacccatgactaacttagtcaacaatgcaaagatgtcagaacaatatggtgtgaatttggaaggcgctattgaaaagagctatgaattgggaatgaacagtttggacagcacctttgaaaataggtatgagctggtaaagagtaatttggactgcacaaatatggtgagaaatggattgcaattgcaagatcaggacctagcatgttcgtcaaacagtcgcaatgttaactacctgagcccttcccatttggctgtggaatatatggaaaagctcaaacttgtcttttcaccgggaaagtccttggagtttccgaagaaaaagcttctcatcttagatcttaatggtttacttgcagatatcaacgaagactaccacaatgctcacatggctgatgccaaggttcgaggaaaattagtcttccgaaggccttactgtgatgattttctcaacttttgtgccctgaattttgagctaggcatatggtcctcaagaaaaaaagaaaatgttgattcggttgttaatattgttatgaacgaattcaaaccgcgcctactgttttgttgggacttgtctaaatgcacattcactggacacaaaacactggagaataagcacaaaccattagtgctgaaggaattgagaaaactatggaacatggaagaaccagatcttccatgggaagagggggactattcaccttcaaatacattactagtggatgattctccttacaaagctctgcgcaatcctccatatacagcaatttttcctcgctcctacagttacttgaactggaatgacaattcactgggtcccggtggagaccttcgtgtgtatctgcagaacttagctgctgcagatgatgttgagcgttttgttcgtaataatccatttggtcaacccttcattactaagagcgatccgcattggaacttctatgctcagattgctgatagagagtgtgcacccttgacatgttgtgcttga

SEQ ID NO: 11842 - protein, 639 aa, Sorghum bicolor
  misc_feature: Ceres ANNOT ID no. 6034611
  misc_feature (381)..(628): NCBI GI: 20473411 NCBI Desc: 36i5.7 [oryza sativa (japonica cultivar-group)]
  misc_feature (321)..(566): NCBI GI: 30689737 NCBI Desc: nli interacting factor (nif) family protein [arabidopsis thaliana]
  misc_feature (416)..(575): NCBI GI: 92870571 NCBI Desc: aldo/keto reductase; nli interacting factor [medicago truncatula]
  misc_feature (417)..(601): NCBI GI: 124002214 NCBI Desc: development protein [microscilla marina atcc 23134]
  misc_feature (417)..(602): NCBI GI: 114799234 NCBI Desc: phosphoprotein phosphatase [hyphomonas neptunium atcc 15444]
MDPPPARRAASKRRDRRRRLRQRQAAATATDAGAVVLAVEPQSAAVTAPVTPAGAASTPAATARGRNRRRPRRRRHRSAGPAAAADEAPAASPVVDAISIQEDPAPQASCALEATAAHLSDIVLQTTTEKIMSSDKTRKRNFQAGSKALKDSAADGAACSSLARPEHSIRENEASRSKIFKRSDVRFPIDSCTAQGTDMDYHKMKSADLPGNLEKVYQKRTCPGHLSLQKSEEYRENENVPSLNSSSLQEGKKRRKKRGGKRHNRRKKATLQDSPAPTAADNSGLMKFLSENCTSGLKPEEQRKKQDQNKAPMTNLVNNAKMSEQYGVNLEGAIEKSYELGMNSLDSTFENRYELVKSNLDCTNMVRNGLQLQDQDLACSSNSRNVNYLSPSHLAVEYMEKLKLVFSPGKSLEFPKKKLLILDLNGLLADINEDYHNAHMADAKVRGKLVFRRPYCDDFLNFCALNFELGIWSSRKKENVDSVVNIVMNEFKPRLLFCWDLSKCTFTGHKTLENKHKPLVLKELRKLWNMEEPDLPWEEGDYSPSNTLLVDDSPYKALRNPPYTAIFPRSYSYLNWNDNSLGPGGDLRVYLQNLAAADDVERFVRNNPFGQPFITKSDPHWNFYAQIADRECAPLTCCA

SEQ ID NO: 11843 - DNA, 975 bp, Sorghum bicolor
  misc_feature: Ceres ANNOT ID no. 6034653
  misc_feature: Encodes the peptide sequence at SEQ ID NO 11844
atggtgaaggaagaggagatcatggcggaggcaggaggaggacgcggcggctacatggacctgcttggtctcggagaagacgactacctgctgtgcctgtccccttcctcctacttcgcttccagcgtcgtctctgccacgaccaccagcgccaccaccactgctgccgcgtcgtcgcctacctgcgcctcctacctggacatggctcctgcctaccaccacatgctgagcttcgctggccaagatcagcagtaccatggcgacggcgtcctcggcttccagtactacggcgccggcgatcatgcgattccggcggctgtcccgcagaagtccagcccgaccaccgagtgctcctccatctcctccatgtcgtcctcgccgcctgcgacggccatctccgccgtctcctgctcaaagccacaggctttcaagaagaagggatcaaggagcagtgagcaaagaaaggctgcgtctgccgccgccgccgcccccgctgctccggctgctgctggtggtggtgctacgaacaagaggcccagggtaaggagggagaggctcggggagaggatcatagctctgcagcagctggtttctccgttcggaaagtctgatacggcttccgttctgcacgaggcgctgggatacatacgcttcctgcacgaccaagttcaggtcctgagctcgccgtacatgcagcgccagccggcctcagcagcgcacgtcccggagagcgcggcggggacggtggtggagccgccgcggccgaaggacctgaggagccggggcctgtgcctggtgcccgtctcctgcacggagcacctcgccggcaacagccacggcggcaacggcgccgacctctggtccgtggcggcggggatggcgaaggcggccgcggacaagggccctgccggcggaatgctgctgcctggtggtggtggtggtggtggttaccctcgtcaagggcacctggcctag

SEQ ID NO: 11844 - protein, 324 aa, Sorghum bicolor
  misc_feature: Ceres ANNOT ID no. 6034653
  misc_feature (96)..(288): NCBI GI: 50510046 NCBI Desc: bhlh transcription factor-like protein [oryza sativa (japonica cultivar-group)]
  misc_feature (96)..(288): NCBI GI: 115472023 NCBI Desc: os07g0471900 [oryza sativa (japonica cultivar-group)]
  misc_feature (37)..(278): NCBI GI: 53792455 NCBI Desc: bhlh transcription factor-like protein [oryza sativa (japonica cultivar-group)]
  misc_feature (119)..(292): NCBI GI: 15217667 NCBI Desc: ethylene-responsive protein -related [arabidopsis thaliana]
  misc_feature (180)..(290): NCBI GI: 42562634 NCBI Desc: ethylene-responsive protein -related [arabidopsis thaliana]
  misc_feature: The sequence is a functional homolog of SEQ ID NO 1939 in the 10/374,780US patent application
  misc_feature: Useful for making plants with altered Lignin content
  misc_feature: Useful for making plants with modulated growth and phenotype characteristics
  misc_feature: GREAT-hit functional homolog of the protein sequence given in SEQ ID NO 12890
  misc_feature: The sequence is a functional homolog of SEQ ID NO 1939 in the 20060162006 US patent application
MVKEEEIMAEAGGGRGGYMDLLGLGEDDYLLCLSPSSYFASSVVSATTTSATTTAAASSPTCASYLDMAPAYHHMLSFAGQDQQYHGDGVLGFQYYGAGDHAIPAAVPQKSSPTTECSSISSMSSSPPATAISAVSCSKPQAFKKKGSRSSEQRKAASAAAAAPAAPAAAGGGATNKRPRVRRERLGERIIALQQLVSPFGKSDTASVLHEALGYIRFLHDQVQVLSSPYMQRQPASAAHVPESAAGTVVEPPRPKDLRSRGLCLVPVSCTEHLAGNSHGGNGADLWSVAAGMAKAAADKGPAGGMLLPGGGGGGGYPRQGHLA

SEQ ID NO: 11845 - DNA, 270 bp, Sorghum bicolor
  misc_feature: Ceres ANNOT ID no. 6034792
  misc_feature: Encodes the peptide sequence at SEQ ID NO 11846
atgaagcacatattcaagattgctgcaatactggtagcaatctcagctatctggattgctctccttgaaacctcaactgttcctcgaagttatacttggctgcttcccatctacttggtagtggctcttggatgctacggcctttttatggttggatttggacttatgttcttcccaacttgtcctcaagaagctgtactactgcaacaggatattgtggaggcaaaggaattcttagcaaagaagggtgttgatgtgggctctgagtga

SEQ ID NO: 11846 - protein, 89 aa, Sorghum bicolor
  misc_feature: Ceres ANNOT ID no. 6034792
  misc_feature (1)..(86): Pfam Id: DPM3 Pfam Desc: Dolichol-phosphate mannosyltransferase subunit 3 (DPM3)
  misc_feature (1)..(61): NCBI GI: 8778529 NCBI Desc: f21d18.14 [arabidopsis thaliana]
  misc_feature (11)..(84): NCBI GI: 8100054 NCBI Desc: dolichol-phosphate-mannose synthase [homo sapiens]
  misc_feature (11)..(84): NCBI GI: 24430135 NCBI Desc: dolichyl-phosphate mannosyltransferase polypeptide 3 isoform 2 [homo sapiens]
  misc_feature (11)..(84): NCBI GI: 34783282 NCBI Desc: dpm3 protein [homo sapiens]
  misc_feature (11)..(84): NCBI GI: 40850894 NCBI Desc: dpm3 protein [homo sapiens]
MKHIFKIAAILVAISAIWIALLETSTVPRSYTWLLPIYLVVALGCYGLFMVGFGLMFFPTCPQEAVLLQQDIVEAKEFLAKKGVDVGSE

SEQ ID NO: 11847 - DNA, 282 bp, Sorghum bicolor
  misc_feature: Ceres ANNOT ID no. 6034830
  misc_feature: Encodes the peptide sequence at SEQ ID NO 11848
atggggaagagtgtgtcagtgcagcgagggcacatcccggtgctcgtcggtgagggggaggaggggctgaagagggttctggtgcacaggaaggttcttcagcacccctacttcaccgggctgctggagctcgcggccatggagtttgggcatgatcagaagggcgtgctcaggatcccctgtgacatcagatgcttccacacgattgttcagctcattagaagcagaaagcggaggaagaaggtgacgatctcatgcctccttttcctcaagctgatgtag

SEQ ID NO: 11848 - protein, 93 aa, Sorghum bicolor
  misc_feature: Ceres ANNOT ID no. 6034830
  misc_feature (1)..(74): Pfam Id: Auxin_inducible Pfam Desc: Auxin responsive protein
  misc_feature (6)..(75): NCBI GI: 3152585 NCBI Desc: contains similarity to auxin-induced protein tm018a10.6 from a. thaliana bac gbaf013294. [arabidopsis thaliana]
  misc_feature (1)..(70): NCBI GI: 52077231 NCBI Desc: auxin responsive protein-like [oryza sativa (japonica cultivar-group)]
  misc_feature (7)..(70): NCBI GI: 49387755 NCBI Desc: auxin responsive protein-like [oryza sativa (japonica cultivar-group)]
  misc_feature (2)..(78): NCBI GI: 115444177 NCBI Desc: os02g0143300 [oryza sativa (japonica cultivar-group)]
  misc_feature (2)..(80): NCBI GI: 45736190 NCBI Desc: auxin-induced protein-like [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
MGKSVSVQRGHIPVLVGEGEEGLKRVLVHRKVLQHPYFTGLLELAAMEFGHDQKGVLRIPCDIRCFHTIVQLIRSRKRRKKVTISCLLFLKLM

SEQ ID NO: 11849 - DNA, 744 bp, Sorghum bicolor
  misc_feature: Ceres ANNOT ID no. 6034847
  misc_feature: Encodes the peptide sequence at SEQ ID NO 11850
atgtcggaacgttctgagagtgcaactgaaaagattatgagcagcatcatggataccattgctgacaaccttcctaagcagaagtctgggcactttgacccaggttcagtctctgacaaagtgaagaacaagctgtttggtcgtcagaagaccttacatggagttctgggtggtggaaaacctgctgatgtgctgttatggaggaacaagaagatatcatcgagtgttctggctcttgcaacagctatttgggttttctttgagtggcttgactaccactttctgacaattgtttcgtttgcccttgttcttggaatggttgtccagtttatctggtccaacttctcaaacatgctaagcggatctccttctcaggtgccccgagttgaattgcctgaagagttatttgtgaacattgccattgcaatcggtgcccaagtaaacaagttcatgtgcttccttcaggatgtgtcttgtgaaagaaacttgaagcattttgtagtggcgattgccggactgtgggccgctgcagtgattggaagttggtgcaatttcctgacagtcatatatattgggtttgtttgtgttcacacacttcctgtgctctatgagaagtatgaagaccaagtcgatgatttcctctacaaccttcttggtctgctgcgagatcagtatcagaagcttgaccaaggcgtcttgagcaagattccgaaggggaacatgaaggctaagaagaacgagtag

SEQ ID NO: 11850 - protein, 247 aa, Sorghum bicolor
  misc_feature: Ceres ANNOT ID no. 6034847
  misc_feature (61)..(244): Pfam Id: Reticulon Pfam Desc: Reticulon
  misc_feature (6)..(247): NCBI GI: 30681227 NCBI Desc: reticulon family protein [arabidopsis thaliana]
  misc_feature (6)..(246): NCBI GI: 20160502 NCBI Desc: osjnbb0021a09.5 [oryza sativa (japonica cultivar-group)]
  misc_feature (4)..(244): NCBI GI: 56381963 NCBI Desc: at3g61560 [arabidopsis thaliana]
  misc_feature (51)..(245): NCBI GI: 78714222 NCBI Desc: reticulon [hordeum vulgare]
  misc_feature (10)..(242): NCBI GI: 92874883 NCBI Desc: reticulon [medicago truncatula]
MSERSESATEKIMSSIMDTIADNLPKQKSGHFDPGSVSDKVKNKLFGRQKTLHGVLGGGKPADVLLWRNKKISSSVLALATAIWVFFEWLDYHFLTIVSFALVLGMVVQFIWSNFSNMLSGSPSQVPRVELPEELFVNIAIAIGAQVNKFMCFLQDVSCERNLKHFVVAIAGLWAAAVIGSWCNFLTVIYIGFVCVHTLPVLYEKYEDQVDDFLYNLLGLLRDQYQKLDQGVLSKIPKGNMKAKKNE

SEQ ID NO: 11851 - DNA, 1308 bp, Sorghum bicolor
  misc_feature: Ceres ANNOT ID no. 6034868
  misc_feature: Encodes the peptide sequence at SEQ ID NO 11852
atgaaatcatatagactatccgagctcagcgacactgaggttagcggcctcaaggctcgtccccgcatcgatttctcgtccatatttggcacggtgaatccaatcgttgaggatgtccgtgtcagaggagatgcagcagttaagcactacacagaaaagtttgacaaggtcacgctcgatgatgttgttgttcgtgttagcgatcttccagatgcagagcttgatccagctgtgagggaagccttcgatgttgcatatgacaatatatatgccttccatgtttcacaaaaattacccgagaagacagttgaaaatatgaaaggggtaagatgtaagagaataacaaggtgcattggttctgtcgggctgtatgtcccaggtggcactgcggtcttgccttcgactgcattgatgcttgctgtgcctgcacagattgctggatgcaaaactattgtccttgccacaccacctagccgtgatggtagcatatgcaaggaggtgctatactgtgcaaagaaagctggtgtgacacacatattgaaagctggaggagctcaggcaatctcagcaatggcatggggaactgcatcgtgcccaaaggttgagaagatttttgggcctggtaaccagtatgtaacagctgccaaaatgattcttcagaacagtgaagctatggtatctatagacatgcctgctggcccttctgaagttttagtcattgctgataaatacgcgaacccagttcatgttgctgctgatctgctatctcaggcagaacatggtccagatagtcaggttgttctagttattgctggagatggtgttaatttgggtgccattgaggcagaggttagcaagcagtgcaacgcgcttccaagaggtgaatttgcttcaaaagcacttagccacagcttcactgtgtttgccaaagatatggttgaggcgatatcattctcaaatctgtatgcccctgaacatttgatcatcaatgtaaaggatgctgagcagtgggaggagctcgttgagaatgcagggtcagttttcttgggccaatggaccccagagagcgtgggcgattatgcaagcggaacaaaccatgtccttccaacctatggttacgcaaggatgtacagtggtgtatcactgaactctttcctcaaatacattactgtccaatccctaacagaggaaggactgagaaagctgggtccatacgtcgcgaagatggccgaagtggaagggctagaagcgcacaagagagccgttacccttaggctgcaagaggttgaggcctctgtaaccgtatag

SEQ ID NO: 11852 - protein, 435 aa, Sorghum bicolor
  misc_feature: Ceres ANNOT ID no. 6034868
  misc_feature (14)..(427): Pfam Id: Histidinol_dh Pfam Desc: Histidinol dehydrogenase
  misc_feature (1)..(435): NCBI GI: 75321234 NCBI Desc: histidinol dehydrogenase, chloroplast precursor (hdh)
  misc_feature (1)..(434): NCBI GI: 167142 NCBI Desc: histidinol dehydrogenase
  misc_feature (1)..(434): NCBI GI: 123178 NCBI Desc: histidinol dehydrogenase, chloroplast precursor (hdh)
  misc_feature (1)..(431): NCBI GI: 10177677 NCBI Desc: histidinol dehydrogenase [arabidopsis thaliana]
  misc_feature (1)..(431): NCBI GI: 21593566 NCBI Desc: histidinol dehydrogenase [arabidopsis thaliana]
  misc_feature (1)..(435): SWISSPROT Homolog: EC 1.1.1.23 Histidinol dehydrogenase, chloroplast precursor
MKSYRLSELSDTEVSGLKARPRIDFSSIFGTVNPIVEDVRVRGDAAVKHYTEKFDKVTLDDVVVRVSDLPDAELDPAVREAFDVAYDNIYAFHVSQKLPEKTVENMKGVRCKRITRCIGSVGLYVPGGTAVLPSTALMLAVPAQIAGCKTIVLATPPSRDGSICKEVLYCAKKAGVTHILKAGGAQAISAMAWGTASCPKVEKIFGPGNQYVTAAKMILQNSEAMVSIDMPAGPSEVLVIADKYANPVHVAADLLSQAEHGPDSQVVLVIAGDGVNLGAIEAEVSKQCNALPRGEFASKALSHSFTVFAKDMVEAISFSNLYAPEHLIINVKDAEQWEELVENAGSVFLGQWTPESVGDYASGTNHVLPTYGYARMYSGVSLNSFLKYITVQSLTEEGLRKLGPYVAKMAEVEGLEAHKRAVTLRLQEVEASVTV

SEQ ID NO: 11853 - DNA, 975 bp, Sorghum bicolor
  misc_feature: Ceres ANNOT ID no. 6034875
  misc_feature: Encodes the peptide sequence at SEQ ID NO 11854
atgccgctctgcagcttctacgcctccacgtccgtccccgtcgtcaagccccagcagtccgtcgcctcctccaagcccccctccacggcggcggcctctgtgactacaactgtgccgatgcgcagtgcgacgacggcgacggtaacgacggccgtgcccacagcgagccaaacgctgtcgctgcacctgccggagctgccgtcgcaggtgaaggacaagatcctgagcctagagctgatgggcgtggactacaggcgcgcgctggagctgaacccggcgctccgcgacgcggcgccggagtccatccacgcggtggtgtcgttcctccagtcccgcgggctccagttcaaggacctgggccgcgtcttcggcatgtgcccgtccgtgctcaccgccagcgtccgcgccgacctccgccccgtcttcgccttcctctccgaggacctgtgcatcccggagtcggcgcaccggcgcgtggtgatcaagtgcccgcgcgtgctggcctgcagcgtccgcgaccagctccgcccggcgctcatctacctccgccgcctggggttccgtgacagccgcgcgctggcgctgcaggacccgatcctcctcgtctccagcgtggagcgcaccctggcgccgaagctggagtacctggccgggctgggcatgtcgcgggacgacgccgtcgccatggtgctgcggtgcccggcgctcttcaccttcagcatcgagcggaacttcaggcccaagttcgagtacctggtggacgccatgggcggcggcgtcgaggacgtcaaggccttcccgcagtacttcgccttcagcctcgagaagcggatcgcgccccgccaccgcgccgcggaggacgccggcgtcgcgctgccgctgccggacatgctcaaggccaccgacgaggagttcagggagatgctcgacaaggagcgggagctgctgcaggagcagacagcgacgacggactga

SEQ ID NO: 11854 - protein, 324 aa, Sorghum bicolor
  misc_feature: Ceres ANNOT ID no. 6034875
  misc_feature (27)..(307): Pfam Id: mTERF Pfam Desc: mTERF
  misc_feature (1)..(321): NCBI GI: 115455761 NCBI Desc: os03g0785200 [oryza sativa (japonica cultivar-group)]
  misc_feature (23)..(309): NCBI GI: 85541253 NCBI Desc: mterf-like protein [brassica napus]
  misc_feature (23)..(310): NCBI GI: 18655377 NCBI Desc: at2g36000/f11f19.9 [arabidopsis thaliana]
  misc_feature (59)..(305): NCBI GI: 33589698 NCBI Desc: at1g78930 [arabidopsis thaliana]
  misc_feature (84)..(305): NCBI GI: 124359483 NCBI Desc: mitochodrial transcription termination factor-related [medicago truncatula]
  misc_feature: Useful for making plants with altered terpenoid content
  misc_feature: GREAT-hit functional homolog of the protein sequence given in SEQ ID NO 13264
  misc_feature: Useful for making plants with altered terpenoid content
  misc_feature: Functional homolog of the protein sequence given in SEQ ID NO 13264
MPLCSFYASTSVPVVKPQQSVASSKPPSTAAASVTTTVPMRSATTATVTTAVPTASQTLSLHLPELPSQVKDKILSLELMGVDYRRALELNPALRDAAPESIHAVVSFLQSRGLQFKDLGRVFGMCPSVLTASVRADLRPVFAFLSEDLCIPESAHRRVVIKCPRVLACSVRDQLRPALIYLRRLGFRDSRALALQDPILLVSSVERTLAPKLEYLAGLGMSRDDAVAMVLRCPALFTFSIERNFRPKFEYLVDAMGGGVEDVKAFPQYFAFSLEKRIAPRHRAAEDAGVALPLPDMLKATDEEFREMLDKERELLQEQTATTD

SEQ ID NO: 11855 - DNA, 1065 bp, Sorghum bicolor
  misc_feature: Ceres ANNOT ID no. 6034959
  misc_feature: Encodes the peptide sequence at SEQ ID NO 11856
atgttgtgggtagacaagtaccggccaaaaaccctagacaaggtcaccgtccacgaccaggtggcgcagaacctcaggaagctcgtgtcggagcaggattgcccgcacctgctgttctatgggccgtcggggtccgggaagaaaaccctaatcctcgcgctcatcaagcagatgtttggcgctggtgcggagaaggttaagctggaaaacaagacatggaaaatcgatactggaacaaggacacttgagatagaattggcaatgttgtcaagtgctcaccatgtggagatgaaccccagtgatgctggctttcaggacaggtatgttgtccaggaggtcatcaaagagatggcgaagaacaggccaattgatgccaaaggcaagagagcgtttaaagtccttgtgttaaatgaagttgacaagctctcacgagaagcccagcattccctccgcagaactatggaaaagtatagctcatcgtgcaggctgatcctatgctgtaacagctcctcaaaagtgacagaggctgtaagatcccgttgcttaaatgtgcgagtaaatgcacccagcgaagatcagattgtccaagttctagagttcattgggaagaaagaaaacctgcgtcttccagctggatttgcagctcgtatcgcagcacaatcaaaccgtaatcttagacgggcaatactgttttttgagacttgcaaagtgcaacaatatccatttacatcaaatcaagcggcgcctcctcttgactgggagcaatatgtgtctgaaatagcaactgatatactgacagaacaaagccctaaaaggctatttgctgtacgtcagaaattctatgaattacttgtcaattgtatcccgcctgaaagtattttgaagaaattgttggcagaattactgaggaagttagatgctgatctgaaacatgaaatctgtcactgggctgcacactatgagcacaagatgcgccttggatcaaaggccatttttcatctagaagctttcgtggccaagttcatgagcatttacaaggagtttctggtggctacatttggttga

SEQ ID NO: 11856 - protein, 354 aa, Sorghum bicolor
  misc_feature: Ceres ANNOT ID no. 6034959
  misc_feature (36)..(238): Pfam Id: AAA Pfam Desc: ATPase family associated with various cellular activities(AAA)
  misc_feature (1)..(354): NCBI GI: 30314657 NCBI Desc: replication factor c 38 kda subunit [oryza sativa (japonica cultivar-group)]
  misc_feature (2)..(349): NCBI GI: 61357169 NCBI Desc: replication factor c 3 [synthetic construct]
  misc_feature (2)..(349): NCBI GI: 54696204 NCBI Desc: replication factor c (activator 1) 3, 38kda [homo sapiens]
  misc_feature (2)..(349): NCBI GI: 61371558 NCBI Desc: replication factor c 3 [synthetic construct]
  misc_feature (2)..(349): NCBI GI: 60812373 NCBI Desc: replication factor c 3 [synthetic construct]
MLWVDKYRPKTLDKVTVHDQVAQNLRKLVSEQDCPHLLFYGPSGSGKKTLILALIKQMFGAGAEKVKLENKTWKIDTGTRTLEIELAMLSSAHHVEMNPSDAGFQDRYVVQEVIKEMAKNRPIDAKGKRAFKVLVLNEVDKLSREAQHSLRRTMEKYSSSCRLILCCNSSSKVTEAVRSRCLNVRVNAPSEDQIVQVLEFIGKKENLRLPAGFAARIAAQSNRNLRRAILFFETCKVQQYPFTSNQAAPPLDWEQYVSEIATDILTEQSPKRLFAVRQKFYELLVNCIPPESILKKLLAELLRKLDADLKHEICHWAAHYEHKMRLGSKAIFHLEAFVAKFMSIYKEFLVATFG

SEQ ID NO: 11857 - DNA, 1686 bp, Sorghum bicolor
  misc_feature: Ceres ANNOT ID no. 6034961
  misc_feature: Encodes the peptide sequence at SEQ ID NO 11858
atggccgctgcgctcgcgagctcgccgcttgttcacctaaccacctcccgcctccgcctccccaggccccgggcctccgcttcgaactccgctccaggaccaggctgctcgagcggcgtgtgcctgggatggaggctgacggttgggtggaggcccgcgaggcggtgcgaccggcttcgatgcttctccaacgatggaggaggcggggaggagggggagaagcatggcgaggaggaggcctcggcggcggcggccccggccccggccccggcggagacacaggtgggcgccgtggaggagcaggcgtccgagcggagccggtcggggagcttttcgtcctcatcctcgtcgtccgggactcctggtgtatcaagcgagccaccactattgagttttagtgttgataatatcgatacagttaagctgttggaacttctaggcccggaaaaggtcgatccaattgatgtcaaggcaattaaggaaaaactctttgggtatacgacattctggttgacaaaagaagaaccctttggtgatcttggtgaaggagttcttttcattgggaatctccgtgggaagagggaggaaatctttgcaaaactccaacggcaagtacgtgaacttactggtgataaatacaatctttttatggtggaggaacctaattcagaaggggatgacccacgtgggggaccacgtgttagttttggtttgcttaggaaggaagtttctgagcctggacctactaccctatggcagtatgtcatttctctgttacttttccttctcactatgttctcctgcgttgagctaggaattgcgtcaaagattagcagtcttccaccagaaattgtttcatatttcactgatccaaatgctaccggaccccctcctgatatgcaacttctgctcccatttgtggaatcggctttgccagtggcttatggtgtcttggctatccaactatttcatgaaattggacactttttggcagcatttccaaacaatgtgaaactaggcattcctttcttcattccgaacttcacccttggaacttttggtgcaattactcagttcaagtccattcttccggatcgaaagacaatgtttgacatatcaatggctggtcctgtggctggagctgcactttccttttcaatgttctttgtaggcttattactctcttcaaatcctgttggggcaagtgatttagtggaagtacctagccaactgttccagggttcattgttgcttggacttattagtagagcaacacttggatacagtgctatgcacgctgctacagtttcgatccaccctcttgtgattgcaggctggtgtggtttaactactactgcatttaatatgcttcctgttggatgtcttgatggtggaagagcattacagggtgcttttggcaaggatgctttgtttggatttggcctcacaacatattcgttgcttggactaggagtgcttggaggaccactgtctcttccttggggtttgtacgtgctaatatgtcagagaacacctgagaaaccatgcttgaacgacgtaagcgatgttggaagttggaggagggcagccttgatagcttcagtgtttcttgttgttttgactctcattccgttatgggatgaactcgcggaggaactaggtgtagggcttgttacttcgttctga

SEQ ID NO: 11858 - protein, 561 aa, Sorghum bicolor
  misc_feature: Ceres ANNOT ID no. 6034961
  misc_feature (312)..(494): Pfam Id: Peptidase_M50 Pfam Desc: Peptidase family M50
  misc_feature (96)..(561): NCBI GI: 115455845 NCBI Desc: os03g0792400 [oryza sativa (japonica cultivar-group)]
  misc_feature (57)..(561): NCBI GI: 124359362 NCBI Desc: peptidase m50, mammalian sterol-regulatory element binding protein [medicago truncatula]
  misc_feature (137)..(561): NCBI GI: 144923420 NCBI Desc: peptidase m50, mammalian sterol-regulatory element binding protein [medicago truncatula]
  misc_feature (311)..(556): NCBI GI: 119487075 NCBI Desc: peptidase m50 [lyngbya sp. pcc 8106]
  misc_feature (309)..(556): NCBI GI: 119511518 NCBI Desc: peptidase m50 [nodularia spumigena ccy9414]
MAAALASSPLVHLTTSRLRLPRPRASASNSAPGPGCSSGVCLGWRLTVGWRPARRCDRLRCFSNDGGGGEEGEKHGEEEASAAAAPAPAPAETQVGAVEEQASERSRSGSFSSSSSSSGTPGVSSEPPLLSFSVDNIDTVKLLELLGPEKVDPIDVKAIKEKLFGYTTFWLTKEEPFGDLGEGVLFIGNLRGKREEIFAKLQRQVRELTGDKYNLFMVEEPNSEGDDPRGGPRVSFGLLRKEVSEPGPTTLWQYVISLLLFLLTMFSCVELGIASKISSLPPEIVSYFTDPNATGPPPDMQLLLPFVESALPVAYGVLAIQLFHEIGHFLAAFPNNVKLGIPFFIPNFTLGTFGAITQFKSILPDRKTMFDISMAGPVAGAALSFSMFFVGLLLSSNPVGASDLVEVPSQLFQGSLLLGLISRATLGYSAMHAATVSIHPLVIAGWCGLTTTAFNMLPVGCLDGGRALQGAFGKDALFGFGLTTYSLLGLGVLGGPLSLPWGLYVLICQRTPEKPCLNDVSDVGSWRRAALIASVFLVVLTLIPLWDELAEELGVGLVTSF

SEQ ID NO: 11859 - DNA, 1020 bp, Sorghum bicolor
  misc_feature: Ceres ANNOT ID no. 6034999
  misc_feature: Encodes the peptide sequence at SEQ ID NO 11860
atgaaccacgggaacgggatgttgaactctgtcaaggtggagagccggccatcagtggttgctaccaatggccagcctaggccgatggatgtgctccatgacggcggcccaccaccgttccttaccaagacgtacgacatggttgatgacccaaccacggacgccgttgtgtcatggagcgccactagcaatagcttcatagtttgggatcctcatatctttgggacggtgctgctgccaaggtatttcaagcacaacaacttctccagcttcgttcggcagctcaatacttatggcttcagaaaggtggatcctgacagatgggaatttgctaatgaagagtttctgagaggtcagaggcaccttctcaaaaacattaggcggcggaaacctccacactcatctccaaatcagcaatctcttggctcttaccttgaggtagggcactttgggtatgaagaagagattgatcagctgaagagggacaaacagctcttgatgactgaagtagtgaagctaaggcaggagcagcaaaatacaaagtcagacctacaggccatggaagagaaattacaagatactgagcagaagcaacagcagatgatggcattcatggctcgagtcatgcagaaccctgattttatgcgtcaactgatctcccagcgcgagatgaggaaggagcttgaggatgccatctcaaagaaaagaaggcgccgcattgttcagggacctgaagctgatagcatgggcactggttctagcctggagcaagggtctcaggtagtgtttgaaccactggagccggtggaatcacttgccaatggtgtgccatctgatctgggaagttcatctgtggaggcaaagggtttcgaggtccaacaaggtgtttcttcatgtggctctgagcgtcttaatggcaagccaactgcagagttaaatgatgatttctgggaggaccttctgcatgaggggggactcggtgcaggtaatgcagttggtcaggatgatatgaagatgtag

SEQ ID NO: 11860 - protein, 339 aa, Sorghum bicolor
  misc_feature: Ceres ANNOT ID no. 6034999
  misc_feature (38)..(205): Pfam Id: HSF_DNA-bind Pfam Desc: HSF-type DNA-binding
  misc_feature (2)..(339): NCBI GI: 33087081 NCBI Desc: heat stress protein [oryza sativa (japonica cultivar-group)]
  misc_feature (28)..(335): NCBI GI: 19490 NCBI Desc: heat stress transcription factor hsf30 [lycopersicon peruvianum]
  misc_feature (21)..(266): NCBI GI: 56117815 NCBI Desc: heat shock factor 1b [medicago sativa]
  misc_feature (21)..(266): NCBI GI: 115521213 NCBI Desc: heat shock transcription factor 1 [medicago sativa]
  misc_feature (21)..(266): NCBI GI: 115521217 NCBI Desc: heat shock transcription factor 1 variant c [medicago sativa]
  misc_feature: The sequence is a functional homolog of SEQ ID NO 1020 in the 10/225,066US patent application
  misc_feature: The sequence is a functional homolog of SEQ ID NO 12 in the 10/286,264US patent application
  misc_feature: The sequence is a functional homolog of SEQ ID NO 16 in the 10/412,699US patent application
  misc_feature: The sequence is a functional homolog of SEQ ID NO 168 in the 10/412,699US patent application
  misc_feature: The sequence is a functional homolog of SEQ ID NO 1685 in the 10/412,699US patent application
  misc_feature: The sequence is a functional homolog of SEQ ID NO 1686 in the 10/412,699US patent application
  misc_feature: The sequence is a functional homolog of SEQ ID NO 1687 in the 10/412,699US patent application
  misc_feature: The sequence is a functional homolog of SEQ ID NO 1688 in the 10/412,699US patent application
  misc_feature: The sequence is a functional homolog of SEQ ID NO 1805 in the 10/374,780US patent application
  misc_feature: The sequence is a functional homolog of SEQ ID NO 190 in the 10/412,699US patent application
  misc_feature: The sequence is a functional homolog of SEQ ID NO 220 in the 10/666,642US patent application
  misc_feature: The sequence is a functional homolog of SEQ ID NO 2201 in the 10/666,642US patent application
  misc_feature: The sequence is a functional homolog of SEQ ID NO 2248 in the 10/374,780US patent application
  misc_feature: The sequence is a functional homolog of SEQ ID NO 2660 in the 10/374,780US patent application
  misc_feature: The sequence is a functional homolog of SEQ ID NO 377 in the 11/479,226US patent application
  misc_feature: The sequence is a functional homolog of SEQ ID NO 401 in the 11/479,226US patent application
  misc_feature: The sequence is a functional homolog of SEQ ID NO 74 in the 10/225,066US patent application
  misc_feature: The sequence is a functional homolog of SEQ ID NO 865 in the 10/666,642US patent application
  misc_feature: The sequence is a functional homolog of SEQ ID NO 92 in the 10/412,699US patent application
  misc_feature: The sequence is a functional homolog of SEQ ID NO 926 in the 10/412,699US patent application
  misc_feature: Useful for making plants with modulated biomass
  misc_feature: Useful for making plants with modulated growth and phenotype characteristics
  misc_feature: Useful for making plants with modulated heat sensitivity
  misc_feature: Useful for making plants with modulated phosphate use efficiency
  misc_feature: Functional homolog of the protein sequence given in SEQ ID NO 13434
  misc_feature: Functional homolog of the protein sequence given in SEQ ID NO 13465
  misc_feature: Functional homolog of the protein sequence given in SEQ ID NO 13466
  misc_feature: The sequence is a functional homolog of SEQ ID NO 12 in the 20030093837 US patent application
  misc_feature: The sequence is a functional homolog of SEQ ID NO 16 in the 20040045049 US patent application
  misc_feature: The sequence is a functional homolog of SEQ ID NO 16 in the 20040045049 US patent application
  misc_feature: The sequence is a functional homolog of SEQ ID NO 168 in the 20040045049 US patent application
  misc_feature: The sequence is a functional homolog of SEQ ID NO 168 in the 20040045049 US patent application
  misc_feature: The sequence is a functional homolog of SEQ ID NO 1685 in the 20040045049 US patent application
  misc_feature: The sequence is a functional homolog of SEQ ID NO 1686 in the 20040045049 US patent application
  misc_feature: The sequence is a functional homolog of SEQ ID NO 1687 in the 20040045049 US patent application
  misc_feature: The sequence is a functional homolog of SEQ ID NO 1688 in the 20040045049 US patent application
  misc_feature: The sequence is a functional homolog of SEQ ID NO 92 in the 20040045049 US patent application
  misc_feature: The sequence is a functional homolog of SEQ ID NO 926 in the 20040045049 US patent application
  misc_feature: The sequence is a functional homolog of SEQ ID NO 1805 in the 20060162006 US patent application
  misc_feature: The sequence is a functional homolog of SEQ ID NO 220 in the 20070033671 US patent application
  misc_feature: The sequence is a functional homolog of SEQ ID NO 2201 in the 20070033671 US patent application
  misc_feature: The sequence is a functional homolog of SEQ ID NO 1685 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: Useful for making plants with modulated heat sensitivity
  misc_feature: Functional homolog of the protein sequence given in SEQ ID NO 13699
  misc_feature: The sequence is a functional homolog of SEQ ID NO 1686 in the 10/412,699 US patent application
  misc_feature: Useful for making plants with modulated biomass
  misc_feature: Functional homolog of the protein sequence given in SEQ ID NO 13700
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 142 in the 10/666,642 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 1688 in the 10/412,699 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
  misc_feature: The sequence is a functional homolog of SEQ ID NO 404 in the 11/479,226 US patent application
  misc_feature: The sequence is a functional homolog of SEQ ID NO 832 in the 11/435,388 US patent application
MNHGNGMLNSVKVESRPSVVATNGQPRPMDVLHDGGPPPFLTKTYDMVDDPTTDAVVSWSATSNSFIVWDPHIFGTVLLPRYFKHNNFSSFVRQLNTYGFRKVDPDRWEFANEEFLRGQRHLLKNIRRRKPPHSSPNQQSLGSYLEVGHFGYEEEIDQLKRDKQLLMTEVVKLRQEQQNTKSDLQAMEEKLQDTEQKQQQMMAFMARVMQNPDFMRQLISQREMRKELEDAISKKRRRRIVQGPEADSMGTGSSLEQGSQVVFEPLEPVESLANGVPSDLGSSSVEAKGFEVQQGVSSCGSERLNGKPTAELNDDFWEDLLHEGGLGAGNAVGQDDMKM

SEQ ID NO: 11861 - DNA, 510 bp, Sorghum bicolor
  misc_feature: Ceres ANNOT ID no. 6035002
  misc_feature: Encodes the peptide sequence at SEQ ID NO 11862
atgccggtcagccacgtaacgacgtcgctcctcccgccgtgccgcgccgccgcgtcgtcgtcggcgcgcgccatgcgttcgttcgcgcgccgtccgtcgccttcctccaccgggctcggcagcggcgtgcgctgccacgccgcgactccgccgccgccggagttcccagaccagcagacgacgccggccgagctgccgggcacggatcgccccccgtccgaggtgccggggacgaaccgcccgccggacgagttcccgagcatcgacacgccaccggagttcaacgcgccgccgggcgtggacgtgccgatgccggggctaccagtgcctgggccggagctccctggccccgcgatgccgtcgccgccggcgccggagatcccgaccgtgccgcccaaccccgacgtcccaccgccgcagccccctgaggtggacccgcccaggccgccacccgaggtcgtccccccgcagcctcctggcgccgcgacggtgctgcctccctttgtgtag

SEQ ID NO: 11862 - protein, 169 aa, Sorghum bicolor
  misc_feature: Ceres ANNOT ID no. 6035002
  misc_feature (9)..(159): NCBI GI: 12018149 NCBI Desc: gamete-specific hydroxyproline-rich glycoprotein a2 [chlamydomonas reinhardtii]
  misc_feature (49)..(167): NCBI GI: 27371271 NCBI Desc: sf3a2-prov protein [xenopus laevis]
  misc_feature (49)..(159): NCBI GI: 76262498 NCBI Desc: pherophorin-c1 protein precursor [chlamydomonas reinhardtii]
  misc_feature (19)..(167): NCBI GI: 6523547 NCBI Desc: hydroxyproline-rich glycoprotein dz-hrgp [volvox carteri f. nagariensis]
  misc_feature (32)..(167): NCBI GI: 41400384 NCBI Desc: plus agglutinin [chlamydomonas reinhardtii]
MPVSHVTTSLLPPCRAAASSSARAMRSFARRPSPSSTGLGSGVRCHAATPPPPEFPDQQTTPAELPGTDRPPSEVPGTNRPPDEFPSIDTPPEFNAPPGVDVPMPGLPVPGPELPGPAMPSPPAPEIPTVPPNPDVPPPQPPEVDPPRPPPEVVPPQPPGAATVLPPFV

SEQ ID NO: 11863 - DNA, 924 bp, Sorghum bicolor
  misc_feature: Ceres ANNOT ID no. 6035006
  misc_feature: Encodes the peptide sequence at SEQ ID NO 11864
atgaagctaaaaaatagtgcagtggagacttttaaggagaacaatatgattttcacttctgaaggaaatttccactctaaaaaaatgcgagaagactatgttgctagtccaaaccaagcagatgttcagacaagatgcaaatggataattggagatgtaacggaggtcttggatcgcaacacatggaagcttggaaagatcttaaagatgctgaagaacaattactttgttatcaggcttgctgattgcatccaactgaaagagttccacatatctagcttgagaatcccacgtggtctggatgctcctcaaagcaagccttttcatgcagcagataaggccaccggacgcagtaagcgccaacctgctgatggccccttgcccggcgcaagagctgtgcaacaattgggtcatcgaacaacctacgatctggggagcagtggcaagaagcggaaaacagctgaagatgcctctcgccatccgagaagagcagcagcacatccccgaaacgtcgtcgcagcctccaacctgaacggcggcatgaccgacagctacctgcagagcgcttcacaggccatagaagacgtcgaatgctcggtggccagctgcagcgtgaatgacctgtaccgcctaggcaatggcggcaatgctaagcggcgccccgccgcggcagggtgcctccctgacgacgccatgtccgcgtgtccgtgcacgcccggggccagggagggggacgaggaggaggaggccgcggcgggcgtgcatgggctggagctggaggcgtaccggtcgacgatgcgggcgctgtacgcgtcggggccactgacgtgggagcaggaggcgctgctgacgaacctgcgcctgtcgctcaacatctccaacgaggagcatctgctccagctcaggcgcctactgtcctcgtga

SEQ ID NO: 11864 - protein, 307 aa, Sorghum bicolor
  misc_feature: Ceres ANNOT ID no. 6035006
  misc_feature (194)..(307): NCBI GI: 92895175 NCBI Desc: agenet [medicago truncatula]
  misc_feature (157)..(307): NCBI GI: 50725037 NCBI Desc: agenet domain-containing protein-like [oryza sativa (japonica cultivar-group)]
  misc_feature (223)..(307): NCBI GI: 92869047 NCBI Desc: agenet [medicago truncatula]
  misc_feature (195)..(306): NCBI GI: 42569914 NCBI Desc: emsy n terminus domain-containing protein / ent domain-containing protein [arabidopsis thaliana]
MKLKNSAVETFKENNMIFTSEGNFHSKKMREDYVASPNQADVQTRCKWIIGDVTEVLDRNTWKLGKILKMLKNNYFVIRLADCIQLKEFHISSLRIPRGLDAPQSKPFHAADKATGRSKRQPADGPLPGARAVQQLGHRTTYDLGSSGKKRKTAEDASRHPRRAAAHPRNVVAASNLNGGMTDSYLQSASQAIEDVECSVASCSVNDLYRLGNGGNAKRRPAAAGCLPDDAMSACPCTPGAREGDEEEEAAAGVHGLELEAYRSTMRALYASGPLTWEQEALLTNLRLSLNISNEEHLLQLRRLLSS

SEQ ID NO: 11865 - DNA, 450 bp, Sorghum bicolor
  misc_feature: Ceres ANNOT ID no. 6035222
  misc_feature: Encodes the peptide sequence at SEQ ID NO 11866
atgaccacctcttccgccttctcggccactctccttccgttcccgccgccgcctcgcctctccgttgcccgcctgcgactccacccccgccgtcgcgctctggtccgctgcgccgcggtgtccgagattgccccggccgcctcagccgcctacggcgtcctcctcctgggcggcggcgccttcgcatatgcgaggtcggggagtaaaggctccatctacggaggactggctggagctgcgctcatgggcgctgcctattatctgatgcagtcgcctgagacgatggcagcaggtgatgctgttggatttggatctgcctttttatttgcctgcgtgtttggtatcaggttgtacaatagccggaaactggtgccatctggccttcttctagccctttctcttggtgccttgggtgtcttttactctgcttacttgcaagacaaggtgtaa

SEQ ID NO: 11866 - protein, 149 aa, Sorghum bicolor
  misc_feature: Ceres ANNOT ID no. 6035222
  misc_feature (45)..(144): Pfam Id: TMEM14 Pfam Desc: Transmembrane proteins 14C
  misc_feature (8)..(149): NCBI GI: 116309683 NCBI Desc: h0404f02.7 [oryza sativa (indica cultivar-group)]
  misc_feature (8)..(149): NCBI GI: 32488496 NCBI Desc: osjnba0011j08.3 [oryza sativa (japonica cultivar-group)]
  misc_feature (50)..(135): NCBI GI: 95103164 NCBI Desc: transmembrane protein 14c [bombyx mori]
  misc_feature (47)..(134): NCBI GI: 90103444 NCBI Desc: transmembrane protein 14c-like [ictalurus punctatus]
  misc_feature (51)..(134): NCBI GI: 49257433 NCBI Desc: mgc82997 protein [xenopus laevis]
MTTSSAFSATLLPFPPPPRLSVARLRLHPRRRALVRCAAVSEIAPAASAAYGVLLLGGGAFAYARSGSKGSIYGGLAGAALMGAAYYLMQSPETMAAGDAVGFGSAFLFACVFGIRLYNSRKLVPSGLLLALSLGALGVFYSAYLQDKV

SEQ ID NO: 11867 - DNA, 963 bp, Sorghum bicolor
  misc_feature: Ceres ANNOT ID no. 6035230
  misc_feature: Encodes the peptide sequence at SEQ ID NO 11868
atgttttacgggggatatgcttaccatggcaactcgtttgagcaaacgtaccgttgctatccagcatccttttttgataagccacacctggaaggtggcgataaagtaataatgccaccgtcagcccttgatcgtcttgcctccttgcacatcgagtaccctatgctatttgagctgcacaatgatgcaacccagcggatttcacactgtggtgttttggagtttgtggcagaagaaggcatgatcatcatgccctattggatgatgcaaaacatgcttcttcaagagggtgacactgtccatgtcaaaaatgcaactcttcccaagggcacatatgtgaaattgcaacctcacacaactgattttctggatatttcaaatccaaaagccatcttggaaaaaactttaagaaatttctcctgcttaaccacgggagacagcatcatggtagcctacaacaacaaacaatattatattgatatcgttgaaacaaagcctgcttcagcagttagcattattgagacagactgtgaagtggactttgcacctcctcttgattataaagaacctgagaaaccacgacaaccaacagttcctgcaggcaaggcacctgctgaagatggaaacactgtagtggaggatgaaccaaaattcaaaccatttactggttctggaaagaggttggatggaaaagcctcaaaactgcaatcatctgtgggtccttccactgcactttctgcaccttcagattcaaacaaaagaggaaaccagcaaatgtcagcaccggcagcttcgggagctagcaattacagtcgacagaaaactggaaagcttgtttttggttcaagtgcaagcaacaataaggaaccacaaaaggctcctgttaaagaggaggaacccgcgaaaaaggacgagcccaggttccaagccttcagcgggaagagctactcattgaaacgttag

SEQ ID NO: 11868 - protein, 320 aa, Sorghum bicolor
  misc_feature: Ceres ANNOT ID no. 6035230
  misc_feature (10)..(184): Pfam Id: UFD1 Pfam Desc: Ubiquitin fusion degradation protein UFD1
  misc_feature (1)..(320): NCBI GI: 38345534 NCBI Desc: osjnba0020j04.9 [oryza sativa (japonica cultivar-group)]
  misc_feature (1)..(319): NCBI GI: 78191476 NCBI Desc: ubiquitin fusion-degradation protein-like [solanum tuberosum]
  misc_feature (1)..(319): NCBI GI: 144923598 NCBI Desc: ubiquitin fusion degradation protein ufd1 [medicago truncatula]
  misc_feature (1)..(319): NCBI GI: 46452265 NCBI Desc: ubiquitin fusion degradation protein [triticum aestivum]
  misc_feature (1)..(319): NCBI GI: 145329208 NCBI Desc: ubiquitin fusion degradation ufd1 family protein [arabidopsis thaliana]
MFYGGYAYHGNSFEQTYRCYPASFFDKPHLEGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKTLRNFSCLTTGDSIMVAYNNKQYYIDIVETKPASAVSIIETDCEVDFAPPLDYKEPEKPRQPTVPAGKAPAEDGNTVVEDEPKFKPFTGSGKRLDGKASKLQSSVGPSTALSAPSDSNKRGNQQMSAPAASGASNYSRQKTGKLVFGSSASNNKEPQKAPVKEEEPAKKDEPRFQAFSGKSYSLKR

SEQ ID NO: 11869 - DNA, 744 bp, Sorghum bicolor
  misc_feature: Ceres ANNOT ID no. 6035270
  misc_feature: Encodes the peptide sequence at SEQ ID NO 11870
atgtatctgctaggaaagaaaactggaaagaagaaagtgtatcttggttatatgagtgcccctctaccgtatgccattgaagagaactacggtgggtgcttctttgatgacgacgacgatcttgcccaagttcttcaagatcaggaaatattgtatcaattaattcaaggaagtaatggtagcggttcatctagaactcatttgactccaagttgtagctatggccatgatcggacaccaaatgaacgaaaatcatctgaagatgtaaactatgagttgcaactagcagttgatgaagctttagctagagagttgcaagaaatggagggcaaactagccaacacttcacttaatgacaataatggaagaaagccaacatcatcttcattgtttgatagagccaataattctgcaagtagacctcctcaggcagtggaggaggatgggattgatccagataatatgacttatgaggaactgcaacagttaggggaagccattggtaccgaaagcaaagggttgcctgaaagtgtcatagcactcttgccaacttcaacttacaaaattgggatattctcaagaaaggaaaaacatgaagaatgtgtgatctgctgtatgtcatacaagaaccgggataggcttactaaattgccctgtggacatcagtaccatcaagcttgtgttgctaaatggttacagatcaataaggtatgccctgtttgcaataaggaggttttcagctag

SEQ ID NO: 11870 - protein, 247 aa, Sorghum bicolor
  misc_feature: Ceres ANNOT ID no. 6035270
  misc_feature (201)..(241): Pfam Id: zf-C3HC4 Pfam Desc: Zinc finger, C3HC4 type (RING finger)
  misc_feature (1)..(246): NCBI GI: 115460008 NCBI Desc: os04g0571200 [oryza sativa (japonica cultivar-group)]
  misc_feature (1)..(246): NCBI GI: 116310277 NCBI Desc: osigba0111l12.9 [oryza sativa (indica cultivar-group)]
  misc_feature (1)..(246): NCBI GI: 6983871 NCBI Desc: zinc finger protein-like [oryza sativa (japonica cultivar-group)]
  misc_feature (1)..(246): NCBI GI: 29170198 NCBI Desc: zinc finger protein [oryza sativa (indica cultivar-group)]
  misc_feature (76)..(245): NCBI GI: 140068969 NCBI Desc: zinc finger, ring-type [medicago truncatula]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
MYLLGKKTGKKKVYLGYMSAPLPYAIEENYGGCFFDDDDDLAQVLQDQEILYQLIQGSNGSGSSRTHLTPSCSYGHDRTPNERKSSEDVNYELQLAVDEALARELQEMEGKLANTSLNDNNGRKPTSSSLFDRANNSASRPPQAVEEDGIDPDNMTYEELQQLGEAIGTESKGLPESVIALLPTSTYKIGIFSRKEKHEECVICCMSYKNRDRLTKLPCGHQYHQACVAKWLQINKVCPVCNKEVFS

SEQ ID NO: 11871 - DNA, 1140 bp, Sorghum bicolor
  misc_feature: Ceres ANNOT ID no. 6035502
  misc_feature: Encodes the peptide sequence at SEQ ID NO 11872
atggcgtctagctgctggcagcggcatctggttctggtcgtcgtcgtcgtcgtcgtcgtcgtcatgatgcggcgctggatcaggacgaccccgtcgccgtcgtcggcgtggggttctcgcctctgttcggggaggccaacatgcatggagcggtccgccgacgggcgcggcgtccggctgacgctgaaccgctactccggctccggcttcatctccaaccactactaccaccccggcttcttcagcgccgacgtcaccctgcccaaggaccacaccgccggagtcgtcgtcgccttctatctgtccaacggcgacgtgttcgacaagacgcacgacgaactggacttggaattcctaggcaaccggcggcgccacgagtggcgtctccagaccaacgtgtacggcaacggcagcacggaccgcgggcgcgaggagcggtacctgatgcccttcgacccgacggcggcggcgcaccgcttctccatcctctggtcctcccgcgccgtcatcttctacgtggacggcgtggccatccgcgaggtaccccgctcggccgccatggcgggggactacccgtccaagcccatggccgtgtacgccaccatctgggacggatccacctgggccaccgacaacggccggtacaaggtgaactaccgccggggtcccttcacggccgagttctcgggactggtgatccgcggttgccccgccgtcggcaacggcggcggcgaccacgtggcgatgctgcggctgcagctgggagccgctaacaaccacgaccgggacgcctgcgccggcgctgagttcgagctcatgacggccgactgcgccatcatgacgccgcggaagcgggcggacatgcggcggtggcgccggcgccagatgctctacacggtgtgctacgacaccaaccggtacccggcggcgttccccgagtgcgacgtggacgccgcggaggcggagcggcagatgttctgggagtggggcgagtccaaggtcgtccgcggccgcgcgcggccgttccgggggcaagcgccgccagcaggtcgcggccgggaccactacgacgacgccggcgccgcggctggtgtcactgcagcaggccgactgattgatctccacctccaactccactga

SEQ ID NO: 11872 - protein, 379 aa, Sorghum bicolor
  misc_feature: Ceres ANNOT ID no. 6035502
  misc_feature (36)..(221): Pfam Id: Glyco_hydro_16 Pfam Desc: Glycosyl hydrolases family 16
  misc_feature (265)..(314): Pfam Id: XET_C Pfam Desc: Xyloglucan endo-transglycosylase (XET) C-terminus
  misc_feature (51)..(264): NCBI GI: 1244754 NCBI Desc: xyloglucan endotransglycosylase-related protein
  misc_feature (54)..(237): NCBI GI: 5533313 NCBI Desc: endoxyloglucan transferase [arabidopsis thaliana]
  misc_feature (51)..(323): NCBI GI: 124109189 NCBI Desc: xyloglucan endotransglycosylase/hydrolase precursor xth-3 [populus tremula x populus tremuloides]
  misc_feature (54)..(236): NCBI GI: 115480926 NCBI Desc: os10g0117000 [oryza sativa (japonica cultivar-group)]
  misc_feature (11)..(236): NCBI GI: 13560781 NCBI Desc: endoxyloglucan transferase [daucus carota]
  misc_feature: Useful for making plants with altered cell wall content and/or composition
  misc_feature: Functional homolog of the protein sequence encoded by LOCUS at2g01850
  misc_feature: Useful for making plants with altered carbohydrate content
  misc_feature: Functional homolog of the protein sequence given in SEQ ID NO 13697
  misc_feature: Useful for making plants with altered cell wall content and/or composition
  misc_feature: Functional homolog of the protein sequence given in SEQ ID NO 13698
  misc_feature: The sequence is a functional homolog of SEQ ID NO. 381 in the 11/188,298 US application
MASSCWQRHLVLVVVVVVVVVMMRRWIRTTPSPSSAWGSRLCSGRPTCMERSADGRGVRLTLNRYSGSGFISNHYYHPGFFSADVTLPKDHTAGVVVAFYLSNGDVFDKTHDELDLEFLGNRRRHEWRLQTNVYGNGSTDRGREERYLMPFDPTAAAHRFSILWSSRAVIFYVDGVAIREVPRSAAMAGDYPSKPMAVYATIWDGSTWATDNGRYKVNYRRGPFTAEFSGLVIRGCPAVGNGGGDHVAMLRLQLGAANNHDRDACAGAEFELMTADCAIMTPRKRADMRRWRRRQMLYTVCYDTNRYPAAFPECDVDAAEAERQMFWEWGESKVVRGRARPFRGQAPPAGRGRDHYDDAGAAAGVTAAGRLIDLHLQLH

SEQ ID NO: 11873 - DNA, 978 bp, Sorghum bicolor
  misc_feature: Ceres ANNOT ID no. 6035976
  misc_feature: Encodes the peptide sequence at SEQ ID NO 11874
atgaacgcgctggcgtcggcggacccgcggatgcaggaggtgcgcgagaacacggtccggtccttcaacgacgccgcgcgcttccccgtcgactacgtcgagttcgacgtccaggtcactaaagatggatgcccaatcatcttccatgacaacttcatcttcacccaagaagatggtaaaatttcacagaagcgtgtgaccgatattcatctggaagacttcctccagtatgggccccagaatgagcaggggaaggttgggaagcccctgcttcgcaggctgaaggatggtaggatggtgaactggaatgtgcaatcggaggatgctctttgcacacttgaagaagcgttcgagaaggtcaatacaagattgggcttcaacgttgagctgaaatttgatgacagtcttgaataccaggaggaagagctcactcgcatcctccaggccatcctcaaggtgatttttgagcatgccaaggataggcctatacttttctctagttttcagcccgatgctgcacagctcatgcgtaaattgcaaggcacatatcctgtctacttcctgacaaacggagggacagagctatacaccgacgtgagaaggaactcgttggaggaggccgtcaagctttgcctcgcgagtggcatgcaaggaatagtttcagaagcccgcgggatattcaggcaccctgctgctgtaccaaagatcaaagaggctaacctctccctgctaacctatggaacattgaataatgtgccggaggcggtgtacatgcagcacctcatgggagtgaatggggtgatcgtcgacctggtgccggagatcaccgacgcagtctcggagctcattgccctgcccgagcctgacctggaagtggacaacttgagcaaccaggcagctagaggagccacaacaccgaatttctcgcagcgcgagatctcgttcttgctgaggctaattcctgagcttgtccaataa

SEQ ID NO: 11874 - protein, 325 aa, Sorghum bicolor
  misc_feature: Ceres ANNOT ID no. 6035976
  misc_feature (11)..(274): Pfam Id: GDPD Pfam Desc: Glycerophosphoryl diester phosphodiesterase family
  misc_feature (1)..(325): NCBI GI: 82792094 NCBI Desc: glycerophosphoryl diester phosphodisterase [oryza sativa (japonica cultivar-group)]
  misc_feature (59)..(325): NCBI GI: 115446337 NCBI Desc: os02g0514500 [oryza sativa (japonica cultivar-group)]
  misc_feature (1)..(312): NCBI GI: 116309380 NCBI Desc: h0718e12.3 [oryza sativa (indica cultivar-group)]
  misc_feature (1)..(325): NCBI GI: 42573537 NCBI Desc: glycerophosphoryl diester phosphodiesterase family protein [arabidopsis thaliana]
  misc_feature (1)..(291): NCBI GI: 34146826 NCBI Desc: at5g43300 [arabidopsis thaliana]
MNALASADPRMQEVRENTVRSFNDAARFPVDYVEFDVQVTKDGCPIIFHDNFIFTQEDGKISQKRVTDIHLEDFLQYGPQNEQGKVGKPLLRRLKDGRMVNWNVQSEDALCTLEEAFEKVNTRLGFNVELKFDDSLEYQEEELTRILQAILKVIFEHAKDRPILFSSFQPDAAQLMRKLQGTYPVYFLTNGGTELYTDVRRNSLEEAVKLCLASGMQGIVSEARGIFRHPAAVPKIKEANLSLLTYGTLNNVPEAVYMQHLMGVNGVIVDLVPEITDAVSELIALPEPDLEVDNLSNQAARGATTPNFSQREISFLLRLIPELVQ

SEQ ID NO: 11875 - DNA, 1086 bp, Sorghum bicolor
  misc_feature: Ceres ANNOT ID no. 6036071
  misc_feature: Encodes the peptide sequence at SEQ ID NO 11876
atggacctttatcttctttttcatagcgtggtgatgcatatctctgccgcaattatcatcttgatatacatcccactctctataccggtgaagctgttcatgtgggcgttcgtgaaaccgctgaggaaggaggacctgagaggcaaggtcgtgctcatcacaggcgcctcctccggcatcggcgaggagcttgcgtaccagtacgcgaagaaaggcgcgtgcctttcgctggtggcccggaggaaacaagcgctggagggcgtcgcagcggccgccctggaacgtggtgcgccggacgttctggtcattccggccgacgtctcggacgcggagcaatcgaggcgcgccgtcgaggccaccgtcgctcacttcggcaaactgaaccatctagttgccaatgccggggtctggtccagctgcttcttcgacgaagtcaccaatataactgggttcaacaaaatgatggatgtcaacttctggggctctgtctacccaacctactatgccctgccacacctgaaggcgagcaaaggaaaactcatcgtgtcttcctccacagccgcgacggcgcctacatctaggatgaccttgtacaatgctagcaaggcagcacagctcaggttctacgagacactgagatccgagcttggctcggaggttggggtgactatactgacggccggattcgtggagtctgagatgaccaaaggcaaggccatccagaaagacggcaacgtcgccattgacctggaggccagagatgtgcagatcggggtgttcccagtggcccgtgtcgagaagctgtgcaaggtagccttggacggcatccagagaggggactggtacgtgacatggccgtcgctctaccggccgataccgctcatcgcctgcctcgcccccgaggtgctcacctggcagtcctacgcgctgtacaacgccagacaggggaagccgccgctgagccagagaatgctggacgccaccggagccaagcgcttctacccaccgtcgcttcggcatcatccaggtatcaagacggaggggactcatcacaaacgagatatcgatgcagcgtctaatgtgtag

SEQ ID NO: 11876 - protein, 361 aa, Sorghum bicolor
  misc_feature: Ceres ANNOT ID no. 6036071
  misc_feature (49)..(217): Pfam Id: adh_short Pfam Desc: short chain dehydrogenase
  misc_feature (18)..(347): NCBI GI: 21742781 NCBI Desc: osjnba0055c08.3 [oryza sativa (japonica cultivar-group)]
  misc_feature (12)..(339): NCBI GI: 112784981 NCBI Desc: 11-beta-hydroxysteroid dehydrogenase-like protein [triticum aestivum]
  misc_feature (33)..(347): NCBI GI: 124107990 NCBI Desc: short-chain dehydrogenase reductase [brassica napus]
  misc_feature (1)..(339): NCBI GI: 16033752 NCBI Desc: steroleosin [sesamum indicum]
  misc_feature (33)..(347): NCBI GI: 134304897 NCBI Desc: short-chain dehydrogenase reductase [brassica napus]
  misc_feature: The sequence is a functional homolog of SEQ ID NO. 389 in the 11/188,298 US application
  misc_feature: The sequence is a functional homolog of SEQ ID NO. 453 in the 11/188,298 US application
MDLYLLFHSVVMHISAAIIILIYIPLSIPVKLFMWAFVKPLRKEDLRGKVVLITGASSGIGEELAYQYAKKGACLSLVARRKQALEGVAAAALERGAPDVLVIPADVSDAEQSRRAVEATVAHFGKLNHLVANAGVWSSCFFDEVTNITGFNKMMDVNFWGSVYPTYYALPHLKASKGKLIVSSSTAATAPTSRMTLYNASKAAQLRFYETLRSELGSEVGVTILTAGFVESEMTKGKAIQKDGNVAIDLEARDVQIGVFPVARVEKLCKVALDGIQRGDWYVTWPSLYRPIPLIACLAPEVLTWQSYALYNARQGKPPLSQRMLDATGAKRFYPPSLRHHPGIKTEGTHHKRDIDAASNV

SEQ ID NO: 11877 - DNA, 1713 bp, Sorghum bicolor
  misc_feature: Ceres ANNOT ID no. 6036183
  misc_feature: Encodes the peptide sequence at SEQ ID NO 11878
atggcctgcagtctccagggtggtgatgtcgtcgtgttcgaggtggacgccatcggctgggctccctccggcgcgcgcacggcgctgtccctgcaccacgagctcgacccggccaggctccctgctgcgtccgccgccgtcaggccgcacgggcacacgcccagcggccggtacgtcctggcgggcggccgcgccgacgaggaggacggcctgtgccaggcgatcacgccgggcgcgctcaagccccgggtcacgtaccgtgtcgccgggtggatcagcgtcgcagccgccggcgccggggtgggaggaacgacgacggcccaccatcatcccgccgtgcacgtcagcatccgcgtcgacggcggccgctgcgtcatggacggcggcgctgtcgcctgctccgccgccgcctccgacgacgccagcagcagcaggtgggcggagatcaaaggcgggttccggctgaaggagagcccccgcagcgcggcggtgcacgtgcatggtgcgcccgccggcgtcgacgtgaaggtcatggacctgaggatcattgccaccgaccgaaaagcgcgcttcaggtacctcaaggacaagacggacaaggtgcgcaagcgtgacgtggttgtgaaggtgggcggtggtgccccagcgggcgcgcccgtgcgcgtggtgcagctggacagcgccttccccatcggcagctgcatcaacggcacggtgatccaggacccagccttcgtggacttcttcaccaaccacatggactgggccgtcttcgagaacgagctgaaatggtactggaccgaggcgcagcgcgggcagctcaactacggcgacgccgaccgcctgctcgacttctgcgaccgcgccgggaagcccgtgcgtggccactgcatcttctgggccgtcgacgccgaggtgcagcagtggatcaaggacctcgccgccgacgagctcatggcggcggtgcgggcgcgcctcaacggcctcctcggccgctacgcggggaggttcccgcactacgacgtcaacaacgagatgctgcacggccggttcttccgcgaccgcctcggcgacggcgtcgcgccgctcatgttccgcgaggcggcgcgcctggacccgggcgccgcactcttcgtcaacgactacaacgtcgagtgcggcaacgacggcaacgccacgccggagaggtacgtggagctcatccgcggccttcagcgcggcggcgcgcgggtcggcggcgtcgggctgcagggccacgtcacgcaccccgtcggggaggtcatctgcgacgcgctcgacgcgctcgccgcggccacggagctgcccgtctggttcacggagctcgacgtgtgcgagcccgacgacgccctccgcgccgacgacctcgaggtggtgatgcgcgaggcgttcgcgcacccggcggtgcagggcgtcgtgctctgggggttcatgcagggacacatgtggaggcaggacgccgcgctcgtcaacgccgacggcaccgtcaacgacgccgggcggaggttcgttgaactccggagggagtggacgtccgacgcgaggggacgcctcgacgccgatggccagttcaagttcaggggcttccacggcaactacgtggctcaggtcaccacgcccgcggggacgaagatgctcaaggcgttcaccgtcgacaaaggggacacgcctctcgtcctggacatggataactga

SEQ ID NO: 11878 - protein, 570 aa, Sorghum bicolor
  misc_feature: Ceres ANNOT ID no. 6036183
  misc_feature (224)..(513): Pfam Id: Glyco_hydro_10 Pfam Desc: Glycosyl hydrolase family 10
  misc_feature (33)..(569): NCBI GI: 115434378 NCBI Desc: os01g0134900 [oryza sativa (japonica cultivar-group)]
  misc_feature (19)..(568): NCBI GI: 71142590 NCBI Desc: endo-1,4-beta-xylanase [hordeum vulgare subsp. vulgare]
  misc_feature (19)..(568): NCBI GI: 71142588 NCBI Desc: endo-1,4-beta-xylanase [hordeum vulgare]
  misc_feature (19)..(568): NCBI GI: 71142586 NCBI Desc: endo-1,4-beta-xylanase [hordeum vulgare subsp. vulgare]
  misc_feature (19)..(568): NCBI GI: 14861199 NCBI Desc: 1,4-beta-d xylan xylanohydrolase [hordeum vulgare]
  misc_feature: Useful for making plants with altered carbohydrate content
  misc_feature: Functional homolog of the protein sequence given in SEQ ID NO 13701
MACSLQGGDVVVFEVDAIGWAPSGARTALSLHHELDPARLPAASAAVRPHGHTPSGRYVLAGGRADEEDGLCQAITPGALKPRVTYRVAGWISVAAAGAGVGGTTTAHHHPAVHVSIRVDGGRCVMDGGAVACSAAASDDASSSRWAEIKGGFRLKESPRSAAVHVHGAPAGVDVKVMDLRIIATDRKARFRYLKDKTDKVRKRDVVVKVGGGAPAGAPVRVVQLDSAFPIGSCINGTVIQDPAFVDFFTNHMDWAVFENELKWYWTEAQRGQLNYGDADRLLDFCDRAGKPVRGHCIFWAVDAEVQQWIKDLAADELMAAVRARLNGLLGRYAGRFPHYDVNNEMLHGRFFRDRLGDGVAPLMFREAARLDPGAALFVNDYNVECGNDGNATPERYVELIRGLQRGGARVGGVGLQGHVTHPVGEVICDALDALAAATELPVWFTELDVCEPDDALRADDLEVVMREAFAHPAVQGVVLWGFMQGHMWRQDAALVNADGTVNDAGRRFVELRREWTSDARGRLDADGQFKFRGFHGNYVAQVTTPAGTKMLKAFTVDKGDTPLVLDMDN

SEQ ID NO: 11879 - DNA, 933 bp, Sorghum bicolor
  misc_feature: Ceres ANNOT ID no. 6037429
  misc_feature: Encodes the peptide sequence at SEQ ID NO 11880
atggaggacgtggccaacgcgcacctctacgcccatgcccacgcccaccggagcaagcgtcccccgtcgtcggccgcgatgaaggacggggacggggacgtcgacttgtccatgaagggcgcgcggtaccgcggcgtgcggcgccggccgtggggccggttcgcggcggagatccgcgaccccatgtccaaggagcggcggtggctcggcaccttcgacaccgctgagcaggccgcctgcgcctacgacatcgccgcgcgcgccatgcgcggcaacaaggcgcgcaccaacttccccggccacgccaccgcgggctactggccgtggggcacgccgcagccggcggcggtcgcggtcgcgcacccgatcaacatcaaccccctcctgctgcacaacctcatcatgagctcctcccaccacggctgccgcctgcttaaccaagcaggacacggacacgggcacggacacggacattccgttcccaccagacctccggcgccggcgccggcgacggatgacacgaccatcgcagggcccttccctgtcgcctcccaccccgacgtcgtagcgatggacgaggacgtggacgactgggacggcgtcctgcggagcgagcccgcggacgccggtctgctgcaggacgcgctgcacgacttctacccttttacgcgtccgcgcgccggcggcgatggcaggcgcggcctgtccgcggccggcgccgacgacgccagggcagccgcagctgcgttggtgccggtaatgcaggaggggttcgtctttcccagccctttcgcgggcgtcgacgggaacggcgagtacccgatgatgccgcagggcctgctcgaggacgtgatcccacactccccggcgttcctggaggtcgtggccgcgccgtccgtctccgtcccgacgcgacgcggccgcaggggctga

SEQ ID NO: 11880 - protein, 310 aa, Sorghum bicolor
  misc_feature: Ceres ANNOT ID no. 6037429
  misc_feature (41)..(92): Pfam Id: AP2 Pfam Desc: AP2 domain
  misc_feature (1)..(181): NCBI GI: 46805282 NCBI Desc: enhancer of shoot regeneration esr1-like protein [oryza sativa (japonica cultivar-group)]
  misc_feature (22)..(108): NCBI GI: 18028940 NCBI Desc: enhancer of shoot regeneration esr1 [arabidopsis thaliana]
  misc_feature (18)..(229): NCBI GI: 62466415 NCBI Desc: frizzy panicle [oryza meridionalis]
  misc_feature (41)..(98): NCBI GI: 49387780 NCBI Desc: branched silkless 1-like [oryza sativa (japonica cultivar-group)]
  misc_feature (18)..(229): NCBI GI: 62466417 NCBI Desc: frizzy panicle [oryza longistaminata]
  misc_feature: The plant flowers significantly late compared to wild-type.
  misc_feature: The plant is abnormally small.
  misc_feature: The sequence is a functional homolog of SEQ ID NO 1195 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: The sequence is a functional homolog of SEQ ID NO 1195 in the 20070033671 US patent application
  misc_feature: GREAT-hit functional homolog of the protein sequence given in SEQ ID NO 13534
  misc_feature: The sequence is a functional homolog of SEQ ID NO. 274 in the 11/188,298 US application
MEDVANAHLYAHAHAHRSKRPPSSAAMKDGDGDVDLSMKGARYRGVRRRPWGRFAAEIRDPMSKERRWLGTFDTAEQAACAYDIAARAMRGNKARTNFPGHATAGYWPWGTPQPAAVAVAHPININPLLLHNLIMSSSHHGCRLLNQAGHGHGHGHGHSVPTRPPAPAPATDDTTIAGPFPVASHPDVVAMDEDVDDWDGVLRSEPADAGLLQDALHDFYPFTRPRAGGDGRRGLSAAGADDARAAAAALVPVMQEGFVFPSPFAGVDGNGEYPMMPQGLLEDVIPHSPAFLEVVAAPSVSVPTRRGRRG

SEQ ID NO: 11881 - DNA, 861 bp, Sorghum bicolor
  misc_feature: Ceres ANNOT ID no. 6037645
  misc_feature: Encodes the peptide sequence at SEQ ID NO 11882
atggcgaagaagagcaaaggcccggccgccgcggcgccggcggcggcggatgagacgggcgtctcgagtccccagggctccgcccacggcagcgagggcggcggggagaaggagggcgccttccttctgggggagccaacctgggaggacaccggcggcgggcggtggcggtgcgcggagacagggcacgagctgccggagcgggagaaggaggcgtacgcgcggtcccgcgcctgccgcctcgcgctcattgaccacgccgtcgcgcgcaagaagccgccgctcaacgccttcaagccccaccccgagcacaaatcgaagctggtatgcaagattacaggggatacggttaacaagttggaggatcacatatggaagcacatcaacgggaagagatttcttaacaagctagaaaaactagaagaccaggtggcttctggcgagatggctgatgaagaacctgtgaagtcaaatgaagtggcaaagaagagcaagtcaagaaagaaggacaagaagaaagctaatgttgccagtccttctttgccaagagaacctaaaccagagatggatgattcagatgatccagatttctgggtgcctccggttggaagtcgctgggatgacgatgatgggaaagacagatgggagtcatcaccaggaaagcccaactcagcaaagaacaaaggtggttctgatgatgatggtgctggtgataatgacggtggtggtgatgatgatacggctgacaaggatgatgctgaatcaagggaacttgcttcgaggacaaagcgaatgtcaatagaggctgttgggccaagtagcttcgcttcaaggaagaaaaaacccaagaaggagcagtaa

SEQ ID NO: 11882 - protein, 286 aa, Sorghum bicolor
  misc_feature: Ceres ANNOT ID no. 6037645
  misc_feature (31)..(279): Pfam Id: SURF2 Pfam Desc: Surfeit locus protein 2 (SURF2)
  misc_feature (1)..(286): NCBI GI: 32488148 NCBI Desc: osjnba0044k18.33 [oryza sativa (japonica cultivar-group)]
  misc_feature (6)..(286): NCBI GI: 116309840 NCBI Desc: osigba0158f13.7 [oryza sativa (indica cultivar-group)]
  misc_feature (1)..(286): NCBI GI: 115459002 NCBI Desc: os04g0480400 [oryza sativa (japonica cultivar-group)]
  misc_feature (37)..(213): NCBI GI: 145334681 NCBI Desc: surfeit locus protein 2 family protein / surf2 family protein [arabidopsis thaliana]
  misc_feature (36)..(284): NCBI GI: 28866786 NCBI Desc: surf2 [gallus gallus]
MAKKSKGPAAAAPAAADETGVSSPQGSAHGSEGGGEKEGAFLLGEPTWEDTGGGRWRCAETGHELPEREKEAYARSRACRLALIDHAVARKKPPLNAFKPHPEHKSKLVCKITGDTVNKLEDHIWKHINGKRFLNKLEKLEDQVASGEMADEEPVKSNEVAKKSKSRKKDKKKANVASPSLPREPKPEMDDSDDPDFWVPPVGSRWDDDDGKDRWESSPGKPNSAKNKGGSDDDGAGDNDGGGDDDTADKDDAESRELASRTKRMSIEAVGPSSFASRKKKPKKEQ

SEQ ID NO: 11883 - DNA, 1080 bp, Sorghum bicolor
  misc_feature: Ceres ANNOT ID no. 6037675
  misc_feature: Encodes the peptide sequence at SEQ ID NO 11884
atggacgcgagccaaacctggccgcccccgaccccctcgccgccgcccttctcctcccggccccgcgcgtcgccgtcgccgtcgccgtccgcgcaccgccggcgccgccggcactccaagaagcacaagcccccgcccgcgcctgcgcctgcgccgacgccgcagggcgcggcggacttctccgcgctcccgccggagctcgtccaccgggccctcgcggccgcgtgcgcctccgacgtcgcggcggccagccgcgcgtgccgcgcgtggcgggacgcgctgcggccgctccgcgaggccgcggcgctgcacgcgttcggccgacgcgtcaagcacggcctcgtggcgggacccgcgtcctcacgcgggggggccggtggcggacgtctcgagacggagaggcagcgcgctctggggctgttccggcgggccgcgaggctgggctccgcggcggcgatggtggacgccgggctcatgtgctgggaggatgggcggcgggaggaggccgtcggttactaccggagcgcggcggacctgggccatcccgttgggatgtgcaatcttggagtctccttccttgaagctgatccacccaaggccgaggaagctattagatggttttatccatcagcatctgcaggcaatgctcgtgctcaatacaacctaggcctttgcttgcagaacgggaagggtgtcaaacggagtcagaaggaagctgcaaaatggtatttacgagctgcagagggagggaatgtacgagccatgtataacatttccttgtgttacagctatggtgaagggctttcacaggatccagtgcgcgctaagaggtggcttcaactagctgctgattgtggtcacaagaaagctctttatgagtgtggtattaaactttgtgcggcaggagacaaggtcaagtctctcatgtatctagagttggcaacacggcgtggagaatacgctgctgcccacatgagagatgtgatatttgaatcgctctctgttgtgaataaacagcgtgccatgtcggacgctgataaatggaagcctaggacactccatcctagaagactgcagtag

SEQ ID NO: 11884 - protein, 359 aa, Sorghum bicolor
  misc_feature: Ceres ANNOT ID no. 6037675
  misc_feature (216)..(251): Pfam Id: Sel1 Pfam Desc: Sel1 repeat
  misc_feature (252)..(287): Pfam Id: Sel1 Pfam Desc: Sel1 repeat
  misc_feature (12)..(357): NCBI GI: 38344482 NCBI Desc: osjnba0022h21.17 [oryza sativa (japonica cultivar-group)]
  misc_feature (12)..(357): NCBI GI: 115458954 NCBI Desc: os04g0476000 [oryza sativa (japonica cultivar-group)]
  misc_feature (32)..(357): NCBI GI: 116310297 NCBI Desc: osigba0106g07.11 [oryza sativa (indica cultivar-group)]
  misc_feature (52)..(350): NCBI GI: 27363348 NCBI Desc: at1g70590/f5a18_23 [arabidopsis thaliana]
  misc_feature (196)..(349): NCBI GI: 140041696 NCBI Desc: sel1-like repeat [medicago truncatula]
MDASQTWPPPTPSPPPFSSRPRASPSPSPSAHRRRRRHSKKHKPPPAPAPAPTPQGAADFSALPPELVHRALAAACASDVAAASRACRAWRDALRPLREAAALHAFGRRVKHGLVAGPASSRGGAGGGRLETERQRALGLFRRAARLGSAAAMVDAGLMCWEDGRREEAVGYYRSAADLGHPVGMCNLGVSFLEADPPKAEEAIRWFYPSASAGNARAQYNLGLCLQNGKGVKRSQKEAAKWYLRAAEGGNVRAMYNISLCYSYGEGLSQDPVRAKRWLQLAADCGHKKALYECGIKLCAAGDKVKSLMYLELATRRGEYAAAHMRDVIFESLSVVNKQRAMSDADKWKPRTLHPRRLQ

SEQ ID NO: 11885 - DNA, 1044 bp, Sorghum bicolor
  misc_feature: Ceres ANNOT ID no. 6037814
  misc_feature: Encodes the peptide sequence at SEQ ID NO 11886
atggatgacgacctgaaacatctgagggtcagcttctctggggtgaggcaggaagatcgtggccgccgcggcggcgagacaatcccaacaccatcttttcagcaaaggacgagttcacgcagagaggagtacgacgcggcgtatgcagccacggtggcagcagtggcatacgccattgccgcgcgagaggaggagaggctgttagcgtctcaagagagtccgtcgccgtatgctgccgcggacaagctttcgcgtggaaatggaaacaatccagcaagtcaccacgtacccaagagaggcgagagcctcaagaagccgattttcgaaggcggcagatcctcttcctcgagatggttcactggtaaagagcccatagacgacgattaccaagatgaacaaggtgctaatgtgtcagtgaaacggataagactgccggttcacaggaagccagcacagggtgcggtttcagacgaaaggccccctgtttacactgatcctgcaccacgcgtaaagaaggaccccagtttcacccggaaaccgtcggaaaagagaggaagcaggagattcgagcaggatcagggcaaccagacggcgccggcacggccaatggacaagacgtcgagctcgtattcggcgggcggtagggagagtggtggagctgctactgctaccacgtcttctggtggtggagtggcggcgttctctagcgaaaacgaagccatggcagatgcttgggagaaggagaagctggcgaagatcaagaagcagtacaacgagacgatgcagacgattgctgaatgggagaccgagaagaaggccaaggccaagcgccagaaggagctgaaagatgagagtgagtcggacaggaagcgtgcgaaggcgctggaggagtacaacgaggagatgtcgaggatcaacaaggtggccgcggcgtcgaggctgacggcggaggacaagaggaggagcgccgagaggaaggtcagggacaaggcgcacaccataaggtccacggggaagcttcccgggacatgtggctgtttctga

SEQ ID NO: 11886 - protein, 347 aa, Sorghum bicolor
  misc_feature: Ceres ANNOT ID no. 6037814
  misc_feature (233)..(345): Pfam Id: Remorin_C Pfam Desc: Remorin, C-terminal region
  misc_feature (133)..(347): NCBI GI: 115451495 NCBI Desc: os03g0211500 [oryza sativa (japonica cultivar-group)]
  misc_feature (48)..(347): NCBI GI: 8778390 NCBI Desc: f16a14.13 [arabidopsis thaliana]
  misc_feature (240)..(344): NCBI GI: 30697834 NCBI Desc: remorin family protein [arabidopsis thaliana]
  misc_feature (237)..(341): NCBI GI: 102140033 NCBI Desc: remorin-related [musa acuminata]
  misc_feature (244)..(347): NCBI GI: 92877744 NCBI Desc: remorin, c-terminal region [medicago truncatula]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
MDDDLKHLRVSFSGVRQEDRGRRGGETIPTPSFQQRTSSRREEYDAAYAATVAAVAYAIAAREEERLLASQESPSPYAAADKLSRGNGNNPASHHVPKRGESLKKPIFEGGRSSSSRWFTGKEPIDDDYQDEQGANVSVKRIRLPVHRKPAQGAVSDERPPVYTDPAPRVKKDPSFTRKPSEKRGSRRFEQDQGNQTAPARPMDKTSSSYSAGGRESGGAATATTSSGGGVAAFSSENEAMADAWEKEKLAKIKKQYNETMQTIAEWETEKKAKAKRQKELKDESESDRKRAKALEEYNEEMSRINKVAAASRLTAEDKRRSAERKVRDKAHTIRSTGKLPGTCGCF

SEQ ID NO: 11887 - DNA, 648 bp, Sorghum bicolor
  misc_feature: Ceres ANNOT ID no. 6037842
  misc_feature: Encodes the peptide sequence at SEQ ID NO 11888
atggattcctcctcctcctcgtccagcctgagccagcagcccgagttcgactaccttttcaagctcctcctgatcggcgactccggcgtcggcaagagcagcctcctcctccgtttcaccgccgactccttcgaggacctctcccccacaataggtgttgacttcaaggtgaagatggttagcattggtggcaaaaaactcaagcttgccatctgggacacagctggacaagagagatttaggaccttgaccagctcttactacagaggggcacaggggatcattatggtgtatgatgtcactcgacgggaaacatttaccaatctttctgatatatgggcgaaggaaattgacctgtattcaaccaaccaggactgtataaagatgcttgttggaaataaagtagacaaggaaagtgagagatgtgtcacaaaaaaagaggggattgaatttgccagggaatacggatgtttatttctagaatgcagtgcaaaaacaaaagtaaatgtagaacagtgctttgaggaactcgttctaaagatattagacacgccaagcctcctcgcggatgcttcctcgggggccaagaagaacatcttcaagcagaagcctccggaagctgacgcggcggcaagcagctgctgttaa

SEQ ID NO: 11888 - protein, 215 aa, Sorghum bicolor
  misc_feature: Ceres ANNOT ID no. 6037842
  misc_feature (21)..(183): Pfam Id: Ras Pfam Desc: Ras family
  misc_feature (21)..(136): Pfam Id: Miro Pfam Desc: Miro-like protein
  misc_feature (5)..(181): Pfam Id: Arf Pfam Desc: ADP-ribosylation factor family
  misc_feature (7)..(215): NCBI GI: 1370174 NCBI Desc: rab1y [lotus corniculatus var. japonicus]
  misc_feature (75)..(215): NCBI GI: 8778652 NCBI Desc: f9c16.3 [arabidopsis thaliana]
  misc_feature (16)..(215): NCBI GI: 1370172 NCBI Desc: rab1x [lotus corniculatus var. japonicus]
  misc_feature (17)..(214): NCBI GI: 549810 NCBI Desc: gtp-binding protein yptv3
  misc_feature (21)..(187): NCBI GI: 33416686 NCBI Desc: mgc69017 protein [xenopus laevis]
  misc_feature: Useful for making plants with altered Lignin content
  misc_feature: GREAT-hit functional homolog of the protein sequence given in SEQ ID NO 13058
  misc_feature: Useful for making plants with altered lignin content
  misc_feature: Functional homolog of the protein sequence given in SEQ ID NO 13058
  misc_feature: The sequence is a functional homolog of SEQ ID NO. 400 in the 11/188,298 US application
MDSSSSSSSLSQQPEFDYLFKLLLIGDSGVGKSSLLLRFTADSFEDLSPTIGVDFKVKMVSIGGKKLKLAIWDTAGQERFRTLTSSYYRGAQGIIMVYDVTRRETFTNLSDIWAKEIDLYSTNQDCIKMLVGNKVDKESERCVTKKEGIEFAREYGCLFLECSAKTKVNVEQCFEELVLKILDTPSLLADASSGAKKNIFKQKPPEADAAASSCC

SEQ ID NO: 11889 - DNA, 621 bp, Sorghum bicolor
  misc_feature: Ceres ANNOT ID no. 6037848
  misc_feature: Encodes the peptide sequence at SEQ ID NO 11890
atggccgtggggggccttctgcggggtctcgtttcgccggcggggggagccgccgcctggctgccctgccacgagctcttcgcctcctggcaccactggctcccctcgctcccgcgcctccgcccgcccgcatccgacggattcaagcttctcttcgtgctcctgctcttctccgccgctctggccgaggtccgctacatcgcctcctcctccatggcgccaacgctccgaccaggcgaccgagccgtcgccgagaaggttacatacttgttccggaggccatctattggggatatagtgtttttcaaagtgccttctgccgtacagaattatggtgtcaataaggatgttgtctttattaagagagtattggcaacacctggagatttcattgaggttcgacaagggcagcttattgtaaatggtattgcactgaaggagcattacacagcaacccatgcgttgtacacaatggaagcaatgcgccttcctgaaggtcatgtattcgtcatgggtgacaaccgaaataacagctgtgattctcgtgcctgggggcctcttcccattgccaacatcgttggaaggtacatgacgtcctttacaagatcctctttccagtaa

SEQ ID NO: 11890 - protein, 206 aa, Sorghum bicolor
  misc_feature: Ceres ANNOT ID no. 6037848
  misc_feature (66)..(143): Pfam Id: Peptidase_S24 Pfam Desc: Peptidase S24-like
  misc_feature (48)..(195): NCBI GI: 144924728 NCBI Desc: peptidase s26a, signal peptidase i [medicago truncatula]
  misc_feature (48)..(195): NCBI GI: 51536582 NCBI Desc: at1g05140 [arabidopsis thaliana]
  misc_feature (51)..(200): NCBI GI: 75907154 NCBI Desc: peptidase s26a, signal peptidase i [anabaena variabilis atcc 29413]
  misc_feature (74)..(197): NCBI GI: 71535009 NCBI Desc: chloroplast thylakoidal processing peptidase [medicago sativa]
  misc_feature (50)..(200): NCBI GI: 67922441 NCBI Desc: signal peptidase i [crocosphaera watsonii wh 8501]
MAVGGLLRGLVSPAGGAAAWLPCHELFASWHHWLPSLPRLRPPASDGFKLLFVLLLFSAALAEVRYIASSSMAPTLRPGDRAVAEKVTYLFRRPSIGDIVFFKVPSAVQNYGVNKDVVFIKRVLATPGDFIEVRQGQLIVNGIALKEHYTATHALYTMEAMRLPEGHVFVMGDNRNNSCDSRAWGPLPIANIVGRYMTSFTRSSFQ

SEQ ID NO: 11891 - DNA, 1662 bp, Sorghum bicolor
  misc_feature: Ceres ANNOT ID no. 6037860
  misc_feature: Encodes the peptide sequence at SEQ ID NO 11892
atgcgtgccgccatggcggcggcggccctccgacccaccgccgccaccctccgcttcctcttcaccccacctcaccagcgccgccgcctcttggtcgaacacctcccctttgctcgccgacgccgccactcctccaccgccacggcccctgcgctggaggactccagccccagcaatggcgaaggcaaggccgcccgccgccgccgcgcccgcgaatcccccgagggcctcctccgtcaccagctcgacatgtgctcccgcaacgccgacctcaccaccgcgctccgcctctacgacgacgccctctccccggacacccccgtcccgctctccctccaccactacaactgcctgctctacctctgctccaacgccgccgctaccgacactgacaccgatagctccaccgccgccgcccagcgcggcttcgacatcttcgccaggatggaggccgacggcgtccagcccaacgaggccaccctcaccagcgtcgcgcgcctcgccgccgccacccgcgaccccgccatggccttctccgtcgtccgccgcatggccgctgcgggcaccccgccgcgcctccgctcctacggcccggccctcttcgcctactgcgacgccaaagacgccgacggcgccaagcaggtcgaggcccacatggacgcctctggcgtcgtgcccgaggagcccgagctcgccgcgttgctccgcgtcaatgcggacaagggcaaggccgatgaggtttacaggctcctgcacaggacgcgcgccctcgtcaggcaggtctgcgacacgaccgcccaggtcgtcgaggcctggttccggtcggacgcagcgtcccaggcgggggtggacaagtgggatcccagcaaggtcaaggagggcgtcgtcaagggcggcggcggctggcatggccagggatggcttggcaagggggcatggagcgttggctggaccgagatggacaaggatgggacatgccaacgctgtggggagaagcttgtctgcatagacattgatccatcggagactgacaactttgcaaattcgctcaccgaacttgccatcaagcgtgaggtcaaggaagacttcctcgggttccagaactggctacgtcgccatggaccattcgatgctgttatagacgctgctaatgtaggcctttacaatagtaaagctttcagtttttcacaggttaactctgttgtaaatgctatacagagagtaactaagtcaaagaagttgccactgatcattttgcataggaaccgtgtaaatggtggtcctgcaaaggctccatacaaccagaagattctggagagttggaggaatgctggagctctgtatgcgacccctcctggttccaatgatgattggtactggttgtatgcagctgtcagttgccgatcgttgcttgttacaaatgatgagatgcgagaccacttgtttcaactgcttggcactagttttttccctaggtggaaagagaaacatcaggtcagactaactttctccgggcgtggccctacccttcacttgccacctccctattcaattgttattcaggaatctgaagatggaagctggcatgtaccaacaacaacaggtgatgatatagaaaagccacggcagtggatgtgcactactagaaaatcttcgaagtag

SEQ ID NO: 11892 - protein, 553 aa, Sorghum bicolor
  misc_feature: Ceres ANNOT ID no. 6037860
  misc_feature (27)..(552): NCBI GI: 51536606 NCBI Desc: at2g32230 [arabidopsis thaliana]
  misc_feature (184)..(552): NCBI GI: 115461538 NCBI Desc: os04g0692500 [oryza sativa (japonica cultivar-group)]
  misc_feature (35)..(553): NCBI GI: 92872159 NCBI Desc: tetratricopeptide-like helical [medicago truncatula]
  misc_feature (184)..(498): NCBI GI: 38567837 NCBI Desc: osjnbb0020j19.15 [oryza sativa (japonica cultivar-group)]
  misc_feature (138)..(549): NCBI GI: 144924739 NCBI Desc: tetratricopeptide-like helical [medicago truncatula]
MRAAMAAAALRPTAATLRFLFTPPHQRRRLLVEHLPFARRRRHSSTATAPALEDSSPSNGEGKAARRRRARESPEGLLRHQLDMCSRNADLTTALRLYDDALSPDTPVPLSLHHYNCLLYLCSNAAATDTDTDSSTAAAQRGFDIFARMEADGVQPNEATLTSVARLAAATRDPAMAFSVVRRMAAAGTPPRLRSYGPALFAYCDAKDADGAKQVEAHMDASGVVPEEPELAALLRVNADKGKADEVYRLLHRTRALVRQVCDTTAQVVEAWFRSDAASQAGVDKWDPSKVKEGVVKGGGGWHGQGWLGKGAWSVGWTEMDKDGTCQRCGEKLVCIDIDPSETDNFANSLTELAIKREVKEDFLGFQNWLRRHGPFDAVIDAANVGLYNSKAFSFSQVNSVVNAIQRVTKSKKLPLIILHRNRVNGGPAKAPYNQKILESWRNAGALYATPPGSNDDWYWLYAAVSCRSLLVTNDEMRDHLFQLLGTSFFPRWKEKHQVRLTFSGRGPTLHLPPPYSIVIQESEDGSWHVPTTTGDDIEKPRQWMCTTRKSSK

SEQ ID NO: 11893 - DNA, 1125 bp, Sorghum bicolor
  misc_feature: Ceres ANNOT ID no. 6037862
  misc_feature: Encodes the peptide sequence at SEQ ID NO 11894
atgggcctcaaggagcagcatccgcagctcgaccaaactgagagagatgccatcaactcacccgcttcttctgttcctaacgacgaccaccaccagggaccgggcatcccccgtgtctcaagctgcagcaccgacaacgattctggccttccactttgccgagtctgtcattgcgtcgaacccgatctgagaggcgagtccgccctcgggttcttgggaatcgcgccgccttcccctcccaggactgacactgactccatcaccacatcgtccaccagcaaggatgccatcactgggccaaaggatgacgccaccgccaccggtggcggtgcttccagttttgttgagtttgtaagccccgagggggagatattcgtgtgcgccactgacgtcgaatcggggcccctgcaccagcaagaccatcttgtggatctaggttgttcttgcaagaacgaccttgcccttgcgcattatgcttgtgcgttgaagtggttcgtcagccatggatccaccacgtgcgagatatgtggaactgttgccgcaaatgtaaggcctcaggatttcaacaaggttctcgcgtccctcaaggattatgaagctctcagggaaaggacatccactggggaaatctcatacttgcagcatgggccagatactggtgttgatccagacgctgtcgcggcaatacgaaggcagcggcttagcgagatctcatcttggttcaatcctcacaactctcacgtgcctgttgcccaaggccacattgatcaacctcagccgccacttagtccaaccaataattatgttctggagcataatgttgtggcggcgatgccagtacatacaagatggagtttggagagcactggagtttttgttgctacctgcctagttgtcattattcttgcatggttggttgctccacatgttggcaagaaagctgctgtaatctgtcttcatatgcttcttggaggtttatgcgtattgactgtagtaatatccctgagatttgttttcccaagaatccagtatgggtctatgcaatattgggcaatcttgttcgtgtcctggttccttgtgtttggtgtttgggcttcacgaacacgcagcgcacgctcctcatga

SEQ ID NO: 11894 - protein, 374 aa, Sorghum bicolor
  misc_feature: Ceres ANNOT ID no. 6037862
  misc_feature (53)..(176): Pfam Id: zf-C3HC4 Pfam Desc: Zinc finger, C3HC4 type (RING finger)
  misc_feature (37)..(374): NCBI GI: 115461534 NCBI Desc: os04g0692300 [oryza sativa (japonica cultivar-group)]
  misc_feature (40)..(374): NCBI GI: 140069449 NCBI Desc: zinc finger, ring-type [medicago truncatula]
  misc_feature (20)..(374): NCBI GI: 16209722 NCBI Desc: at5g63780/mbk5_26 [arabidopsis thaliana]
  misc_feature (20)..(374): NCBI GI: 145334333 NCBI Desc: zinc finger (c3hc4-type ring finger) family protein [arabidopsis thaliana]
  misc_feature (128)..(186): NCBI GI: 117667936 NCBI Desc: zinc finger protein [brassica rapa]
  misc_feature: Useful for making plants with modulated nitrogen use efficiency
  misc_feature: GREAT-hit functional homolog of the protein sequence given in SEQ ID NO 13168
MGLKEQHPQLDQTERDAINSPASSVPNDDHHQGPGIPRVSSCSTDNDSGLPLCRVCHCVEPDLRGESALGFLGIAPPSPPRTDTDSITTSSTSKDAITGPKDDATATGGGASSFVEFVSPEGEIFVCATDVESGPLHQQDHLVDLGCSCKNDLALAHYACALKWFVSHGSTTCEICGTVAANVRPQDFNKVLASLKDYEALRERTSTGEISYLQHGPDTGVDPDAVAAIRRQRLSEISSWFNPHNSHVPVAQGHIDQPQPPLSPTNNYVLEHNVVAAMPVHTRWSLESTGVFVATCLVVIILAWLVAPHVGKKAAVICLHMLLGGLCVLTVVISLRFVFPRIQYGSMQYWAILFVSWFLVFGVWASRTRSARSS

SEQ ID NO: 11895 - DNA, 1494 bp, Sorghum bicolor
  misc_feature: Ceres ANNOT ID no. 6037870
  misc_feature: Encodes the peptide sequence at SEQ ID NO 11896
atgaagagtagtagatttctgttcctttgtgcaatgttctgtcttatggctcggctgggagctgccaatgtcgtgctaatggggaataatctgaccctgtccttcgatgacattgaggcgagcttttctccaggagtgaaagggtctggagtcagtggagtagtttatgcttctgaacctttgaatgcctgcagcccattaacaatcaaaacagtcaatggccctccatctccctttgcgttaattataagaggcgggtgcacatttgatgagaaagtaaaaaatgcacaggatgctggattcaaagctgcaatcgtatacgacaataaaaatagtggggtcctggtttcaatggctggaagctcaagtggcattcatatatatgccgtgttcgtttcaaaggcctcgggagaggtgttgaagaaattctcaggcaatatggatgtagaggtgtggatactacctacttttgagaactcagcctggtcgatcatggcaatctcattcgtatcgctacttgccatgtgtgctgtactgggtacgtgtttctttgtgagaaggcatcgaataaggagggagcaccctagaatcgcagaagatcgagaattccatggaatgagcagtcagttagttaaggctattccaagtcttatttttacaaaagtgcaagaagataactgcacatcttcaatgtgtgccatttgcttggcagactacaatgtcggagaaaagctaagagtgctgccttgccgtcacacttgtgtggacttgtggctgacttcttggcgaacattctgtcctatatgcaagagagatgcaaggagtggagcatcagaagttgttgcgacagaggctacccccttgctttcttctgctgctcggttaccttcattccggtcgagtgtggcagcatcccctccaaggccaataagccggcatccttcatcgcactcggtttctcgtgcttactctgtttctagtacccccaattctcccaacccctttatatcttctcacataagctcacctggcatccgtgcaagcagaagcatcacagaccttggaaatatatcatctctccatcctcgcatctcacatttgtcatcgacgcactccctggttggcagccacttgtctccaccaatcagtataaggtattggtcgtcccatgtggcgcattcagggtatggatcacccagtccacacgtgagttcatcctacatctccaattctgggtatggttcttcaagctactgctatctgggactgggaggctccagccacagccagcatgggacatacctaaggcgctgtggagaatcggggccaagcctgtgtaccatggtgccgcagcagttgcagtgggagactaatgtagcagcaggtgcgtcgtcagcaaagtccctgcggcagtcctcctacctgagacactgtggcgattcagacgccagtttgtctgacatgacgtcagcccagtcgttgccgaggtgctga

SEQ ID NO: 11896 - protein, 497 aa, Sorghum bicolor
  misc_feature: Ceres ANNOT ID no. 6037870
  misc_feature (45)..(144): Pfam Id: PA Pfam Desc: PA domain
  misc_feature (232)..(269): Pfam Id: zf-C3HC4 Pfam Desc: Zinc finger, C3HC4 type (RING finger)
  misc_feature (7)..(410): NCBI GI: 6942149 NCBI Desc: remembr-h2 protein jr702 [arabidopsis thaliana]
  misc_feature (12)..(429): NCBI GI: 15219930 NCBI Desc: protease-associated zinc finger (c3hc4-type ring finger) family protein [arabidopsis thaliana]
  misc_feature (15)..(300): NCBI GI: 42562538 NCBI Desc: protease-associated zinc finger (c3hc4-type ring finger) family protein [arabidopsis thaliana]
  misc_feature (15)..(300): NCBI GI: 8778343 NCBI Desc: f15o4.19 [arabidopsis thaliana]
  misc_feature (43)..(290): NCBI GI: 15219668 NCBI Desc: protease-associated zinc finger (c3hc4-type ring finger) family protein [arabidopsis thaliana]
  misc_feature: The sequence is a functional homolog of SEQ ID NO. 329 in the 11/188,298 US application
MKSSRFLFLCAMFCLMARLGAANVVLMGNNLTLSFDDIEASFSPGVKGSGVSGVVYASEPLNACSPLTIKTVNGPPSPFALIIRGGCTFDEKVKNAQDAGFKAAIVYDNKNSGVLVSMAGSSSGIHIYAVFVSKASGEVLKKFSGNMDVEVWILPTFENSAWSIMAISFVSLLAMCAVLGTCFFVRRHRIRREHPRIAEDREFHGMSSQLVKAIPSLIFTKVQEDNCTSSMCAICLADYNVGEKLRVLPCRHTCVDLWLTSWRTFCPICKRDARSGASEVVATEATPLLSSAARLPSFRSSVAASPPRPISRHPSSHSVSRAYSVSSTPNSPNPFISSHISSPGIRASRSITDLGNISSLHPRISHLSSTHSLVGSHLSPPISIRYWSSHVAHSGYGSPSPHVSSSYISNSGYGSSSYCYLGLGGSSHSQHGTYLRRCGESGPSLCTMVPQQLQWETNVAAGASSAKSLRQSSYLRHCGDSDASLSDMTSAQSLPRC

SEQ ID NO: 11897 - DNA, 891 bp, Sorghum bicolor
  misc_feature: Ceres ANNOT ID no. 6037876
  misc_feature: Encodes the peptide sequence at SEQ ID NO 11898
atggatcagcaggaggagtcttgtgttcccccaggcttcaggttccaccctacagaggaagagctggtgggatactaccttgccaggaaggtggcctcccagaagatcgacctcgacatcatccaggaggtcgatctctacaggatagagccatgggatctgcaagagcggtgcaggcagcacgccggcggtgggcacgacgagcagacgacggagtggtacttcttcagctacaaggaccgcaagtaccccagcgggacgaggaccaaccgcgccacggcggccggattctggaaggccaccggcagggacaagccggtgctgtcgtcgtcgtgcaccaggaccagcaggtgcggcggcggcagcagggtcgtcatcggcatgaggaagacgctggtgttttacaagggcagggcccccaacggcaggaagagcgactggatcatgcacgagtaccgactccaatccaacgagcacgcacccgcgcaggaggaaggctgggtggtgtgccgcgcattccagaagcctatccccaaccagcagaggcccttcttccccaccagctacggcgccggcctgctcagcagcttcccgccttcttcgttatactctgacgacgacttggagtccaagaaacatctgttcagtatgccgccgctggagagccccactgccgccatagcctgctgttctgatggcggcggcggcggctacgctccagctactacgcagagaagcagctacgatgaacatgagctgatgatccaacaggaaggaggagaaggagagcaagctgcagccgctgccggcgccatcgactggaactttctggacagcctgctgtccgcgacgtcgcaactccatgggccctcgggatccttgttgcagtga

SEQ ID NO: 11898 - protein, 296 aa, Sorghum bicolor
  misc_feature: Ceres ANNOT ID no. 6037876
  misc_feature (9)..(155): Pfam Id: NAM Pfam Desc: No apical meristem (NAM) protein
  misc_feature (4)..(289): NCBI GI: 55733771 NCBI Desc: at5g66300 [arabidopsis thaliana]
  misc_feature (1)..(180): NCBI GI: 124360182 NCBI Desc: no apical meristem (nam) protein [medicago truncatula]
  misc_feature (3)..(176): NCBI GI: 32487489 NCBI Desc: osjnbb0020j19.3 [oryza sativa (japonica cultivar-group)]
  misc_feature (7)..(177): NCBI GI: 6630463 NCBI Desc: f23n19.6 [arabidopsis thaliana]
  misc_feature (9)..(159): NCBI GI: 7715611 NCBI Desc: f20b17.1 [arabidopsis thaliana]
  misc_feature: The plant produces a reduced number of seeds.
  misc_feature: The sequence is a functional homolog of SEQ ID NO 1270 in the 10/374,780US patent application
  misc_feature: The sequence is a functional homolog of SEQ ID NO 1378 in the 10/666,642US patent application
  misc_feature: The sequence is a functional homolog of SEQ ID NO 142 in the 10/412,699US patent application
  misc_feature: The sequence is a functional homolog of SEQ ID NO 1423 in the 10/412,699US patent application
  misc_feature: The sequence is a functional homolog of SEQ ID NO 1750 in the 10/412,699US patent application
  misc_feature: The sequence is a functional homolog of SEQ ID NO 286 in the 11/435,388US patent application
  misc_feature: The sequence is a functional homolog of SEQ ID NO 288 in the 10/714,887US patent application
  misc_feature: The sequence is a functional homolog of SEQ ID NO 333 in the 11/479,226US patent application
  misc_feature: The sequence is a functional homolog of SEQ ID NO 38 in the 10/374,780US patent application
  misc_feature: The sequence is a functional homolog of SEQ ID NO 54 in the 10/225,068US patent application
  misc_feature: The sequence is a functional homolog of SEQ ID NO 586 in the 10/225,066US patent application
  misc_feature: The sequence is a functional homolog of SEQ ID NO 898 in the 10/666,642US patent application
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 12949
  misc_feature: The sequence is a functional homolog of SEQ ID NO 142 in the 20040045049 US patent application
  misc_feature: The sequence is a functional homolog of SEQ ID NO 1423 in the 20040045049 US patent application
  misc_feature: Useful for making plants with altered carbohydrate content
  misc_feature: Functional homolog of the protein sequence given in SEQ ID NO 13685
  misc_feature: Useful for making plants with altered cell wall content and/or composition
  misc_feature: Functional homolog of the protein sequence given in SEQ ID NO 13703
  misc_feature: Useful for biocontainment applications
  misc_feature: Functional homolog of the protein sequence given in SEQ ID NO 13623
  misc_feature: The sequence is a functional homolog of SEQ ID NO 854 in the 10/374,780 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Useful for making plants with altered lignin content
  misc_feature: Functional homolog of the protein sequence given in SEQ ID NO 13620
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MDQQEESCVPPGFRFHPTEEELVGYYLARKVASQKIDLDIIQEVDLYRIEPWDLQERCRQHAGGGHDEQTTEWYFFSYKDRKYPSGTRTNRATAAGFWKATGRDKPVLSSSCTRTSRCGGGSRVVIGMRKTLVFYKGRAPNGRKSDWIMHEYRLQSNEHAPAQEEGWVVCRAFQKPIPNQQRPFFPTSYGAGLLSSFPPSSLYSDDDLESKKHLFSMPPLESPTAAIACCSDGGGGGYAPATTQRSSYDEHELMIQQEGGEGEQAAAAAGAIDWNFLDSLLSATSQLHGPSGSLLQ

SEQ ID NO: 11899 - DNA, 1440 bp, Sorghum bicolor
  misc_feature: Ceres ANNOT ID no. 6037882
  misc_feature: Encodes the peptide sequence at SEQ ID NO 11900
atgggcaacatgacccgctcagactcgcccgtctcccgccgcatcgtcctctccttcctcgacttcctcaactccgtcgagttagctcctggggttgatcctgaagctcttgaagttgctaaggattgcctggagtccatttttagtgttaactcatcagccactcgtgaggcgatacagccaggactgttgcttgagctatttgcttctctggaagcaaatgaaagagaccgggcaagagctgctttgctgtcacaatctgtatcaaacaagccatctcaaaatgcgggtacatctaatgtcgaagaagacccaaacaaatgcacaacatcagatagtgacagtcagatggaggatacatttgacctagatcattcaggggatgaactatttgcaaaattttatgctgcacttgatgaaatcaatttctttaagacatcacctgctggagctgaagatcctggcctactttcaaaagcaacacaatactttaatgatgcattactggcgatgcagaagtcaggaacgaaaaaggcaagcttagtagaccttgcagagtcctttaaatcaagaggtaatgaattcatgagatcaaaccaacaccttaaagcggtagagctgtacacctgtgccattgcattgaacaaaaaaaatgccatttactattgcaacagggctgctgcatatacccttcttaatatgaacaatgaagctattgaggactgcctgaagtcaattgaaattgaccctagctacagcaaagcatatagccgacttggatctgcttattttgctatggggaattatcatgatgctctgtacaagggatacttgaaagccgctgagcttgatcctagtaatgaaaatgtcaggcagaatattgaggtcgcaaaaaagaaactggctgaacaacgagtcccaccagaagggcagaacacacatgcacgccaagctcaaggaccacatccagtatttacaagtagtggtgttcctttcaatctgtttccaccaggtagttctccaggtcaagaattcttcgctggctggtcatctgatattggtgcaccaccaccaggacattccataagtataaatttgaatgacatttttggtcaagcaagtgtcaatgctggcggtcaaggatcaagtcaaacagggaattcaaataaccatactccacctgcttcgttcccaactggtgctgctgttcctcccccctttgccttctcgggctcaggcaatgaaggaactcaggcacgccaagcttctaatggacatgaaggggaacatggtgaaccaggcgtacacagggatgatggcatccatataaatgtggctggagctagacccgagcaggctgcggaggctttgagagctgtgatgcaaatgcttgggccacacatgactccacatgaaggtgcacctagaggaccaggttaa

SEQ ID NO: 11900 - protein, 479 aa, Sorghum bicolor
  misc_feature: Ceres ANNOT ID no. 6037882
  misc_feature (185)..(218): Pfam Id: TPR_1 Pfam Desc: Tetratricopeptide repeat
  misc_feature (219)..(252): Pfam Id: TPR_1 Pfam Desc: Tetratricopeptide repeat
  misc_feature (253)..(287): Pfam Id: TPR_1 Pfam Desc: Tetratricopeptide repeat
  misc_feature (219)..(252): Pfam Id: TPR_2 Pfam Desc: Tetratricopeptide repeat
  misc_feature (113)..(479): NCBI GI: 5777615 NCBI Desc: caa30373.1 protein [oryza sativa]
  misc_feature (113)..(475): NCBI GI: 116311992 NCBI Desc: h0814g11.17 [oryza sativa (indica cultivar-group)]
  misc_feature (113)..(358): NCBI GI: 38345522 NCBI Desc: osjnba0039k24.25 [oryza sativa (japonica cultivar-group)]
  misc_feature (3)..(472): NCBI GI: 140052254 NCBI Desc: tpr repeat [medicago truncatula]
  misc_feature (1)..(428): NCBI GI: 42566332 NCBI Desc: tetratricopeptide repeat (tpr)-containing protein [arabidopsis thaliana]
  misc_feature: The sequence is a functional homolog of SEQ ID NO. 298 in the 11/188,298 US application
MGNMTRSDSPVSRRIVLSFLDFLNSVELAPGVDPEALEVAKDCLESIFSVNSSATREAIQPGLLLELFASLEANERDRARAALLSQSVSNKPSQNAGTSNVEEDPNKCTTSDSDSQMEDTFDLDHSGDELFAKFYAALDEINFFKTSPAGAEDPGLLSKATQYFNDALLAMQKSGTKKASLVDLAESFKSRGNEFMRSNQHLKAVELYTCAIALNKKNAIYYCNRAAAYTLLNMNNEAIEDCLKSIEIDPSYSKAYSRLGSAYFAMGNYHDALYKGYLKAAELDPSNENVRQNIEVAKKKLAEQRVPPEGQNTHARQAQGPHPVFTSSGVPFNLFPPGSSPGQEFFAGWSSDIGAPPPGHSISINLNDIFGQASVNAGGQGSSQTGNSNNHTPPASFPTGAAVPPPFAFSGSGNEGTQARQASNGHEGEHGEPGVHRDDGIHINVAGARPEQAAEALRAVMQMLGPHMTPHEGAPRGPG

SEQ ID NO: 11901 - DNA, 1185 bp, Sorghum bicolor
  misc_feature: Ceres ANNOT ID no. 6037898
  misc_feature: Encodes the peptide sequence at SEQ ID NO 11902
atggggggcggcggcggcggcggatgcgatgtggcgaagccggtggcggcgatggtggcgattcaggtgatgtctgcgggcgtgaacatattctacaagctggcggtgtcggacggcatggacatgagggtgctcgtcgcctaccgctacctcttcgcctccgccttcctcgcgccactcgcctacttcatagagaggaacagacggacaaagttgacgtggagagtgttggtgatgtctttcatatgtggcctcagcgagggctcgctggcgcagaacctgtacatctccggcatgaagctgacctcggccaccttcgcctccgccaccaccaacctcatcccgggggtcaccttcgtgctggcgctcatcttccgctacgagggactcgccatccgcgccgcctcgggccaggccaaggtggccggcaccctgctgggcgtcgccggcgccatgctgctcaccttctacaagggcgccgacatcacaccgtggcacagccacgtcaacctcgcccgcgccggcgccggcgccgtgcaccaccacccgccgccggatgatgatcaggccgccaaccgcgtgatgggctcgctgctgtgcatcagcagctgcgtcttctacgcgctctggctcatcctgcaggccaagctcagcaaggagtacccgttccactactccagcacggcgctcatgtgcgtgatgagcacgctgcagtccgtggccttggcgctgatctggagtcgccacgacgtcgtcgcgcagtggcggctgggcctcgacgtccgcctgctctccgtcgcctactcgggcgtcctggcctcgggcgtcatgctcgtcgtgctgtcctggtgcgtcaagaagcggggacctctgttcgcgtccgtcttcaacccgctcatgctgctggtggtggccgtcctcagctcgctgctgctgggcgagaagctctacctcggcagcgcgctcggcgccgtgctcatcgtcctggggctctacgccgtgctctgggggaagggccgagaggacgtcaccaccaccaaggtcagcgagctgcccctgcccatcgtcactacttctgacgacgacgacgacggcgccaccaccgtcgacgtcgtcgtcgtgcagacgtccgatcacgattccaccaagcagcagcagcagcagcagcagcggacgacgagatga

SEQ ID NO: 11902 - protein, 394 aa, Sorghum bicolor
  misc_feature: Ceres ANNOT ID no. 6037898
  misc_feature (196)..(336): Pfam Id: TPT Pfam Desc: Triose-phosphate Transporter family
  misc_feature (4)..(389): NCBI GI: 90399021 NCBI Desc: h0701f11.7 [oryza sativa (indica cultivar-group)]
  misc_feature (4)..(389): NCBI GI: 38345836 NCBI Desc: osjnba0070m12.19 [oryza sativa (japonica cultivar-group)]
  misc_feature (85)..(389): NCBI GI: 5777632 NCBI Desc: caa303720.1 protein [oryza sativa]
  misc_feature (99)..(389): NCBI GI: 38345504 NCBI Desc: osjnba0039k24.1 [oryza sativa (japonica cultivar-group)]
  misc_feature (8)..(362): NCBI GI: 116309896 NCBI Desc: h0525e10.16 [oryza sativa (indica cultivar-group)]
MGGGGGGGCDVAKPVAAMVAIQVMSAGVNIFYKLAVSDGMDMRVLVAYRYLFASAFLAPLAYFIERNRRTKLTWRVLVMSFICGLSEGSLAQNLYISGMKLTSATFASATTNLIPGVTFVLALIFRYEGLAIRAASGQAKVAGTLLGVAGAMLLTFYKGADITPWHSHVNLARAGAGAVHHHPPPDDDQAANRVMGSLLCISSCVFYALWLILQAKLSKEYPFHYSSTALMCVMSTLQSVALALIWSRHDVVAQWRLGLDVRLLSVAYSGVLASGVMLVVLSWCVKKRGPLFASVFNPLMLLVVAVLSSLLLGEKLYLGSALGAVLIVLGLYAVLWGKGREDVTTTKVSELPLPIVTTSDDDDDGATTVDVVVVQTSDHDSTKQQQQQQQRTTR

SEQ ID NO: 11903 - DNA, 1473 bp, Sorghum bicolor
  misc_feature: Ceres ANNOT ID no. 6037985
  misc_feature: Encodes the peptide sequence at SEQ ID NO 11904
atgcctgagagggaagaagcacctgtacctccaccagattcaccacgtgaggaggaggacgccgccgccgccgccgtcccagttgcttccgttgcctcttcctccttcggctccgatcacaaggaagacagcggctccaggcagaccaaggcctccatcctgtccggcgtcttcacgcccccttttgccttattcgagggccagcagcaggagcaggactcgtcgtcgtcgtcgccggcgtgcgacgccatatcgacaaagtcgtcctcagggtcctatgcttggtctaggattctgaggaggttcgtaggcagcagctcgatgtggcgtcttctgggctgcgccaaggttctgacctccagtgatgtgtggttccttggtaaatgctacaaggtgtcacctgaggaagaggagtctggcgacggccatgctgcgtttctggaagatttctcttccaagatatggatcacctaccggaaaggctttgatgcaatatctgattccaagctgactagtgatgtgaactggggatgcatggttagaagcagtcagatgctggttgctcaggcactgatttttcaccatcttggaagatcttggagaaagcccccggagaagccatacaacccagattatataggggtcttacacctatttggtgattctgaagcttgtgctttctctattcacaatttacttcaagctggaaggaattatggtctggctgctggatcatgggtgggtccatatgctatgtgccgggcatggcagacccttatccgcacaaatagagagcaagctggtgctgtcaatgggaaggaaaatttccctatgattctttatgtggtttcgggtgatgaagatggtgaaagaggtggagctccagttgtttgcatcgatgttgctgctcagctttgctctgatttcaacaaagaacaatctacatggtcacctattcttttgttagttcctctggttcttggcctcgacaaaattaatccaaggtacatcccattactaaaggagacgtttacgttcccacaaagcttgggcattttaggtggaaaacctgggacgtcaacatacattgctggcgtacaggatgatagggccctctacctagatccccacgacgttcagatggcagttgacattgcaccggataacttggaggcagacacttcgtcgtaccactgcagtgttgtccgagatttggctctagaacaaatagatccctccctggctattggtttttactgtcgtgacaaagacgactttgatgatttctgttctcgggcctctgagttggcagaaaaggccaatggagcgccactctttactgttgtgcagtcaatcgagccattgaagcaaatgtataaacaagatgatgggctgggctgttctggcagtagcatgggcaacgacgatgaccttgatggctctggagaagcagaggagtggcagatcctctaa

SEQ ID NO: 11904 - protein, 490 aa, Sorghum bicolor
  misc_feature: Ceres ANNOT ID no. 6037985
  misc_feature (140)..(434): Pfam Id: Peptidase_C54 Pfam Desc: Peptidase family C54
  misc_feature (30)..(490): NCBI GI: 82470053 NCBI Desc: autophagy 4 [oryza sativa (indica cultivar-group)]
  misc_feature (30)..(490): NCBI GI: 32488637 NCBI Desc: osjnba0032f06.13 [oryza sativa (japonica cultivar-group)]
  misc_feature (30)..(490): NCBI GI: 115461386 NCBI Desc: os04g0682000 [oryza sativa (japonica cultivar-group)]
  misc_feature (7)..(490): NCBI GI: 115453357 NCBI Desc: os03g0391000 [oryza sativa (japonica cultivar-group)]
  misc_feature (32)..(490): NCBI GI: 124359485 NCBI Desc: peptidase c54 [medicago truncatula]
MPEREEAPVPPPDSPREEEDAAAAAVPVASVASSSFGSDHKEDSGSRQTKASILSGVFTPPFALFEGQQQEQDSSSSSPACDAISTKSSSGSYAWSRILRRFVGSSSMWRLLGCAKVLTSSDVWFLGKCYKVSPEEEESGDGHAAFLEDFSSKIWITYRKGFDAISDSKLTSDVNWGCMVRSSQMLVAQALIFHHLGRSWRKPPEKPYNPDYIGVLHLFGDSEACAFSIHNLLQAGRNYGLAAGSWVGPYAMCRAWQTLIRTNREQAGAVNGKENFPMILYVVSGDEDGERGGAPVVCIDVAAQLCSDFNKEQSTWSPILLLVPLVLGLDKINPRYIPLLKETFTFPQSLGILGGKPGTSTYIAGVQDDRALYLDPHDVQMAVDIAPDNLEADTSSYHCSVVRDLALEQIDPSLAIGFYCRDKDDFDDFCSRASELAEKANGAPLFTVVQSIEPLKQMYKQDDGLGCSGSSMGNDDDLDGSGEAEEWQIL

SEQ ID NO: 11905 - DNA, 594 bp, Sorghum bicolor
  misc_feature: Ceres ANNOT ID no. 6037992
  misc_feature: Encodes the peptide sequence at SEQ ID NO 11906
atgtacgggaggcgtgcatcgcagctgctgaaggagatcgactcctctgaggctggccagctcgcgccattcaacactgacgtgtttgatcaggtgattagagagtgcaatgagcacaactcacagtttcaatcattgatcaggaaaatggttgagcaaaacttagacatcgagacaactagaaatgaggatcactatggtgcagctatccaccatctttccctgctccgtaacaaaagatgcctgatggcttacatgtacaaccgagcagaagttattcagagttttagatggaaggttggtcctgtgcttcctcacgacatacaagaaaagctccatttctcagagaaagagtacttcaagaaccactctgcagccattaaatcatacatttcagagatggatatagatttgacagtggatatggttcctcccaaggatccttacattcaggttcgggtgctggaggacattggcgaagtatctcttggtgaccattctgtctcattgaccaagaactcactccatttcctaaggcgcacagacgctgaacaatttatatcacagggtcttatggaagaatttctggagtag

SEQ ID NO: 11906 - protein, 197 aa, Sorghum bicolor
  misc_feature: Ceres ANNOT ID no. 6037992
  misc_feature (1)..(195): Pfam Id: Psf1 Pfam Desc: Partner of SLD five, PSF1
  misc_feature (1)..(194): NCBI GI: 92898747 NCBI Desc: gins complex, psf1 component [medicago truncatula]
  misc_feature (1)..(94): NCBI GI: 115464235 NCBI Desc: os05g0453900 [oryza sativa (japonica cultivar-group)]
  misc_feature (1)..(196): NCBI GI: 40788899 NCBI Desc: kiaa0186 [homo sapiens]
  misc_feature (1)..(196): NCBI GI: 15214812 NCBI Desc: kiaa0186 protein [homo sapiens]
  misc_feature (1)..(196): NCBI GI: 49115013 NCBI Desc: mgc80254 protein [xenopus laevis]
MYGRRASQLLKEIDSSEAGQLAPFNTDVFDQVIRECNEHNSQFQSLIRKMVEQNLDIETTRNEDHYGAAIHHLSLLRNKRCLMAYMYNRAEVIQSFRWKVGPVLPHDIQEKLHFSEKEYFKNHSAAIKSYISEMDIDLTVDMVPPKDPYIQVRVLEDIGEVSLGDHSVSLTKNSLHFLRRTDAEQFISQGLMEEFLE

SEQ ID NO: 11907 - DNA, 1494 bp, Sorghum bicolor
  misc_feature: Ceres ANNOT ID no. 6037998
  misc_feature: Encodes the peptide sequence at SEQ ID NO 11908
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
atggtggcgtcggccaagggacggctcgtgtccgtgctcgcggtggcggcggcgctcgcggccgtgctcctctaccgcgcccccttctccaagagcttgggcggcgaagggtgcagcctcctcccgcacgaccacttctgggtcgccagcgaccgcgtcgtcacgctcggccgcgtcggccccgccgcagtggaggtcaaaggagggctcatcaacgccatcgcggtcggggactaccggagcttcgtgctccgccgtcctctcctggactacggggacgccgtcatcatgcccggcctcatcgacgtgcatgcccatctcgacgagcctggacgtgccgagtgggagggcttctctactggtacaagagcagctgcggcaggcgggataacgacgttggtggatatgccactcaacagcttcccgtcgacagtctctgaagaaactctcaaactgaagctggaagcagctcaagataagctatatgttgatgttgggttctggggaggacttgtgccagagaacgccttcaacccaagtgctttggagggcctcctaaatgcaggcgttttaggactcaagtcttttatgtgcccctcaggcatcaacgacttccccatgacaaattcaactcatattgaggaaggattggttacactggcaaaatacaagagacctttacttatccatgcagaacgtatacctgaggctgaggatgatgatatgcgagaggatgaactagatcctcgatcctatatgacggaggaatcagctatcagagatctacaccgtgcaatgaaggatacggagtcggggggtcggtccgaaggagctcatattcacattgttcatctatcagatgcaaaaacttccttggaacttatgaaggatgctaaacgcagtggtgcaagtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaatccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatgttgcttgtggtgttcctatcctcgctaagtaa

SEQ ID NO: 11908 - protein, 497 aa, Sorghum bicolor
  misc_feature: Ceres ANNOT ID no. 6037998
  misc_feature (95)..(437): Pfam Id: Amidohydro_1 Pfam Desc: Amidohydrolase family
  misc_feature (95)..(435): Pfam Id: Amidohydro_3 Pfam Desc: Amidohydrolase family
  misc_feature (60)..(497): NCBI GI: 115461372 NCBI Desc: os04g0680400 [oryza sativa (japonica cultivar-group)]
  misc_feature (8)..(497): NCBI GI: 124360607 NCBI Desc: dihydroorotase [medicago truncatula]
  misc_feature (27)..(497): NCBI GI: 39653353 NCBI Desc: allantoinase [robinia pseudoacacia]
  misc_feature (44)..(495): NCBI GI: 88798451 NCBI Desc: dihydroorotase and related cyclic amidohydrolase [reinekea sp. med297]
  misc_feature (48)..(495): NCBI GI: 83643966 NCBI Desc: dihydroorotase and related cyclic amidohydrolase [hahella chejuensis kctc 2396]
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
MVASAKGRLVSVLAVAAALAAVLLYRAPFSKSLGGEGCSLLPHDHFWVASDRVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKLEAAQDKLYVDVGFWGGLVPENAFNPSALEGLLNAGVLGLKSFMCPSGINDFPMTNSTHIEEGLVTLAKYKRPLLIHAERIPEAEDDDMREDELDPRSYMTEESAIRDLHRAMKDTESGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSENPAKLAGQKNKGAILPGYHADIVVWKPETEFQLDDSHVIYHKHQNISAYLGKQLSGKVLSTFVRGNLVFAEDKHANVACGVPILAK

SEQ ID NO: 11909 - DNA, 2409 bp, Sorghum bicolor
  misc_feature: Ceres ANNOT ID no. 6038022
  misc_feature: Encodes the peptide sequence at SEQ ID NO 11910
atgccggaggccgcgcgggcgcggggcatgctggatccggcgggcgagggggaggcggagcaggaggaggagttctacgagtcgctggatcggatcctctcctcttcctgctcctccacctccgcctccgcctccgacgacgacgccgaccaccgacgccgcagcagcaggcgccaccacctcctccaccagcaccaccacaacccgccgccgtcctcgcggccggacgcgtcctccgcgtacgacgtctggatctccgagcccacgtccgtcgaggagcgccgccgcctcctgctccagcgcctcggcctcgcctccgacccgccgccgccctctccgcctcgccgctcgccgtcgcctcccgtgtctgccccggcctcgcctccggcgcccgcggaggagcccagatccggcggcggcgggctcgggaggcctccgctggcgcggaaccccagctccagcggcggggaacagcaatgccggatccggaacctggacgacggcacggagttcgaggtcggggaggtgcacgaggaggaggtggtgcgagaggtgggcaccggccgccacctcaccttcgaggagttcgagctctgcgttggccgctccccgatcgtgcacgagctcatgaagcggacaaccaccgcggcctccgcgtccgcctccgaccacgctgcccccgcgtccagcagaccccgaaggaaggccggtggtgggtggctgcgcggcatcaggcagcttgcaggcaccgtcgcgtacggccgccgcggcgccgacgacagggacaaggagaaggagagggaggcgcggcgccttagctctgccaccgatgacagcctagatggctccggctcgcgcaatgtcgggagggtccgggtgcggcaatacgggaagacgtgcaaagagctcaccgggctgttcatgacgcaggaattggctgcccactcgggctccgtgtggtgcatcaacttcagcctggatggacgataccttgccactgcaggagaggatcgtgtgatccatgtgtgggaggtgtgcgagggagacagaaagggcgaattgctcggtgaagcttcggtggcaaaggagaatggtggtggctgcagcccgtttcttgcggttgttgggaatgattcaccggagatttctgcattgtcattgtcctgtgccgatgggggctatgtggataagaagagaaggccgaggaaacagagcaatcggaagtcggtcgggtccgatcatctagttgttcctgagtgtgtgtttggtttcagagataagccagtttgctcacttctggggcatgccgccgatgttcttgatctgtcatggtccaaatctcagtacttgatctcatcctccatggacaaaactgttaagctctgggacatcactaccagtacctgtttgaaaacattctcacatacggactatgtgacttgcatccagttcaatcctgtagatgataacttcttcattagtggatcattggatgagaaagttcgcatttggaatgtccgagatcgtaagattgaggattggaatgatcttcatgagatggttactgctgcttgttattcccctgatggacaggttgcaatggtgggctctcacaagggaagctgtcatatatttgatacatctgagaagaagcttcagtacaaaagtcagatagacttaagaattaggaaaaagaagtctggccagaagaagataactggcttccagtttgctcctggaagctcctcggaagttctgattacttctgcagattcaagaatacgtgttgttaatggtgatgaatttgttcacaagtttaaagggtttcggaacacgagtagccaaatctcagcttctgtagctccaaatgggaaatacgtcatctgtgccagtgaggattctcacgtctatgtgtggagacatgacaacagttccccccctagcaggagcaggagtacagttgatgtaaccaactcatatgaacatttccactgccatggtgtgaccgtggctgtcacatggcctggtgctgaagcccgaggttcgtttggatctcaaagcagcaggcacagtgattcagatggagcagtgaactctggtcgagacctcccagttgagaacactcagcacaattgtgatgcagctgatatcagatacaatgagagcccagtctgcgaaggtgtgacaagcagaagcaccagtagacatcaaggtgatggagcgtccacatcctggcctgacgaaaaattaccatcagccaagagcagccctggtcactgctcgtccgatctttgcatgggagctatggatgtccagcgccggtctgcgtggggtttggtgattgtcacggctgggcgggcaggcgagatcagggtgttccagaattttggcttcccagttcaagtgtaa

SEQ ID NO: 11910 - protein, 802 aa, Sorghum bicolor
  misc_feature: Ceres ANNOT ID no. 6038022
  misc_feature (306)..(344): Pfam Id: WD40 Pfam Desc: WD domain, G-beta repeat
  misc_feature (426)..(463): Pfam Id: WD40 Pfam Desc: WD domain, G-beta repeat
  misc_feature (467)..(505): Pfam Id: WD40 Pfam Desc: WD domain, G-beta repeat
  misc_feature (3)..(802): NCBI GI: 38344207 NCBI Desc: osjnba0064g10.23 [oryza sativa (japonica cultivar-group)]
  misc_feature (43)..(802): NCBI GI: 38346620 NCBI Desc: osjnba0074l08.11 [oryza sativa (japonica cultivar-group)]
  misc_feature (16)..(548): NCBI GI: 116312019 NCBI Desc: osigba0155k17.2 [oryza sativa (indica cultivar-group)]
  misc_feature (380)..(548): NCBI GI: 49388718 NCBI Desc: wd-40 repeat protein-like [oryza sativa (japonica cultivar-group)]
  misc_feature (257)..(688): NCBI GI: 30689405 NCBI Desc: wd-40 repeat family protein [arabidopsis thaliana]
  misc_feature: The sequence is a functional homolog of SEQ ID NO. 502 in the 11/188,298 US application
  misc_feature: The sequence is a functional homolog of SEQ ID NO. 485 in the 11/188,298 US application
MPEAARARGMLDPAGEGEAEQEEEFYESLDRILSSSCSSTSASASDDDADHRRRSSRRHHLLHQHHHNPPPSSRPDASSAYDVWISEPTSVEERRRLLLQRLGLASDPPPPSPPRRSPSPPVSAPASPPAPAEEPRSGGGGLGRPPLARNPSSSGGEQQCRIRNLDDGTEFEVGEVHEEEVVREVGTGRHLTFEEFELCVGRSPIVHELMKRTTTAASASASDHAAPASSRPRRKAGGGWLRGIRQLAGTVAYGRRGADDRDKEKEREARRLSSATDDSLDGSGSRNVGRVRVRQYGKTCKELTGLFMTQELAAHSGSVWCINFSLDGRYLATAGEDRVIHVWEVCEGDRKGELLGEASVAKENGGGCSPFLAVVGNDSPEISALSLSCADGGYVDKKRRPRKQSNRKSVGSDHLVVPECVFGFRDKPVCSLLGHAADVLDLSWSKSQYLISSSMDKTVKLWDITTSTCLKTFSHTDYVTCIQFNPVDDNFFISGSLDEKVRIWNVRDRKIEDWNDLHEMVTAACYSPDGQVAMVGSHKGSCHIFDTSEKKLQYKSQIDLRIRKKKSGQKKITGFQFAPGSSSEVLITSADSRIRVVNGDEFVHKFKGFRNTSSQISASVAPNGKYVICASEDSHVYVWRHDNSSPPSRSRSTVDVTNSYEHFHCHGVTVAVTWPGAEARGSFGSQSSRHSDSDGAVNSGRDLPVENTQHNCDAADIRYNESPVCEGVTSRSTSRHQGDGASTSWPDEKLPSAKSSPGHCSSDLCMGAMDVQRRSAWGLVIVTAGRAGEIRVFQNFGFPVQV

SEQ ID NO: 11911 - DNA, 1404 bp, Sorghum bicolor
  misc_feature: Ceres ANNOT ID no. 6038121
  misc_feature: Encodes the peptide sequence at SEQ ID NO 11912
atggctgctctgggccggggcatcggcctcctcttcctcggcgtcctcctcttggccgtcgccggtgccgcctccgcggcgcccggcggcatgtccatcatctcgtacaacgaggagcacggcgcgcgggggctggagcggacggaggcggaggtccgggcgatgtacgagctctggctcgttgagcacggccgccgcgtctccaacgtactcggcgagcacgacagccgcttccgcgtgttctgggacaacctccgcttcgtcgacgcccataacgagcgcgccggggagcacggattccgcctcgggatgaaccagttcgcggatctcaccaacgacgagttccgcgccgcctacctcggcgccaggatccccgccgcccggagtggaaacgccgtgggggagatgtaccgtcatgacggcgccgaggagctgccggagagcgtcgactggagggagaagggggctgttgcgcccgtcaagaaccaggggcaatgcggaagttgctgggctttctctgcagtaagctcagtagagagcattaaccaaattgttactggtgagatggtgacgttgtccgagcaggagcttgtagagtgctctactgatggagggaacagtggctgcaatggtgggcttatggatgctgcctttaacttcatcataaagaacggaggcattgatactgaagatgactacccttacaaagcagtcgatggaaagtgcgacatcaacaggagaaatgccaaggttgtgagcattgatgcctttgaagatgtgcctgaaaatgatgagaaatcattacagaaggcagttgctcaccagccagttagcgttgccattgaggctggtggccggcagttccagctttacaaatcgggtgtgttcagtggaagttgcaccacaaaccttgatcacggtgtagttgcagtcggttatggcactgagaatggcaaggactactggattgtccgcaactcatggggtccaaagtggggtgaggctggttatatccgtatggagaggaacatcaatgccaccactgggaagtgtggaattgctatgatggcatcctaccctactaagaagggcgcaaaccctcccaagccatctccaactcctccaacaccgcctcccccagttgcacctgaccatgtctgcgacgagaactttgtctgctcagcaggcagcacctgctgctgtgcatttggcttcaggaacgtctgcttggtctggggttgctgcccgattgaaggtgccacctgctgcaaggatcacgccagctgctgcccgccggactaccctgtctgcaacattagggctcgaacttgctcagtgagcaagaacagcccactgagcgtcaaggccttgaagcgcaccctcgccaagctgaacaccgcatga

SEQ ID NO: 11912 - protein, 467 aa, Sorghum bicolor
  misc_feature: Ceres ANNOT ID no. 6038121
  misc_feature (145)..(361): Pfam Id: Peptidase_C1 Pfam Desc: Papain family cysteine protease
  misc_feature (56)..(115): Pfam Id: Inhibitor_I29 Pfam Desc: Cathepsin propeptide inhibitor domain (I29)
  misc_feature (398)..(446): Pfam Id: Granulin Pfam Desc: Granulin
  misc_feature (16)..(467): NCBI GI: 109939735 NCBI Desc: oryzain beta chain precursor
  misc_feature (16)..(467): NCBI GI: 32488398 NCBI Desc: osjnba0043a12.28 [oryza sativa (japonica cultivar-group)]
  misc_feature (16)..(467): NCBI GI: 115461222 NCBI Desc: os04g0670200 [oryza sativa (japonica cultivar-group)]
  misc_feature (15)..(467): NCBI GI: 111073717 NCBI Desc: triticain beta [triticum aestivum]
  misc_feature (12)..(464): NCBI GI: 90265242 NCBI Desc: h0624f09.3 [oryza sativa (indica cultivar-group)]
  misc_feature (42)..(378): SWISSPROT Homolog: EC 3.4.22.14 Actinidain precursor
  misc_feature (145)..(361): SWISSPROT Homolog: EC 3.4.22.15 Cathepsin L
MAALGRGIGLLFLGVLLLAVAGAASAAPGGMSIISYNEEHGARGLERTEAEVRAMYELWLVEHGRRVSNVLGEHDSRFRVFWDNLRFVDAHNERAGEHGFRLGMNQFADLTNDEFRAAYLGARIPAARSGNAVGEMYRHDGAEELPESVDWREKGAVAPVKNQGQCGSCWAFSAVSSVESINQIVTGEMVTLSEQELVECSTDGGNSGCNGGLMDAAFNFIIKNGGIDTEDDYPYKAVDGKCDINRRNAKVVSIDAFEDVPENDEKSLQKAVAHQPVSVAIEAGGRQFQLYKSGVFSGSCTTNLDHGVVAVGYGTENGKDYWIVRNSWGPKWGEAGYIRMERNINATTGKCGIAMMASYPTKKGANPPKPSPTPPTPPPPVAPDHVCDENFVCSAGSTCCCAFGFRNVCLVWGCCPIEGATCCKDHASCCPPDYPVCNIRARTCSVSKNSPLSVKALKRTLAKLNTA

SEQ ID NO: 11913 - DNA, 1464 bp, Sorghum bicolor
  misc_feature: Ceres ANNOT ID no. 6038148
  misc_feature: Encodes the peptide sequence at SEQ ID NO 11914
atgctgctccgcaaggtgtggggctccgtgctcgcgcgcgccgcggcgccgggggccgacccgccgccggggtcaccgagggcccgccgcgcgcaggcgcagcgcgtggagcagtaccagtaccacggctcgctgtcgctgggcgcgctcgacgccgtccccaccgacgtgctcgcccagatcctgcgcctgctgggcccgctcgacgccgcgcgctccagcgccgtctgccgcgcctggcgcgtcctcgcctccgacaacggcctctgggccttcttcctccgcctcggccccgagccctgggacctcgtcgtcttcgccgagacgcacctcgccgccggccccgcctcgcacccgtggctctactacgatagctcgccgcagctctcgtttaagcagatttacggcctccgagcggtggtcccgggtactctcatagtggatggtggatctgggtattgcaagtatggctggagcaagtacgctgctccttctgggcgttgcgctacattcttggaattcggtaacattgaagcacctatgtatgcaaggcttcgtcacttcttctctactatctatacgaggatgcaaataaagcattcgactcaaccggttattgttgtccttccactatgtcactctgatgataccgagtctgctagggcctcaagaaagcaatacaaggagacgttgtactctgtcttgtttgacatgaatgttcctgctgtttgtgctgtcgatcaagcagttctatctttgtatgcttctaaacggatctctggtattgttgtgcacattggattcaatacaacttctgttgttcccatctttcaaggtagggtaatgtatgagataggtgttgaaactgtggggcaaggtgcccttaaactcactggatttctcaaggagttaatgcagcggagaaatatatcctgtgagtcgctgtacacagttcgaaccatcaaggagaaactttgctacgtggctgctgattatgaagctgaattacggaaagatacacaagcatcctacgcggttgatggtgaagggtggttcactctgtcagaagagagattcaagactccagaaattctatttcagccccatatgggaggaatgcgtgctatgggcttgcataaagcagtagctctatgtatggatcactgctatacttcaggaacagttggtgatgacagctggtacaagacgatcgttttagctggtggatcgtcatgcttgcctggtttaccagagaggctggagaaagagcttcaccaacttcttccaccctatatgtcagaaggaataagagtactccccccttcatttggcactgattctgcctggtttggtgcaaagatgattagcaatgtgagtactttcactgaggcatggtgtgtaaagaagaaacaattccgccagaagacacggcgaaatggtccattgtttatgaattcctggtaa

SEQ ID NO: 11914 - protein, 487 aa, Sorghum bicolor
  misc_feature: Ceres ANNOT ID no. 6038148
  misc_feature (143)..(472): Pfam Id: Actin Pfam Desc: Actin
  misc_feature (48)..(95): Pfam Id: F-box Pfam Desc: F-box domain
  misc_feature (1)..(487): NCBI GI: 32488375 NCBI Desc: osjnba0043a12.5 [oryza sativa (japonica cultivar-group)]
  misc_feature (1)..(487): NCBI GI: 116308862 NCBI Desc: h1005f08.28 [oryza sativa (indica cultivar-group)]
  misc_feature (1)..(195): NCBI GI: 115461180 NCBI Desc: os04g0667700 [oryza sativa (japonica cultivar-group)]
  misc_feature (1)..(241): NCBI GI: 21489927 NCBI Desc: tpa: actin-related protein 8a; atarp8a [arabidopsis thaliana]
  misc_feature (1)..(241): NCBI GI: 21427473 NCBI Desc: actin-related protein 8a [arabidopsis thaliana]
MLLRKVWGSVLARAAAPGADPPPGSPRARRAQAQRVEQYQYHGSLSLGALDAVPTDVLAQILRLLGPLDAARSSAVCRAWRVLASDNGLWAFFLRLGPEPWDLVVFAETHLAAGPASHPWLYYDSSPQLSFKQIYGLRAVVPGTLIVDGGSGYCKYGWSKYAAPSGRCATFLEFGNIEAPMYARLRHFFSTIYTRMQIKHSTQPVIVVLPLCHSDDTESARASRKQYKETLYSVLFDMNVPAVCAVDQAVLSLYASKRISGIVVHIGFNTTSVVPIFQGRVMYEIGVETVGQGALKLTGFLKELMQRRNISCESLYTVRTIKEKLCYVAADYEAELRKDTQASYAVDGEGWFTLSEERFKTPEILFQPHMGGMRAMGLHKAVALCMDHCYTSGTVGDDSWYKTIVLAGGSSCLPGLPERLEKELHQLLPPYMSEGIRVLPPSFGTDSAWFGAKMISNVSTFTEAWCVKKKQFRQKTRRNGPLFMNSW

SEQ ID NO: 11915 - DNA, 525 bp, Sorghum bicolor
  misc_feature: Ceres ANNOT ID no. 6038219
  misc_feature: Encodes the peptide sequence at SEQ ID NO 11916
atggccttctccgctttctcatggccgtttcgccgccgtgggagcggcggcggggctggcggcagtggcgcaagtaagtccgctgccacggccgcggaggaggaggagctgggcgtgaccccgcagctgctcgacttcctccggacgctctcgcccgacgccttcaaggccgccgccctccagctccaaggaggctccacggaggcggccgccggcgacctcaccagctggcaggagcggcacgccgtgctcgtgctgtccaaagctaaggaactcgccaagattcggtacgatctgtgccctcggcacatgaaggataagcagttctggaagatatacttcctgctcgccaagagttacatctcaccgtatgagctacgcgccatacaaaaagaaaaaatcagacggatggagacagaaaacggcaagtcaaaagaagtgattactgttgaagtggagatgcaagaatcgaaaggcagtagtctctctcgaacatcagaaagagatttagaatcccaagtttag

SEQ ID NO: 11916 - protein, 174 aa, Sorghum bicolor
  misc_feature: Ceres ANNOT ID no. 6038219
  misc_feature (65)..(127): Pfam Id: BSD Pfam Desc: BSD domain
  misc_feature (71)..(173): NCBI GI: 115461106 NCBI Desc: os04g0662000 [oryza sativa (japonica cultivar-group)]
  misc_feature (1)..(173): NCBI GI: 38346066 NCBI Desc: osjnba0084k01.6 [oryza sativa (japonica cultivar-group)]
  misc_feature (21)..(123): NCBI GI: 42571647 NCBI Desc: bsd domain-containing protein [arabidopsis thaliana]
  misc_feature (31)..(122): NCBI GI: 115485895 NCBI Desc: os11g0557300 [oryza sativa (japonica cultivar-group)]
  misc_feature (34)..(134): NCBI GI: 115455117 NCBI Desc: os03g0729900 [oryza sativa (japonica cultivar-group)]
MAFSAFSWPFRRRGSGGGAGGSGASKSAATAAEEEELGVTPQLLDFLRTLSPDAFKAAALQLQGGSTEAAAGDLTSWQERHAVLVLSKAKELAKIRYDLCPRHMKDKQFWKIYFLLAKSYISPYELRAIQKEKIRRMETENGKSKEVITVEVEMQESKGSSLSRTSERDLESQV

SEQ ID NO: 11917 - DNA, 1644 bp, Sorghum bicolor
  misc_feature: Ceres ANNOT ID no. 6038344
  misc_feature: Encodes the peptide sequence at SEQ ID NO 11918
atgagtgaggcaaatactactcagcttgaccttgagaaaggattttctcaagtgtctaatgataatgattcaagtagccctgcaactgtgcataagatgaaagctgagacagaagatggtggaagtgaaatcgaatcacccactccagaaaaacgtgaatctagaagcaaaggggttgttgtgagttcactggcaaggaatttgcttgcagagaggtacaaagacagatttgcatatcagctggtggaagatgagggtgagacagatgaagaagactataatgaaagtgtttcgcctagtggtagccgatctctttttccagaaagcattgaacttcttgagaaaatggagagttctataagattgcttcacctacggaagaagatggctacatttaataatattgccacccaggtggagatactcgcaaaaagtcatttggcccagatgaaacatttattcccagaggcaatccagataaagaggatactagtacatgatgagaagagcctatgcatgtatgctgatatggaaatcacacttgtaatggatgttgtggaatgcacaagccctgatcagtctccatccatgacaatttgcgaggctttttactcaaagcttttgagatttttggatgctcatcataagggtgcagatattcctgaggcaatcctaccggaaccctttaattcaaggccaagggataagttatatcttgaggcagtacataatgggcatgctgctgagccacctatgcagggtgccgctgaggaggaactctcaaatgcttcccactttccacaatcttttcaaaaactcatgtcgcagaaaatcattgctgatggaactgaaaagactcaattgctatctgatccagcagagctgagctctgtgaacgtttatgatacagaagggtcagacagaaaccctaaaaagcaagatgaacatgctccagctccagtgaactctgaaatttctgctactccaagccgtcatttgacctcttgttgtcaagagagtacaccaaaacaagggacctcagagtcaccattgttgtctggaacacctgcaatgcagactccaaataggccattgccgactccacttgagaaacccaaggtcacatgtggacacattagtgaaccacgttcagccagttctgcccgcagatcactaaatacatcgttaaaatttgaaggaggaagcccttcttattatgatggaatggaacatacgactacagctgaaaagggcataatctcagaagactcatcaagttttaacaagtcatttgaggaagatagtcctgtcttctttactgataaagacaaaatcaatgaagtagactcagtggatactcaagaaaggatggcttcgctacataccacatttgacatagtctgcgatatttctcgttctaccaagaattcacttatcacgaaacaggaacttttccacaatattcttgccaacaacttggagatagaagagattggggagatagaagagcagctgcatattttagaggatctggctccttctttgatatcaaagaaggtgataaatggaggagaaatactttatagcatcgagcctataacagatcagaattcagttcgggcgaggcttgtagaacctgtatga

SEQ ID NO: 11918 - protein, 547 aa, Sorghum bicolor
  misc_feature: Ceres ANNOT ID no. 6038344
  misc_feature (106)..(227): Pfam Id: CDT1 Pfam Desc: DNA replication factor CDT1 like
  misc_feature (110)..(547): NCBI GI: 115482658 NCBI Desc: os10g0489900 [oryza sativa (japonica cultivar-group)]
  misc_feature (57)..(543): NCBI GI: 38344618 NCBI Desc: osjnbb0003a12.4 [oryza sativa (japonica cultivar-group)]
  misc_feature (57)..(543): NCBI GI: 116317853 NCBI Desc: osigba0148j22.4 [oryza sativa (indica cultivar-group)]
  misc_feature (9)..(545): NCBI GI: 38567811 NCBI Desc: cdt1a protein [arabidopsis thaliana]
MSEANTTQLDLEKGFSQVSNDNDSSSPATVHKMKAETEDGGSEIESPTPEKRESRSKGVVVSSLARNLLAERYKDRFAYQLVEDEGETDEEDYNESVSPSGSRSLFPESIELLEKMESSIRLLHLRKKMATFNNIATQVEILAKSHLAQMKHLFPEAIQIKRILVHDEKSLCMYADMEITLVMDVVECTSPDQSPSMTICEAFYSKLLRFLDAHHKGADIPEAILPEPFNSRPRDKLYLEAVHNGHAAEPPMQGAAEEELSNASHFPQSFQKLMSQKIIADGTEKTQLLSDPAELSSVNVYDTEGSDRNPKKQDEHAPAPVNSEISATPSRHLTSCCQESTPKQGTSESPLLSGTPAMQTPNRPLPTPLEKPKVTCGHISEPRSASSARRSLNTSLKFEGGSPSYYDGMEHTTTAEKGIISEDSSSFNKSFEEDSPVFFTDKDKINEVDSVDTQERMASLHTTFDIVCDISRSTKNSLITKQELFHNILANNLEIEEIGEIEEQLHILEDLAPSLISKKVINGGEILYSIEPITDQNSVRARLVEPV

SEQ ID NO: 11919 - DNA, 1206 bp, Sorghum bicolor
  misc_feature: Ceres ANNOT ID no. 6039445
  misc_feature: Encodes the peptide sequence at SEQ ID NO 11920
  misc_feature: Up-regulated in shoot tissues in response to methyl jasmonate treatment
  misc_feature: Up-regulated in shoot tissues in response to salicylic acid treatment
atggcatccaacggcatcgcccccagagatgtatgtgttgtcggtgttgcacgcacccctatgggtggttttcttggtgccttgtcttccttgcccgcaacaaagcttggctctatagcaattgaagctgctctgaaaagagcaaatgtggatgcggctctcgtgcaggaggtctttttcggaaatgtcttgagtgctaatttgggacaggctcctgcaaggcaagccgctctgggtgcagggataccaaacactgttgtttgcaccactgttaacaaagtctgcgcgtctggcatgaaggctactatgttcgccgcacagacaattcagctgggtatcaatgatattgttgttgcaggtggcatggaaagcatgtccaatgccccaaagtacattgctgaagctaggaaagggtctcgttttggacatgacacacttgttgatgccatgcttaaggatggactttgggatgtatacaatgactgtgccatgggaatgtgtgctgagctttgtgctgacaatcatgccctcacaagagaagaccaggatgcttttgctatccaaagcaacgagcgtggaattgctgctcgtgacagtggtgcttttgcatgggagattgttccgattgaagttcctgtcgggaggggaaaaccacctgtacttattgagaaagatgaaagcctggataagtttgacccagcaaaactgaagaaactccgcccaagtttcaaggagaatggtggtactgttacagctggaaatgcttctagtataagtgatggggctgctgcattagttttggtgagtgggcagaaggctcaagagcttggcctgcaagtccttgcaaggatcagaggatatgcagatgcagctcaagctccggaactttttacaaccaccccagcacttgcgataccaaaggctatagcaaatgctggattagagtcatcccatgttgatttttatgagattaatgaagcattttcggctgttgctcttgcaaatcaaaagcttcttgggattccttcagaaaagactaatgttcatggaggagctgtatctttagggcatcctcttgggtgcagtggtgctcgcattttggtcacccttcttggtgttcttagggtgaagggtggcaagatcggggttgctggagtctgtaacggtggaggtggagcatcagctcttgttgttgagctcgcataa

SEQ ID NO: 11920 - protein, 401 aa, Sorghum bicolor
  misc_feature: Ceres ANNOT ID no. 6039445
  misc_feature (8)..(271): Pfam Id: Thiolase_N Pfam Desc: Thiolase, N-terminal domain
  misc_feature (278)..(400): Pfam Id: Thiolase_C Pfam Desc: Thiolase, C-terminal domain
  misc_feature (1)..(401): NCBI GI: 115478180 NCBI Desc: os09g0252100 [oryza sativa (japonica cultivar-group)]
  misc_feature (2)..(400): NCBI GI: 85700246 NCBI Desc: acetoacetyl-coa thiolase [picrorhiza kurrooa]
  misc_feature (3)..(400): NCBI GI: 8777413 NCBI Desc: acetyl-coa c-acetyltransferase [arabidopsis thaliana]
  misc_feature (2)..(400): NCBI GI: 53854350 NCBI Desc: cytosolic acetoacetyl-coenzyme a thiolase [nicotiana tabacum]
  misc_feature (1)..(400): NCBI GI: 53854352 NCBI Desc: peroxisomal acetoacetyl-coenzyme a thiolase [nicotiana tabacum]
  misc_feature (3)..(400): SWISSPROT Homolog: EC 2.3.1.9 Acetyl-CoA acetyltransferase, cytosolic 1
  misc_feature: Up-regulated in shoot tissues in response to methyl jasmonate treatment
  misc_feature: Up-regulated in shoot tissues in response to salicylic acid treatment
MASNGIAPRDVCVVGVARTPMGGFLGALSSLPATKLGSIAIEAALKRANVDAALVQEVFFGNVLSANLGQAPARQAALGAGIPNTVVCTTVNKVCASGMKATMFAAQTIQLGINDIVVAGGMESMSNAPKYIAEARKGSRFGHDTLVDAMLKDGLWDVYNDCAMGMCAELCADNHALTREDQDAFAIQSNERGIAARDSGAFAWEIVPIEVPVGRGKPPVLIEKDESLDKFDPAKLKKLRPSFKENGGTVTAGNASSISDGAAALVLVSGQKAQELGLQVLARIRGYADAAQAPELFTTTPALAIPKAIANAGLESSHVDFYEINEAFSAVALANQKLLGIPSEKTNVHGGAVSLGHPLGCSGARILVTLLGVLRVKGGKIGVAGVCNGGGGASALVVELA

SEQ ID NO: 11921 - DNA, 753 bp, Sorghum bicolor
  misc_feature: Ceres ANNOT ID no. 6039485
  misc_feature: Encodes the peptide sequence at SEQ ID NO 11922
atgtctggttcgtggatggcgccaccgcgtctcctggtgtcgtcgctgctggtcgccgtgctcgcggtggcggccgccgatgtcgccaatgccggcggcgccaagcccctgacgcccggcgggcgcgtggtgcaccacaaccacggcaagttcaccgccggcgagtggaagcgcgcccacgcgaccttctacggcggccgggacgggtccggcaccacggcgggcgcgtgcgggtacaaggacacgcggtccgagggctacggcgtgcagacggtggccgtgagctcggtgctgttcggcaatggcgcggcctgcggcggttgctacgaggtgcggtgcgtggacagccccgacgggtgcaagccgcccggcgcggcggcggcggcggcggcgctggtgatcgcggaggagaaggccggcatcgtgcccgtctcctaccggcgggtggcgtgcgcgaggcagggcggcatccggtacgccatcgccgggaacaagtacttcaacatggtgacggtcaccaacgtgggcggcgccggcgacgtggcggcggtgtcggtgaaggggagcaagcgcgtcaagtggacggagctgaagcgcaactggggggtagtgtggcagaccggggaggacctcacctgcgagtcgctgacgttcagggtgatgaccggcgaccaccgcaaggccacgtcgtggcacgtcctccccgaggactggaagttcggcgtcacgtaccaggcgtccaagaacttctaa

SEQ ID NO: 11922 - protein, 250 aa, Sorghum bicolor
  misc_feature: Ceres ANNOT ID no. 6039485
  misc_feature (157)..(235): Pfam Id: Pollen_allerg_1 Pfam Desc: Pollen allergen
  misc_feature (91)..(146): Pfam Id: DPBB_1 Pfam Desc: Rare lipoprotein A (RlpA)-like double-psi beta-barrel
  misc_feature (115)..(250): NCBI GI: 75225160 NCBI Desc: expansin-a32 precursor (osexpa32) (alpha-expansin-32) (osexp32) (osaexpa1.30)
  misc_feature (40)..(250): NCBI GI: 25136293 NCBI Desc: alpha expansin 26 [oryza sativa (japonica cultivar-group)]
  misc_feature (40)..(250): NCBI GI: 16517062 NCBI Desc: alpha-expansin osexpa26 [oryza sativa]
  misc_feature (40)..(250): NCBI GI: 115502185 NCBI Desc: expansin-a26 precursor (osexpa26) (alpha-expansin-26) (osexp26) (osaexpa1.29)
  misc_feature (115)..(250): NCBI GI: 4886515 NCBI Desc: expansin18 [lycopersicon esculentum]
MSGSWMAPPRLLVSSLLVAVLAVAAADVANAGGAKPLTPGGRVVHHNHGKFTAGEWKRAHATFYGGRDGSGTTAGACGYKDTRSEGYGVQTVAVSSVLFGNGAACGGCYEVRCVDSPDGCKPPGAAAAAAALVIAEEKAGIVPVSYRRVACARQGGIRYAIAGNKYFNMVTVTNVGGAGDVAAVSVKGSKRVKWTELKRNWGVVWQTGEDLTCESLTFRVMTGDHRKATSWHVLPEDWKFGVTYQASKNF

SEQ ID NO: 11923 - DNA, 1020 bp, Sorghum bicolor
  misc_feature: Ceres ANNOT ID no. 6039515
  misc_feature: Encodes the peptide sequence at SEQ ID NO 11924
atggacgcgcccacgacgtcctcgcccttcccgggcacgagcttcgtcatcctctccgtctccatcgtcggcatcctcgccacctcgctcctactcctagcctactacctcttcctcacccgctgcggcctcctcttcttctggcgcccgggcggcacgcacgacttcgacgacgacgacgtcgtcttagccggacaccaccgccgccacgtcgtcgtcaccgtgcacgaccccgtgccgcctcgccggagcgggctggaggaggcggccatccgccggatccccacgttccggtaccgccacggcgcgcgccaccacctcgtactcacgtcgtcggaggccaacaacaacaacaaggacaagcaggccgccgccgcagccgccgagtgcgccgtgtgcctcgccgacttccgcgacggcgagaggctccgcgtgctgccgccctgcctccacgccttccacatcgactgcatcgacgcctggctccagtccgccgccacctgcccgctctgcagggccgccgtctccgaccccgccgccctgcactaccaccaccaccacctccacgtcccgctcccgctccaggtcccgcgcgccgccaccgacgacgacattgccatagatgttatcagtgctaccatctccccaccagccgccgccgacgaaccagcggcggctgcgcattctcatgagaccgccgcgcatcggaacagtagctgccgcagctgcagcatgggaggaggaggaggaggaggaggaggaggagacggctgcttcttgcccgtgcgccggtcgctgtccatggactccagcaccgacaagcgcttctacctcgcgctgcagggcgtcctgcggcagagttcactggctgtcgcagaagacgaggaaggcaaagcggagagcagcaatgccgccgccgctgccgccgacactgacccaccatcgtcgaggaggctgcgccggtccttcttctcgttcagccagagcaggggatcccgaagtgccgtcctgccgctctga

SEQ ID NO: 11924 - protein, 339 aa, Sorghum bicolor
  misc_feature: Ceres ANNOT ID no. 6039515
  misc_feature (130)..(171): Pfam Id: zf-C3HC4 Pfam Desc: Zinc finger, C3HC4 type (RING finger)
  misc_feature (119)..(336): NCBI GI: 92918533 NCBI Desc: zinc finger, ring-type [medicago truncatula]
  misc_feature (3)..(310): NCBI GI: 49389042 NCBI Desc: ring finger 1 [oryza sativa (japonica cultivar-group)]
  misc_feature (82)..(288): NCBI GI: 48716498 NCBI Desc: zinc finger (c3hc4-type ring finger)-like [oryza sativa (japonica cultivar-group)]
  misc_feature (127)..(338): NCBI GI: 41053267 NCBI Desc: zinc finger (c3hc4-type ring finger)-like [oryza sativa (japonica cultivar-group)]
  misc_feature (123)..(179): NCBI GI: 56201670 NCBI Desc: ring-h2 zinc finger protein-like [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
MDAPTTSSPFPGTSFVILSVSIVGILATSLLLLAYYLFLTRCGLLFFWRPGGTHDFDDDDVVLAGHHRRHVVVTVHDPVPPRRSGLEEAAIRRIPTFRYRHGARHHLVLTSSEANNNNKDKQAAAAAAECAVCLADFRDGERLRVLPPCLHAFHIDCIDAWLQSAATCPLCRAAVSDPAALHYHHHHLHVPLPLQVPRAATDDDIAIDVISATISPPAAADEPAAAAHSHETAAHRNSSCRSCSMGGGGGGGGGGDGCFLPVRRSLSMDSSTDKRFYLALQGVLRQSSLAVAEDEEGKAESSNAAAAAADTDPPSSRRLRRSFFSFSQSRGSRSAVLPL

SEQ ID NO: 11925 - DNA, 1194 bp, Sorghum bicolor
  misc_feature: Ceres ANNOT ID no. 6039787
  misc_feature: Encodes the peptide sequence at SEQ ID NO 11926
atggattcaagctaccagcgtagatcaaataatgaagaggaattttttttcttcgtactccctaccttacaagaagctagttcatcccaatcgtcacaaaggcaagccatacatacatcagtccggaatggagccatatttattgatgaaacactaaatgggcatgaagtcgtatgccgaaggcgatttcatatggagagagagattttccgagctctagttcgaagattgcgtgaaaaaggacttgttgattcaaggtatgtctcggtggaagagcaattagctatattcctttatgcagtatcaaaaaatgcaagcaatcgagtattacaagatcaattccaacatagtgggaaaacaattagccgtcactttgcagcagtgctcaatgcacttacacaactgacatgccactatatatgcttgccttctccacacccgcatcgtatattaaggcagcctaaattttctccatactttcagaactgtgttggagctatcgatggcactcatattccaatgattattcctgttgcacaacaagaaccatacagaaatagaaaacaaggtctatcacaaaacatgatggttgcatgtgacttcgatctaaaatttgtgcatgtccatgccggttgggaggggtctgcttctgatgcaagagttctacaggatgcacttaaccatggatttagtgtcccccccggtaaattctatcttgtagatgcaggctacgcaaatacaccacaatttcttgctccataccgtggaacaagatatcacttacaagaacaaggaagagcaggtcaaaaaccacaaaatccgaaggaattattcaaccttcgacatgcacaactacggaatcatatagagagagctattggtgtattaaaaatgaggtaccctatactaaaggctgcttcagcatatgacatagagacacaagttgatatctctgtagcttgttgtttaacacacaatttcattcggttacacaatggagatgacagtttggtacatagtgctaccacagatatcaatgacagcaacatgatagatgtaccagaaggagatcaccaatacaataatgatgtgccagcatttaacaacttgcgacaagcaggaaatgagatgcgagatgacatagcaaacaagatgtgggaagattacattgccagacgtacaattcagcgataa

SEQ ID NO: 11926 - protein, 397 aa, Sorghum bicolor
  misc_feature: Ceres ANNOT ID no. 6039787
  misc_feature (63)..(390): NCBI GI: 115468106 NCBI Desc: os06g0481800 [oryza sativa (japonica cultivar-group)]
  misc_feature (2)..(355): NCBI GI: 115449507 NCBI Desc: os02g0813200 [oryza sativa (japonica cultivar-group)]
  misc_feature (2)..(355): NCBI GI: 115468766 NCBI Desc: os06g0595700 [oryza sativa (japonica cultivar-group)]
  misc_feature (10)..(393): NCBI GI: 115445177 NCBI Desc: os02g0231600 [oryza sativa (japonica cultivar-group)]
  misc_feature (28)..(389): NCBI GI: 92871232 NCBI Desc: transposase, is4 [medicago truncatula]
MDSSYQRRSNNEEEFFFFVLPTLQEASSSQSSQRQAIHTSVRNGAIFIDETLNGHEVVCRRRFHMEREIFRALVRRLREKGLVDSRYVSVEEQLAIFLYAVSKNASNRVLQDQFQHSGKTISRHFAAVLNALTQLTCHYICLPSPHPHRILRQPKFSPYFQNCVGAIDGTHIPMIIPVAQQEPYRNRKQGLSQNMMVACDFDLKFVHVHAGWEGSASDARVLQDALNHGFSVPPGKFYLVDAGYANTPQFLAPYRGTRYHLQEQGRAGQKPQNPKELFNLRHAQLRNHIERAIGVLKMRYPILKAASAYDIETQVDISVACCLTHNFIRLHNGDDSLVHSATTDINDSNMIDVPEGDHQYNNDVPAFNNLRQAGNEMRDDIANKMWEDYIARRTIQR

SEQ ID NO: 11927 - DNA, 738 bp, Sorghum bicolor
  misc_feature: Ceres ANNOT ID no. 6039976
  misc_feature: Encodes the peptide sequence at SEQ ID NO 11928
atgcctcccgccttcgccgccgcaccttcctcctccatgttagtatctgcatgtggagttcgcatcccaacggcggtttccgcgcccagatttctgcgtaatcgggtggcagcaaaaacacggtctacatcagcttggtccttgaaggctggcttgtgggattctctcagatctggctttttgaagagcaacaacagtacagagacagtagagccaccacaagcaccacttgaagtcgaagaacctttgcctgtggaaatagtactcctagaaagaacactacttgacggaagcacagaacagattttattttcttcagctggagatgttgacctgtatgatctccaagccttatgcgataaggtaggatggccacgcaggcctctatcaaagatagcagcctcattaagaaacagctacttggttgctacactacattcaataattagatcttcagaaacagagggagaagagaagaagcagctcattgggatggcacgagcaacctcagaccatgccttcaatgctacaatttgggatgttcttgttgatccttcataccagggtcagggtcttggtaaagcactcatggagaaagtaattcgtactttgctccagagagacatcaacaacattacattgtttgcagataataaagttatagatttctacaagaacttgggatttgaagttgatcctcaaggcatcaagggcatgttctggtaccccagattttag

SEQ ID NO: 11928 - protein, 245 aa, Sorghum bicolor
  misc_feature: Ceres ANNOT ID no. 6039976
  misc_feature (154)..(230): Pfam Id: Acetyltransf_1 Pfam Desc: Acetyltransferase (GNAT) family
  misc_feature (40)..(244): NCBI GI: 30790421 NCBI Desc: nuclear shuttle interacting protein [arabidopsis thaliana]
  misc_feature (40)..(244): NCBI GI: 145324104 NCBI Desc: atnsi (nuclear shuttle interacting) [arabidopsis thaliana]
  misc_feature (2)..(155): NCBI GI: 115464517 NCBI Desc: os05g0481000 [oryza sativa (japonica cultivar-group)]
  misc_feature (98)..(243): NCBI GI: 75907704 NCBI Desc: gcn5-related n-acetyltransferase [anabaena variabilis atcc 29413]
  misc_feature (97)..(243): NCBI GI: 119509581 NCBI Desc: gcn5-related n-acetyltransferase [nodularia spumigena ccy9414]
MPPAFAAAPSSSMLVSACGVRIPTAVSAPRFLRNRVAAKTRSTSAWSLKAGLWDSLRSGFLKSNNSTETVEPPQAPLEVEEPLPVEIVLLERTLLDGSTEQILFSSAGDVDLYDLQALCDKVGWPRRPLSKIAASLRNSYLVATLHSIIRSSETEGEEKKQLIGMARATSDHAFNATIWDVLVDPSYQGQGLGKALMEKVIRTLLQRDINNITLFADNKVIDFYKNLGFEVDPQGIKGMFWYPRF

SEQ ID NO: 11929 - DNA, 1386 bp, Sorghum bicolor
  misc_feature: Ceres ANNOT ID no. 6040088
  misc_feature: Encodes the peptide sequence at SEQ ID NO 11930
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
atggtggggagctacgcgaacggtggcggggctgcggcgctggtggcggaggagaagctggacgcgctgcggcggttgctggggaagtcggacggcgacccgctgcgggtcgtcggggtgggcgccggggcgtgggggagcgtgttctgcgcgctgctgcaggacgcgtacggccggcaccgcgaccgggtgcaggtgcgcgtgtggcgccgcgctggccgcgccgtggaccgcgccgacgccgagcgcctcttcgaggtcatcaactcccgcgaggacgtgctgcggcggctcatccgacgctgcgcctacctcaagtacgtcgaggcgcggctcggggaccgcacgctgcacgccgacgagatcctccgcgacggcttctgcctcaacatgctcgacaccccgctctgcccgctcaaggtcgtcaccaacctgcaggaggccgtctgggacgccgacatagtcgtcaacggcctgccctccacggagaccagggaggtgttcggggagattgggaggtactggaaggagcgaatcacccagccgctcattatctcgctggcaaaggggatcgaggcgtcgctcgaccctgtgccccggatcattacgcccacgcagatgatcagcaatgcaactggagttccgttggagaacattctgtatcttggaggcccaaacattgcttctgagatttataacaaagaatatgcgaatgctcgcatatgtggagctgacaagtggaggaaacctcttgcaaatttcttgaggcaaccccatttcattgtatgggacaatagtgatctcattactcatgaagtcatgggcggcttaaaaaacgtatatgccattggggctggtatggtggcagcccttaccaatgagagtgcaaccagcaaatcagtatacttttcactttgcacatctgaaatgatatacatcacccatcttctagcacgagagcccgagaaacttgcagggcccttattagctgacacatacgtcaccctgctgaaaggtcgcaatgcatggtacgggcagaagttagctaagggagaactgactctagaaatgggggacagcatcaaaggcaaagggactatccagggtgtttctgcagtcaatgcattttatgaactgctgagccagggaagcctaagcgtgatgcatccagaaaccaagaaggctgttgctcctgttgagctatgcccaatactcaaaacactttacaaaattttgatcaagagggagcttacgaccaattccatcctccaggcaatacgtgatgaatcaatgtatgatccacgggaaagaattgaaatggcgcagaggcagtctcttttccggccatctcttcttggcctagctaaaggtgatgccaaggcctaa

SEQ ID NO: 11930 - protein, 461 aa, Sorghum bicolor
  misc_feature: Ceres ANNOT ID no. 6040088
  misc_feature (266)..(425): Pfam Id: NAD_Gly3P_dh_C Pfam Desc: NAD-dependent glycerol-3-phosphate dehydrogenase C-terminus
  misc_feature (35)..(249): Pfam Id: NAD_Gly3P_dh_N Pfam Desc: NAD-dependent glycerol-3-phosphate dehydrogenase N-terminus
  misc_feature (1)..(458): NCBI GI: 115464667 NCBI Desc: os05g0495700 [oryza sativa (japonica cultivar-group)]
  misc_feature (1)..(453): NCBI GI: 115442141 NCBI Desc: os01g0939600 [oryza sativa (japonica cultivar-group)]
  misc_feature (15)..(453): NCBI GI: 79396613 NCBI Desc: glycerol-3-phosphate dehydrogenase (nad+) [arabidopsis thaliana]
  misc_feature (6)..(235): NCBI GI: 29367963 NCBI Desc: glycerol-3-phosphate dehydrogenase-like protein [oryza sativa (japonica cultivar-group)]
  misc_feature (139)..(382): NCBI GI: 133915197 NCBI Desc: glycerol-3-phosphate dehydrogenase (nad(p)+) [saccharopolyspora erythraea nrrl 2338]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
MVGSYANGGGAAALVAEEKLDALRRLLGKSDGDPLRVVGVGAGAWGSVFCALLQDAYGRHRDRVQVRVWRRAGRAVDRADAERLFEVINSREDVLRRLIRRCAYLKYVEARLGDRTLHADEILRDGFCLNMLDTPLCPLKVVTNLQEAVWDADIVVNGLPSTETREVFGEIGRYWKERITQPLIISLAKGIEASLDPVPRIITPTQMISNATGVPLENILYLGGPNIASEIYNKEYANARICGADKWRKPLANFLRQPHFIVWDNSDLITHEVMGGLKNVYAIGAGMVAALTNESATSKSVYFSLCTSEMIYITHLLAREPEKLAGPLLADTYVTLLKGRNAWYGQKLAKGELTLEMGDSIKGKGTIQGVSAVNAFYELLSQGSLSVMHPETKKAVAPVELCPILKTLYKILIKRELTTNSILQAIRDESMYDPRERIEMAQRQSLFRPSLLGLAKGDAKA

SEQ ID NO: 11931 - DNA, 1494 bp, Sorghum bicolor
  misc_feature: Ceres ANNOT ID no. 6040115
  misc_feature: Encodes the peptide sequence at SEQ ID NO 11932
atgcccgcgcagaagcgcccgctcccgtcgtccgtctcgccaggccccgacgcccacgtcgaggaagctcctggcgccgacgcggacggctgcggcgggggcgaccggcggtcgccgaagctgacgctgaacggagtggaggagcgggacggcgggccgcggcaggccaaggaccggcgccacgattccgacgctgacgacgaggaggaggaaggagaccgcgaaggcggcggcggcgggagcgggagcgggagcgggagcggaggcgacgacgactgcgacagccagtcgtcgcagagcgacggcgtgatggacgagtttacacttgtgaagttagtggatgttcggaaggaagtgcagtgccctatatgcctaggaattattcggaagacaaggacagtcatggagtgtttgcaccggttttgtagggactgcatagataaatcaatgcggcttggaaataatgaatgcccagcatgccgcactcattgtgcaagtagacgttccttgagggatgatcctaactacgatgctttaattctagctttatatccagacattgataagtatgaggaagaggaacttgcattcagtgaagaggaaaggacccgtaacaaaaggattcaagaatccattgctgagacatttcggagacaaactgaagcacttgtgaagaagcgctccactgtaaaaggaacagatgcagcttctacaaggaagactcgacggaatatgcgaccaaggaggagagggcgaattagttctcctgatattgccccaactgattttgatgatgaggatagagaagaaaatggtgatgttggaagcaaggactcatcttctgttgatgatcactccccagatgtaaggccaaaaagagctcggaggtggcccatgccacgtcgttcccctgctaagaccattggcaataccgacaatagcattgaggataatgatgactcaggaggtgctagagactttgtgactgcttctccactgcgtggagagatgcttgcatgggggaaaaatggcactcgcagccaaacccgacatggcaacaccagtggctccagtggaaggatgggcaagggtggccgtgttgccaagttagtggatcaactccgtaatgctgatgactttgatagtaagttgaacctgtatcttgtcctgcttccacttgatgggcaaagtgtgcctaaactggaaaagccctacctcagttgcctgccaacactatctgttcagcatctctgccagtttgttgctcttcagttgtctcggcaacccaaagaagtcgagatatatatcaggaaaaacatggatgcatgcttgtcagccaatgacagtagtaaacacgagacaaagccagatcagtctaatggtttagagagattgtgggaagagaagtctcttttggatctctacccttccctcgccacccgtcaaggagatctggaattgttgtattctctgaaagcacaaggacaggggtag

SEQ ID NO: 11932 - protein, 497 aa, Sorghum bicolor
  misc_feature: Ceres ANNOT ID no. 6040115
  misc_feature (121)..(160): Pfam Id: zf-C3HC4 Pfam Desc: Zinc finger, C3HC4 type (RING finger)
  misc_feature (1)..(495): NCBI GI: 115440475 NCBI Desc: os01g0796700 [oryza sativa (japonica cultivar-group)]
  misc_feature (44)..(438): NCBI GI: 145358843 NCBI Desc: protein binding / zinc ion binding [arabidopsis thaliana]
  misc_feature (125)..(272): NCBI GI: 108864542 NCBI Desc: zinc finger, c3hc4 type family protein [oryza sativa (japonica cultivar-group)]
  misc_feature (35)..(201): NCBI GI: 87240735 NCBI Desc: zinc finger, ring-type [medicago truncatula]
  misc_feature (115)..(238): NCBI GI: 60655935 NCBI Desc: ring finger protein 1 [synthetic construct]
MPAQKRPLPSSVSPGPDAHVEEAPGADADGCGGGDRRSPKLTLNGVEERDGGPRQAKDRRHDSDADDEEEEGDREGGGGGSGSGSGSGGDDDCDSQSSQSDGVMDEFTLVKLVDVRKEVQCPICLGIIRKTRTVMECLHRFCRDCIDKSMRLGNNECPACRTHCASRRSLRDDPNYDALILALYPDIDKYEEEELAFSEEERTRNKRIQESIAETFRRQTEALVKKRSTVKGTDAASTRKTRRNMRPRRRGRISSPDIAPTDFDDEDREENGDVGSKDSSSVDDHSPDVRPKRARRWPMPRRSPAKTIGNTDNSIEDNDDSGGARDFVTASPLRGEMLAWGKNGTRSQTRHGNTSGSSGRMGKGGRVAKLVDQLRNADDFDSKLNLYLVLLPLDGQSVPKLEKPYLSCLPTLSVQHLCQFVALQLSRQPKEVEIYIRKNMDACLSANDSSKHETKPDQSNGLERLWEEKSLLDLYPSLATRQGDLELLYSLKAQGQG

SEQ ID NO: 11933 - DNA, 1206 bp, Sorghum bicolor
  misc_feature: Ceres ANNOT ID no. 6040116
  misc_feature: Encodes the peptide sequence at SEQ ID NO 11934
atgttgctatcgctggtgcgcgcgggtagcgcccctctccgccgagtcgtctccacgttctcctcgacccgagccgtatcgcctcgctttcggtgcgccatcagtagcggcggtaacctcaacctcccgttgtacgctcacccctcgccgtcccgcgacggctcgagcggtccggctggtggagcccggcgaggaatgagcttctgcgcccgcgcggtggacgtcggggacgaggcagcctccagctccgccgccgtgggctcggacctctccgcaccttacctctccgtccgcattcgatgccgcaggcacgacgtggaagcactgtccgaggcgctcttgtgcttcggtgctagctccgtgaccgtggatgacattgccgatgctgaaaatctcgatgaaatctccataacttccttatatgccgatggggaagacgtggactcaagcgtatcaagtgccgcaagctcagctggtttgaactacagcccagtgtatgaaacctctgtcgggaagcagtgcgattgggtggcaaatgtgcaggaaacatacgagcccactgaagtggctgatggcctttgggttgttcctaaatggagaactccccctgatccagaggccacaaacataatcatcgatccaggtttggcttttgggatgggggagcacccaacaactaagctgtgccttctatttctacgagaagttattaaaggcggtgaacgtgtcttggattatggaacaggcacaggagtattggggattgcagctctgaagatgggtgctactcaatcaactgggatagatattgaccctcaagccataacctctgcttcagaaaacttgttgctgaatggtttacattcgaaccaaatgcatgtttatttggtactaacaaatgctcagccttcatgctttccgagtgccatcaacaaatcagaagaccaccactcaaccaataaccttgacttgaagttctcaagaggaacttatgatgtagttgcagcaaatatccttctaaatcccttgttggagctggttgaggacatagttggttatgcaaaacctggtggaataattgctgtttctggaatattggaggaacaggtgccaaaaatcaaagaagtttactcaaggtatttggacagaatattggtatccgaaatggatgggtgggcttgtcttcagggaatcaggagagtgtag

SEQ ID NO: 11934 - protein, 401 aa, Sorghum bicolor
  misc_feature: Ceres ANNOT ID no. 6040116
  misc_feature (93)..(400): Pfam Id: PrmA Pfam Desc: Ribosomal protein L11 methyltransferase (PrmA)
  misc_feature (79)..(400): NCBI GI: 10177254 NCBI Desc: ribosomal protein l11 methyltransferase-like protein [arabidopsis thaliana]
  misc_feature (151)..(281): NCBI GI: 126453605 NCBI Desc: ribosomal protein l11 methyltransferase [burkholderia pseudomallei 1106a]
  misc_feature (137)..(281): NCBI GI: 83653128 NCBI Desc: ribosomal protein l11 methyltransferase [burkholderia thailandensis e264]
  misc_feature (151)..(281): NCBI GI: 84360700 NCBI Desc: cog2264: ribosomal protein l11 methylase [burkholderia dolosa auo158]
  misc_feature (151)..(281): NCBI GI: 60390319 NCBI Desc: ribosomal protein l11 methyltransferase (l11 mtase)
MLLSLVRAGSAPLRRVVSTFSSTRAVSPRFRCAISSGGNLNLPLYAHPSPSRDGSSGPAGGARRGMSFCARAVDVGDEAASSSAAVGSDLSAPYLSVRIRCRRHDVEALSEALLCFGASSVTVDDIADAENLDEISITSLYADGEDVDSSVSSAASSAGLNYSPVYETSVGKQCDWVANVQETYEPTEVADGLWVVPKWRTPPDPEATNIIIDPGLAFGMGEHPTTKLCLLFLREVIKGGERVLDYGTGTGVLGIAALKMGATQSTGIDIDPQAITSASENLLLNGLHSNQMHVYLVLTNAQPSCFPSAINKSEDHHSTNNLDLKFSRGTYDVVAANILLNPLLELVEDIVGYAKPGGIIAVSGILEEQVPKIKEVYSRYLDRILVSEMDGWACLQGIRRV

SEQ ID NO: 11935 - DNA, 1077 bp, Sorghum bicolor
  misc_feature: Ceres ANNOT ID no. 6040214
  misc_feature: Encodes the peptide sequence at SEQ ID NO 11936
atggaggccaccccgatctccgtgaaaccaccgtcgccggcgctggcggcgccacccccggccacgctggggcccagggacatgccaacgcatgccgtcggagggaccgagctggagccgtccagcatgaaccagctggcaatagccccggaccccaagcggcagagggtagaggaggctgcggatggtaacgggtgcaagcattgcgcctgcaagaagtccagatgcttgaactattgcccatgtttttctggaggtggttattgttctgataagtgtggctgccaaccatgtttcaacaaagaagctttttcagaaacagttcagactactcgcaaggtgttactttcaagacagaagcgtatgtcaatgaaaattaataggagacctgaggcaaatgctgaacctatggaagatgctcaccattcttcttcttcaactccaccaaggagaggttgcaactgcaagaaatcaagttgcctaaagaaatactgtgattgctaccaggatgggaccggatgttccttgttttgccgttgtgacgattgccagaatccttttgggaaaaatgaaggcataatagctgatgatagtaagcgctatctatatactggtgctgatttggatcacagcgagggtgaacatgactttgttgtggagcgctcgcctcgtctacaatcacctatctcgaaggagtcttctttccaccaaaccccacctcatcttagggtctcaagcagagacacacatgtgttcccacaggcgatatcccagtggcaggcactgccccgctcgtggcagcattgtgccaacaagaggaacagcaatgacagggtgatggacgactctgcaaactacaagaactcaaaccatgactggcagctatccaagcacgaggacagctacagcatatcgaagtgcgtccagatcctgaacggcatggtggagctgtcacaggtggagaaatcagttgcccccgatgtcttcctgcagccaggcaaccgggaaattttcatctccctcagcggcgatgtgcgcgccatgtggctgaagcgcaagattcagcacctggcctag

SEQ ID NO: 11936 - protein, 358 aa, Sorghum bicolor
  misc_feature: Ceres ANNOT ID no. 6040214
  misc_feature (64)..(104): Pfam Id: CXC Pfam Desc: Tesmin/TSO1-like CXC domain
  misc_feature (148)..(189): Pfam Id: CXC Pfam Desc: Tesmin/TSO1-like CXC domain
  misc_feature (41)..(255): NCBI GI: 7767427 NCBI Desc: cxc domain containing tso1-like protein 1 [arabidopsis thaliana]
  misc_feature (50)..(253): NCBI GI: 51949820 NCBI Desc: cysteine-rich polycomb-like protein 1 [lotus corniculatus var. japonicus]
  misc_feature (50)..(253): NCBI GI: 40241253 NCBI Desc: cysteine-rich polycomb-like protein [lotus corniculatus var. japonicus]
  misc_feature (53)..(336): NCBI GI: 9279696 NCBI Desc: dna binding protein-like [arabidopsis thaliana]
  misc_feature (30)..(195): NCBI GI: 4218187 NCBI Desc: cysteine-rich polycomb-like protein [glycine max]
MEATPISVKPPSPALAAPPPATLGPRDMPTHAVGGTELEPSSMNQLAIAPDPKRQRVEEAADGNGCKHCACKKSRCLNYCPCFSGGGYCSDKCGCQPCFNKEAFSETVQTTRKVLLSRQKRMSMKINRRPEANAEPMEDAHHSSSSTPPRRGCNCKKSSCLKKYCDCYQDGTGCSLFCRCDDCQNPFGKNEGIIADDSKRYLYTGADLDHSEGEHDFVVERSPRLQSPISKESSFHQTPPHLRVSSRDTHVFPQAISQWQALPRSWQHCANKRNSNDRVMDDSANYKNSNHDWQLSKHEDSYSISKCVQILNGMVELSQVEKSVAPDVFLQPGNREIFISLSGDVRAMWLKRKIQHLA

SEQ ID NO: 11937 - DNA, 651 bp, Sorghum bicolor
  misc_feature: Ceres ANNOT ID no. 6040272
  misc_feature: Encodes the peptide sequence at SEQ ID NO 11938
atgccggccagggcggcggccgcgtgcaccggcgcggcgggcatcaagctgttcggcaaggtcatcaccacgcagccgccgcagcagcccatgcagcacgcgccgccgaggctgcagcagcagcaggcgtcgtcggggcgcgggaacaacgccgacctgctggaggaggtggcgcgggcgcgcgcggcggcggccgaggtgcggctgccgtgcccacgctgcttgagccgggacaccaagttctgctacttcaacaactacaacgtcaaccagccgcgccacttctgccgggcctgccaccgctactggacggccggcggcgcgatccgcaacgtgccgatcggctccggccgccgcaagaaccgccccgtgctgctcccaccgccggcgccgcatcacgctgccaccgccaccgccagcagcgccgacgataacgaccaccgctcgggctcggggtctcctccggtgttcacgtctgtgttcaccgcgccctacctcggcggctccccctcccagttcaccacatcgccggcttacgccgccgccgccgccgctgccgccggccacccggggacgacgacggggcagtgcttgtggctggtggcgaccacagatcgtcctgttgcatcggaccgcgcttttctgatatga

SEQ ID NO: 11938 - protein, 216 aa, Sorghum bicolor
  misc_feature: Ceres ANNOT ID no. 6040272
  misc_feature (64)..(126): Pfam Id: zf-Dof Pfam Desc: Dof domain, zinc finger
  misc_feature (11)..(179): NCBI GI: 21538787 NCBI Desc: dof zinc finger protein [hordeum vulgare subsp. vulgare]
  misc_feature (8)..(123): NCBI GI: 15218846 NCBI Desc: dof-type zinc finger domain-containing protein [arabidopsis thaliana]
  misc_feature (1)..(142): NCBI GI: 21644621 NCBI Desc: dna-binding protein dof2-like [oryza sativa (japonica cultivar-group)]
  misc_feature (22)..(141): NCBI GI: 63034231 NCBI Desc: dof domain zinc finger dna-binding protein [picea abies]
  misc_feature (69)..(117): NCBI GI: 115481940 NCBI Desc: os10g0406300 [oryza sativa (japonica cultivar-group)]
  misc_feature: The plant flowers significantly late compared to wild-type.
  misc_feature: The sequence is a functional homolog of SEQ ID NO 1122 in the 10/374,780US patent application
  misc_feature: The sequence is a functional homolog of SEQ ID NO 1133 in the 10/374,780US patent application
  misc_feature: The sequence is a functional homolog of SEQ ID NO 1145 in the 10/666,642US patent application
  misc_feature: The sequence is a functional homolog of SEQ ID NO 132 in the 10/412,699US patent application
  misc_feature: The sequence is a functional homolog of SEQ ID NO 1322 in the 10/412,699US patent application
  misc_feature: The sequence is a functional homolog of SEQ ID NO 192 in the 10/412,699US patent application
  misc_feature: The sequence is a functional homolog of SEQ ID NO 1920 in the 10/412,699US patent application
  misc_feature: The sequence is a functional homolog of SEQ ID NO 1968 in the 10/374,780US patent application
  misc_feature: The sequence is a functional homolog of SEQ ID NO 2182 in the 10/374,780US patent application
  misc_feature: The sequence is a functional homolog of SEQ ID NO 309 in the 11/479,226US patent application
  misc_feature: The sequence is a functional homolog of SEQ ID NO 408 in the 10/666,642US patent application
  misc_feature: The sequence is a functional homolog of SEQ ID NO 582 in the 11/435,388US patent application
  misc_feature: Useful for making plants with modulated flowering time
  misc_feature: Useful for making plants with modulated growth and phenotype characteristics
  misc_feature: The sequence is a functional homolog of SEQ ID NO 132 in the 20040045049 US patent application
  misc_feature: The sequence is a functional homolog of SEQ ID NO 1322 in the 20040045049 US patent application
  misc_feature: The sequence is a functional homolog of SEQ ID NO 192 in the 20040045049 US patent application
  misc_feature: The sequence is a functional homolog of SEQ ID NO 1920 in the 20040045049 US patent application
  misc_feature: The sequence is a functional homolog of SEQ ID NO 1133 in the 20060162006 US patent application
  misc_feature: Functional homolog of the protein sequence given in SEQ ID NO 13541
  misc_feature: The sequence is a functional homolog of SEQ ID NO 1920 in the 10/412,699 US patent application
  misc_feature: The sequence is a functional homolog of SEQ ID NO 2182 in the 10/374,780 US patent application
  misc_feature: The sequence is a functional homolog of SEQ ID NO 408 in the 10/666,642 US patent application
  misc_feature: Useful for making plants with modulated biomass
  misc_feature: The sequence is a functional homolog of SEQ ID NO. 379 in the 11/188,298 US application
  misc_feature: The sequence is a functional homolog of SEQ ID NO. 489 in the 11/188,298 US application
  misc_feature: The sequence is a functional homolog of SEQ ID NO. 486 in the 11/188,298 US application
MPARAAAACTGAAGIKLFGKVITTQPPQQPMQHAPPRLQQQQASSGRGNNADLLEEVARARAAAAEVRLPCPRCLSRDTKFCYFNNYNVNQPRHFCRACHRYWTAGGAIRNVPIGSGRRKNRPVLLPPPAPHHAATATASSADDNDHRSGSGSPPVFTSVFTAPYLGGSPSQFTTSPAYAAAAAAAAGHPGTTTGQCLWLVATTDRPVASDRAFLI

SEQ ID NO: 11939 - DNA, 2031 bp, Sorghum bicolor
  misc_feature: Ceres ANNOT ID no. 6040286
  misc_feature: Encodes the peptide sequence at SEQ ID NO 11940
atggggattgatctcaacagcgtggaggaggacgagcaggcgccggcgggcgcggtgtgctgcggggagctgtggcacgcgtgcgcgggggctggggtggcgctgccgcggcggggcagcgccgtggtgtacctgcctcaggcgcacctcgcggccggcggcgacggtggggagctgccggcccttgcggcggcgccgcgcgtgccgccgcacgtggtgtgtcgcgtcgtcgacgtcgagctacgcgcggatgcggcgacggacgaggtctatgcgcggcttgcgctggtggcggaggataagatgtttggccgaaacatccatgatggtgaaactgaagagaaggatggtgagaaagaggatggtgatggagaaaagctcacatcgcacatgttctgcaagacactcacagcttctgatacaagcactcatgggggattctctgttcctcggcgggctgcagaggactgctttccaccattggactatgagcagcttaggccttcccaagagcttattgccaaggatttgcatggcatgaaatggaggttccgtcatatctatagaggtcaacctcgtaggcatcttctgacaactggatggagttcatttattaataagaagaaactagtctcaggggatgcagtcttgtttctgagaggtagtgatggcgagctaagattgggtgtgaggagagcagttcaactgaaaaatgaagctctacttgaagctgtcaactgtactgattcgaagctacttatgctgtctgctgtggccagttctttggacaatagaagtatatttcacatctgtttcaacccaaggattggtgcatcagaatttattgtgccatattgcaagtttttgaagggcttgaactatcctttttcaattggaaccagatttaaagttggctgcaagaatgaagatgctaacgagaggtcctttggattgatctcaggtattagtgaagttgatcccatacgctggcctggatcaaaatggaaatctctcttggtaaagtgggatggtgataccaagtacagccaccagaatagagtatctccatgggacatcgagagagttggcagctcagtttcagttactcactgtctttcatcttgtgtttcgaagcgaatgaagttgtgcttcccccaaggcaatttggacgctccaattctagatggaaatggtcgtccagactctgtgggaactgaaggtttccaccaggtcttgcaaggtcaagaattggtgagggttcatggtgctgcatgctctcattcatcagatacccccagatgtcaaggctcttatggaaggagattctctgccgatgtgtggaactgcaagatgaatgatggacacctaaataccactgggtttgcttaccagcccctaggcttcagtgaatctgtcaaattctcagaggtcttgcaaggtcaagaaatgtctcaggtggcagccccttccttcatgagagatgctttcagtgctggcacacagaatggcagggttcgatcatttgattatgtgcagagatcagctgcaactcaaggatatgctctccagcaatttaatctgccagcaacagaagtgcattcaccgtcttctgttcttatgtttaaccaaaccatggtaccacagcctgagttagatggtctgaccaaccgtgaagaagcatatggcagcgggtactcatccattgcaatacagagagaagctgaaccatggccatccacgcagcagcaaagagtgcgcgaaaatggaagcgagcctctcgacacaactgaagcctcagctcctgcaaggatcgcaaaatctggatcggtggacaggggcgtcgggggaagcagctgtaagctttttggtttctccttgactgagaagatccttggaacagagggagttggtgggaaagaagggaactacgaagcggatcggcagactccccgggttctagacttgcttgggcacggccattctacgcccggtgctctgcatgctctttgcgctgctcccttgggaatatga

SEQ ID NO: 11940 - protein, 676 aa, Sorghum bicolor
  misc_feature: Ceres ANNOT ID no. 6040286
  misc_feature (258)..(339): Pfam Id: Auxin_resp Pfam Desc: Auxin response factor
  misc_feature (131)..(236): Pfam Id: B3 Pfam Desc: B3 DNA binding domain
  misc_feature (102)..(676): NCBI GI: 115464877 NCBI Desc: os05g0515400 [oryza sativa (japonica cultivar-group)]
  misc_feature (122)..(572): NCBI GI: 36939192 NCBI Desc: ettin-like auxin response factor [triticum aestivum]
  misc_feature (15)..(547): NCBI GI: 124360755 NCBI Desc: transcriptional factor b3; auxin response factor [medicago truncatula]
  misc_feature (2)..(552): NCBI GI: 19352033 NCBI Desc: arabidopsis ettin-like protein 1 [oryza sativa]
  misc_feature (1)..(559): NCBI GI: 19352035 NCBI Desc: arabidopsis ettin-like protein 2 [oryza sativa]
  misc_feature: The sequence is a functional homolog of SEQ ID NO 42 in the 10/838,616US patent application
  misc_feature: The sequence is a functional homolog of SEQ ID NO 696 in the 11/479,226US patent application
  misc_feature: Useful for making plants with modulated growth and phenotype characteristics
  misc_feature: The sequence is a functional homolog of SEQ ID NO 42 in the 20060008874 US patent application
  misc_feature: The sequence is a functional homolog of SEQ ID NO 696 in the 20070022495 US patent application
  misc_feature: The sequence is a functional homolog of SEQ ID NO 696 in the 11/479,226 US patent application
MGIDLNSVEEDEQAPAGAVCCGELWHACAGAGVALPRRGSAVVYLPQAHLAAGGDGGELPALAAAPRVPPHVVCRVVDVELRADAATDEVYARLALVAEDKMFGRNIHDGETEEKDGEKEDGDGEKLTSHMFCKTLTASDTSTHGGFSVPRRAAEDCFPPLDYEQLRPSQELIAKDLHGMKWRFRHIYRGQPRRHLLTTGWSSFINKKKLVSGDAVLFLRGSDGELRLGVRRAVQLKNEALLEAVNCTDSKLLMLSAVASSLDNRSIFHICFNPRIGASEFIVPYCKFLKGLNYPFSIGTRFKVGCKNEDANERSFGLISGISEVDPIRWPGSKWKSLLVKWDGDTKYSHQNRVSPWDIERVGSSVSVTHCLSSCVSKRMKLCFPQGNLDAPILDGNGRPDSVGTEGFHQVLQGQELVRVHGAACSHSSDTPRCQGSYGRRFSADVWNCKMNDGHLNTTGFAYQPLGFSESVKFSEVLQGQEMSQVAAPSFMRDAFSAGTQNGRVRSFDYVQRSAATQGYALQQFNLPATEVHSPSSVLMFNQTMVPQPELDGLTNREEAYGSGYSSIAIQREAEPWPSTQQQRVRENGSEPLDTTEASAPARIAKSGSVDRGVGGSSCKLFGFSLTEKILGTEGVGGKEGNYEADRQTPRVLDLLGHGHSTPGALHALCAAPLGI

SEQ ID NO: 11941 - DNA, 1020 bp, Sorghum bicolor
  misc_feature: Ceres ANNOT ID no. 6040389
  misc_feature: Encodes the peptide sequence at SEQ ID NO 11942
atggaggaaagctccggagagagagctccttccactccgcagctgctgaacctcatccgagacgagagagaatggaaggtgatcagagaggcggaagatggagggggctcatcaaccaccagaagccctgatgtcgaggacgattccaagcttgagctgaagctcggcctccctggcgcccaagatgatgagagaatggcgcggcaaggagagaagatggagcaacagcaggagagctgcacggtactctcccttggttctggttgcttcccatcgcattccaagctcgccaccagcactggtgctactaccaccggggcaaagagagggttcttggcaaccgttggtgccaaagcagaaggttgtaagcagaggcaggaggacagggaagggtgtgggaatgagttattaacattgggaggtgaaaacatggcaggtgagaggaagaaagggtgctgtcccccgtcgtcgtcgcatgactcggctgctgggcctgctgtgcacagcagcaacccccacctgacgagaggctctgttcttccagtggttggttggcctccagtacggtccttcaggagaaacctcacaaatgtcagctcatctaagcaatcccctgaccaacaaaacgatgaagcttgtgacaaggcgaaacaaacttgcaagagaagcccacttatcaaaataaacatggacggcatccccattggaaggaaaataaacctctcagcatacaacaactatcagaagctgtcatctgccgtcgaagatttgttttgtggctttcttgaagctgcccaaaaggatttagcctgttctgaaattggagagcaaggagcagaagagaaaatattttcagggttgttggatggaactggtgaatacactttaatttttgaagacagtgaaggaggcaggacactagttggggacctaccatggaatgtatttgtttctactgctaagaggctgagggttatgaaaagctctgaacttcctcatgtcctgttcctcaattcttag

SEQ ID NO: 11942 - protein, 339 aa, Sorghum bicolor
  misc_feature: Ceres ANNOT ID no. 6040389
  misc_feature (52)..(332): Pfam Id: AUX_IAA Pfam Desc: AUX/IAA family
  misc_feature (1)..(333): NCBI GI: 75252102 NCBI Desc: auxin-responsive protein iaa18 (indoleacetic acid-induced protein 18)
  misc_feature (1)..(335): NCBI GI: 75246515 NCBI Desc: auxin-responsive protein iaa6 (indoleacetic acid-induced protein 6)
  misc_feature (68)..(331): NCBI GI: 75258740 NCBI Desc: auxin-responsive protein iaa7 (indoleacetic acid-induced protein 7)
  misc_feature (169)..(335): NCBI GI: 21593333 NCBI Desc: phytochrome-associated protein 1 (pap1) [arabidopsis thaliana]
  misc_feature (169)..(335): NCBI GI: 4093155 NCBI Desc: phytochrome-associated protein 1 [arabidopsis thaliana]
  misc_feature: The sequence is a functional homolog of SEQ ID NO 1149 in the 10/412,699US patent application
  misc_feature: The sequence is a functional homolog of SEQ ID NO 1757 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 1757 in the 20070022495 US patent application
  misc_feature: The sequence is a functional homolog of SEQ ID NO 1757 in the 11/479,226 US patent application
  misc_feature: Useful for making plants with altered lignin content
  misc_feature: Useful for making plants with modulated nitrogen use efficiency
  misc_feature: Functional homolog of the protein sequence given in SEQ ID NO 13704
MEESSGERAPSTPQLLNLIRDEREWKVIREAEDGGGSSTTRSPDVEDDSKLELKLGLPGAQDDERMARQGEKMEQQQESCTVLSLGSGCFPSHSKLATSTGATTTGAKRGFLATVGAKAEGCKQRQEDREGCGNELLTLGGENMAGERKKGCCPPSSSHDSAAGPAVHSSNPHLTRGSVLPVVGWPPVRSFRRNLTNVSSSKQSPDQQNDEACDKAKQTCKRSPLIKINMDGIPIGRKINLSAYNNYQKLSSAVEDLFCGFLEAAQKDLACSEIGEQGAEEKIFSGLLDGTGEYTLIFEDSEGGRTLVGDLPWNVFVSTAKRLRVMKSSELPHVLFLNS

SEQ ID NO: 11943 - DNA, 600 bp, Sorghum bicolor
  misc_feature: Ceres ANNOT ID no. 6040446
  misc_feature: Encodes the peptide sequence at SEQ ID NO 11944
atggccaccttgaaggaccatggtgccgtggtggcaatggtagcggtgatcttcctcgccgccgctgccctctcgtctcatgcgtcggcgactgcggtcgacgagccggctaagtataagcccacggcaccggcgccgtcccctgcatcgcactcctcgccgcccccgccgcgggtcgtccagcccgtgatcgtcgtgcaaggcctcatctactgcaagtcctgcaagctcaagggctacaacagcggcatggacgcgtcccctctccccaatgcgacggcgagcctggtgtgctacggcgacgaggacagcaagttccgggtgctgaaccagacgagcacggccacggacaagaacggctacttcctcgtgatggtgtacgacgtggacatgttcgaccggcacagctgcaggctgtacctgcgctcgtcgccgacgccgctctgcgccgcgcccttcgtcccgtccaaccccaagctggggctcaccctcgtgagggaccggaaggccacggcgcccaggggcgcgcgcggcatcttccaccccaagaccgcgctcatgtacgcgccggccaccgccggcaagtgcccgccgtattga

SEQ ID NO: 11944 - protein, 199 aa, Sorghum bicolor
  misc_feature: Ceres ANNOT ID no. 6040446
  misc_feature (66)..(191): Pfam Id: Pollen_Ole_e_I Pfam Desc: Pollen proteins Ole e I family
  misc_feature (35)..(172): NCBI GI: 110816007 NCBI Desc: hyprp1 [gossypium hirsutum]
  misc_feature (34)..(164): NCBI GI: 62421767 NCBI Desc: 120 kda pistil extensin-like protein [nicotiana plumbaginifolia]
  misc_feature (25)..(164): NCBI GI: 62421765 NCBI Desc: 120 kda pistil extensin-like protein [nicotiana tabacum]
  misc_feature (34)..(164): NCBI GI: 62421780 NCBI Desc: 120 kda pistil extensin-like protein [nicotiana bonariensis]
  misc_feature (34)..(164): NCBI GI: 62421776 NCBI Desc: 120 kda pistil extensin-like protein [nicotiana langsdorfii]
MATLKDHGAVVAMVAVIFLAAAALSSHASATAVDEPAKYKPTAPAPSPASHSSPPPPRVVQPVIVVQGLIYCKSCKLKGYNSGMDASPLPNATASLVCYGDEDSKFRVLNQTSTATDKNGYFLVMVYDVDMFDRHSCRLYLRSSPTPLCAAPFVPSNPKLGLTLVRDRKATAPRGARGIFHPKTALMYAPATAGKCPPY

SEQ ID NO: 11945 - DNA, 1542 bp, Sorghum bicolor
  misc_feature: Ceres ANNOT ID no. 6040486
  misc_feature: Encodes the peptide sequence at SEQ ID NO 11946
atgccgccgcactccctcgtctccctcctccccgccgcgtccatctcaccgcgaagacgccaagcaaagcaccacaaggcccccacagcgagccacttcctcttctcgcggagagttgtatcccagccgccgctccacgcctcgccctcccccacctccgccggcgggagcgggagcgggagcgacgagctccacctcctcgagaagccgtcacccaccgtcgcagaggataacgaggccgaggaggagcccgagcctgctccgttgctatcaacagaagaagccctcgcgcctttccttaagttcttccaggtgaagagcaccgaccccgacgcgggcgcgggcatcgcgggagaggcacgcgcggatggcgaggtgccggaggaggcgtcgaggagagatgcaatgtccaccgctggcgggcgtggggttagttactacgaccccaagcccggggacttcgtcgccggcgtcgtggtccggagcgacgggaggacgctcgacgtcgacatcggctccggtggcgaacttgcgctgatgctggccaaggagtcggcgccggtgcccggggaggagttcgggttcctggcgtgcgacgtcgcgtccgagcgtgcgacggagttcgcggcggaagggcgggtaggcgtcgtgatcaggcaggtcagcgcaggagagggcgacgaggaggcgacggttgggaggaatgggaaggcgaaaggtgcgcgggtgctgcgcgccggtacgatcgtgttcgctgaggtcctcggtcgaacacttggcgggcggccgctgctgtccgcgcgcaggctgttccggcgcgtcgcgtggcacagagcgaggcagataaaacagctaaatgtacccatcaaggtcaaaatttatgagtggaatgctagtggcttgctgtctagaattgagggccttcgggcattccttcccaagcctgagatgatgactagaccaagaaatttcactgacctaaagaataaagttggtcaagaaatgcgcgtatgtattacaaggattgatcaagggaataacgaattgataattagtgaaaaagaagcatgggcggtggcataccttagagaaggaactctcttgcaaggtacagtacgcaagttgtttccatatggtgcacaaattaggattggtgagactaacagaggtggtttactgcatatctcgaacatgacaaatggtgagctgagatctgtggctgatgtgctgaaagtcggcgacacggtgaaagctcttgtcataaaatcaactccagacagaattgccctcagcacaaaggaactcgagagcgaaccaggattgcttctcactaacaaagagaaggtgttttctgaggctgaagagatggcccaaagataccgggagcaaattgcaaagccacctagatccatcgccgcggaggactcctgcgacgatgctgtccccttcgacgacgaagccctgtcctatgctaactggaagtggctgaaattcagcaagtctggcgacgtaccaaaccccaaatctggcgccgaatcgtga

SEQ ID NO: 11946 - protein, 513 aa, Sorghum bicolor
  misc_feature: Ceres ANNOT ID no. 6040486
  misc_feature (361)..(433): Pfam Id: S1 Pfam Desc: S1 RNA binding domain
  misc_feature (1)..(513): NCBI GI: 115465119 NCBI Desc: os05g0535800 [oryza sativa (japonica cultivar-group)]
  misc_feature (140)..(502): NCBI GI: 53792249 NCBI Desc: 30s ribosomal protein s1-like [oryza sativa (japonica cultivar-group)]
  misc_feature (144)..(498): NCBI GI: 7239499 NCBI Desc: contains s1 rna binding domain pf00575. est gbai997850 comes from this gene. [arabidopsis thaliana]
  misc_feature (144)..(498): NCBI GI: 15217547 NCBI Desc: s1 rna-binding domain-containing protein [arabidopsis thaliana]
  misc_feature (144)..(337): NCBI GI: 62320614 NCBI Desc: ribosomal protein [arabidopsis thaliana]
MPPHSLVSLLPAASISPRRRQAKHHKAPTASHFLFSRRVVSQPPLHASPSPTSAGGSGSGSDELHLLEKPSPTVAEDNEAEEEPEPAPLLSTEEALAPFLKFFQVKSTDPDAGAGIAGEARADGEVPEEASRRDAMSTAGGRGVSYYDPKPGDFVAGVVVRSDGRTLDVDIGSGGELALMLAKESAPVPGEEFGFLACDVASERATEFAAEGRVGVVIRQVSAGEGDEEATVGRNGKAKGARVLRAGTIVFAEVLGRTLGGRPLLSARRLFRRVAWHRARQIKQLNVPIKVKIYEWNASGLLSRIEGLRAFLPKPEMMTRPRNFTDLKNKVGQEMRVCITRIDQGNNELIISEKEAWAVAYLREGTLLQGTVRKLFPYGAQIRIGETNRGGLLHISNMTNGELRSVADVLKVGDTVKALVIKSTPDRIALSTKELESEPGLLLTNKEKVFSEAEEMAQRYREQIAKPPRSIAAEDSCDDAVPFDDEALSYANWKWLKFSKSGDVPNPKSGAES

SEQ ID NO: 11947 - DNA, 606 bp, Sorghum bicolor
  misc_feature: Ceres ANNOT ID no. 6040555
  misc_feature: Encodes the peptide sequence at SEQ ID NO 11948
atggaatccgacgccgaggaggaggcggcggcgaccccggcggccgcgggggcaccaggcgctgggcggctgaaggggagcccggagctgactgtggacgcggacatgcgggagatggcgaagaccgccgcgtggagcgtcagttcctgcaaggccggcaacggcgtcgcggccctgcgcgacgacaacctcgacacctactggcagtctgatggggcgcagccgcacctggtgaacatccagttccagaagaaggtgcagctgcagcttgttgcgctctacgtggatttcaagctcgacgagagctacacgccgagcaagatctccatccgtgccggggatggcttccacaaccttaaggagattaaaactgtggagcttgcaaagccagttggatgggtccatatatcattatccggggctgatccacgagaaacattcattcacacatttatgctccaaattgcggttttatccaatcatctgaacgggagggatactcatgtccgacagatcaagatctatgggccaagaccgaatcctgttcctgcccagccgtttcatttcacttccagggagttcatcacatactctactattagatga

SEQ ID NO: 11948 - protein, 201 aa, Sorghum bicolor
  misc_feature: Ceres ANNOT ID no. 6040555
  misc_feature (7)..(200): Pfam Id: APC10 Pfam Desc: Anaphase-promoting complex, subunit 10 (APC10)
  misc_feature (1)..(201): NCBI GI: 5091606 NCBI Desc: 10a19i.10 [oryza sativa (japonica cultivar-group)]
  misc_feature (1)..(201): NCBI GI: 115465645 NCBI Desc: os05g0579800 [oryza sativa (japonica cultivar-group)]
  misc_feature (36)..(201): NCBI GI: 4836700 NCBI Desc: anaphase promoting complex subunit 10 [homo sapiens]
  misc_feature (36)..(201): NCBI GI: 13528834 NCBI Desc: anapc10 protein [homo sapiens]
  misc_feature (36)..(201): NCBI GI: 119625457 NCBI Desc: anaphase promoting complex subunit 10, isoform cra_b [homo sapiens]
MESDAEEEAAATPAAAGAPGAGRLKGSPELTVDADMREMAKTAAWSVSSCKAGNGVAALRDDNLDTYWQSDGAQPHLVNIQFQKKVQLQLVALYVDFKLDESYTPSKISIRAGDGFHNLKEIKTVELAKPVGWVHISLSGADPRETFIHTFMLQIAVLSNHLNGRDTHVRQIKIYGPRPNPVPAQPFHFTSREFITYSTIR

SEQ ID NO: 11949 - DNA, 804 bp, Sorghum bicolor
  misc_feature: Ceres ANNOT ID no. 6040581
  misc_feature: Encodes the peptide sequence at SEQ ID NO 11950
atggatttgcaagagaagacaacccccactcatcaagggaaagaaaagaaaaaagggagtgcaaagaaaaaagaaagaggaaagaagagaacatcatctgttttggattctgctaatggcacagtcatcagtgaggaaatgtctgagtataatcttgatgaacccactatggaggaaaaactcgcaaccttaaatctgatcaatagagagaatggaatgagtgatactgaaaagcaatcgctctctatggcaccaccaagtgcagattcggttcatatcttgctgaagcaagctcttcgtgctgatgataacgtagcattgttgacttgtttgcataatagagatgagaaggttatcacaaagtctatatcactcctaacaccagcagatgttgtgaagcttctcaagttctttgtgctgcaaatacaatctaggggcgcagtgttggtttgtttactcccatggctgcaaactttactaagtcgacacatgagcagcatagtgtctcaggagtcttctctgtcattgctcaactcgctctaccagcttattgatgcaagaacatcaacattcaagtcggcattgcaactctccaccactctagattaccttttcagcgagattgctgacgatgaagctgatgaggaggaggtaccgccaccgataatttatgaagacaaggacactgatgatgaagagtctgaagttgatgctatggaaaccgacagagaagaggctgaagagctaggtgatgttactgatgcctctgaaaattcagatggaagtgagatcatgagcgactga

SEQ ID NO: 11950 - protein, 267 aa, Sorghum bicolor
  misc_feature: Ceres ANNOT ID no. 6040581
  misc_feature (119)..(205): Pfam Id: NUC189 Pfam Desc: NUC189 domain
  misc_feature (8)..(260): NCBI GI: 5103840 NCBI Desc: f9l1.38 [arabidopsis thaliana]
  misc_feature (44)..(267): NCBI GI: 12038917 NCBI Desc: spac20h4.01 [schizosaccharomyces pombe]
  misc_feature (56)..(263): NCBI GI: 59800440 NCBI Desc: u3 small nucleolar rna-associated protein 5 (u3 snorna-associated protein 5)
  misc_feature (53)..(263): NCBI GI: 119620927 NCBI Desc: hcg16536, isoform cra_a [homo sapiens]
  misc_feature (53)..(263): NCBI GI: 452523 NCBI Desc: kiaa0007 [homo sapiens]
MDLQEKTTPTHQGKEKKKGSAKKKERGKKRTSSVLDSANGTVISEEMSEYNLDEPTMEEKLATLNLINRENGMSDTEKQSLSMAPPSADSVHILLKQALRADDNVALLTCLHNRDEKVITKSISLLTPADVVKLLKFFVLQIQSRGAVLVCLLPWLQTLLSRHMSSIVSQESSLSLLNSLYQLIDARTSTFKSALQLSTTLDYLFSEIADDEADEEEVPPPIIYEDKDTDDEESEVDAMETDREEAEELGDVTDASENSDGSEIMSD

SEQ ID NO: 11951 - DNA, 789 bp, Sorghum bicolor
  misc_feature: Ceres ANNOT ID no. 6040587
  misc_feature: Encodes the peptide sequence at SEQ ID NO 11952
atgcggcttttctccggcgtcctcgattcttcttccgcgtttgcctccgccgtcctgggctccgtgtccgaccgcctcggattctcgcgcgtatttttcggtcgagcgagcccatccagcatgccggctctcgcttgtgaagccgcggcctcgtcttctgcggcagccggtgccgacccctgtgccggcgcccagaaaccatggctcttcgtcggtctggggaaccccgggcggatgtacaaaggcactcggcacaacgttggctttgagatgattgatgctattgcagaagctgagggcatttcagtcagcagtaagcaatttaaggcgattgttggaaaaggcctcattggtgatgtccctgtaatgcttgccaagccacagacttttatgaatgcaagtggtgagtctgtgggacagttggtttcatacttcaagataccactcaatcaattagttgtgatctatgatgatcttgatctaccctttgcgaaattgcgtctgctaccaaaggggggacatggtggacacaatgggatgaggagtattattgaccatttgaaacaaagccgcaatttcgcgcgtctaaggattggcattggacggccacctgaggagcagggtgctatcagttttgttctacagtcattcactgttcaagaaaaggaagagcttgaagtcgtgttccaaagaggcttgcaagcagtaagaattatggtacaggaaggattcaacaagagcgcacaatttgtgaacactccacccccagcagaaatgttgaatagatga

SEQ ID NO: 11952 - protein, 262 aa, Sorghum bicolor
  misc_feature: Ceres ANNOT ID no. 6040587
  misc_feature (69)..(252): Pfam Id: Pept_tRNA_hydro Pfam Desc: Peptidyl-tRNA hydrolase
  misc_feature (35)..(262): NCBI GI: 56785144 NCBI Desc: peptidyl-trna hydrolase-like [oryza sativa (japonica cultivar-group)]
  misc_feature (35)..(262): NCBI GI: 75285812 NCBI Desc: peptidyl-trna hydrolase, mitochondrial precursor (m-pth)
  misc_feature (16)..(261): NCBI GI: 30685853 NCBI Desc: peptidyl-trna hydrolase family protein [arabidopsis thaliana]
  misc_feature (40)..(176): NCBI GI: 140057191 NCBI Desc: peptidyl-trna hydrolase [medicago truncatula]
  misc_feature (16)..(138): NCBI GI: 6714302 NCBI Desc: f15h18.8 [arabidopsis thaliana]
  misc_feature (35)..(262): SWISSPROT Homolog: EC 3.1.1.29 Peptidyl-tRNA hydrolase, mitochondrial precursor
MRLFSGVLDSSSAFASAVLGSVSDRLGFSRVFFGRASPSSMPALACEAAASSSAAAGADPCAGAQKPWLFVGLGNPGRMYKGTRHNVGFEMIDAIAEAEGISVSSKQFKAIVGKGLIGDVPVMLAKPQTFMNASGESVGQLVSYFKIPLNQLVVIYDDLDLPFAKLRLLPKGGHGGHNGMRSIIDHLKQSRNFARLRIGIGRPPEEQGAISFVLQSFTVQEKEELEVVFQRGLQAVRIMVQEGFNKSAQFVNTPPPAEMLNR

SEQ ID NO: 11953 - DNA, 726 bp, Sorghum bicolor
  misc_feature: Ceres ANNOT ID no. 6040616
  misc_feature: Encodes the peptide sequence at SEQ ID NO 11954
atgttctcatcggcgcgccttgccgtccgccgagctgcctctcttggggcgggcctctgccgtgccgcggaggatcccttttcgcgaaggcttctccatgggcagctcctcccacgttcctttgcctccgatgcattcggacacaatttggatccacgtcagaattttaaccgttttaattttgtgcgtcaagatactcgttctaacgcacaagtcaacttcaacaacacagataatggtgcggcgatgtccaggacagcaactggagaaaaactttccagctcaagggagggcttccctttcagctctttgcgtgactttactaaggaccatgaacaatattctaagaagaagagagattttgtccatgtcttactgaagaaaaaaaagacatttgttactgtgacagactctgatggaaataaaaagacaggggcctccgctggttgtttggaggacaggaaagggcgatcccgactctctcggtatgcttctgaagcagtcggagagcatgtcggacgatccgccaggaagatgggtttaacctctgttgtcttgaaagtgaaaggggctgctttcttcaggaagaagaagaaagtgatcttgagcttcagagaaggtttccgaggcgaaagagtgagagatcgatctcctatcatgtacatccatgatgtgacccaacttccacataatggatgccgactccggaagcaacgccgggtgtag

SEQ ID NO: 11954 - protein, 241 aa, Sorghum bicolor
  misc_feature: Ceres ANNOT ID no. 6040616
  misc_feature (122)..(240): Pfam Id: Ribosomal_S11 Pfam Desc: Ribosomal protein S11
  misc_feature (104)..(219): NCBI GI: 32348800 NCBI Desc: small subunit ribosomal protein [dendrocalamus strictus]
  misc_feature (104)..(219): NCBI GI: 32348792 NCBI Desc: small subunit ribosomal protein [typha sp. qiu 94061]
  misc_feature (104)..(219): NCBI GI: 32348798 NCBI Desc: small subunit ribosomal protein [juncus sp. qiu 94042]
  misc_feature (104)..(219): NCBI GI: 32348788 NCBI Desc: small subunit ribosomal protein [disporum hookeri]
  misc_feature (104)..(219): NCBI GI: 32348794 NCBI Desc: small subunit ribosomal protein [cocos nucifera]
MFSSARLAVRRAASLGAGLCRAAEDPFSRRLLHGQLLPRSFASDAFGHNLDPRQNFNRFNFVRQDTRSNAQVNFNNTDNGAAMSRTATGEKLSSSREGFPFSSLRDFTKDHEQYSKKKRDFVHVLLKKKKTFVTVTDSDGNKKTGASAGCLEDRKGRSRLSRYASEAVGEHVGRSARKMGLTSVVLKVKGAAFFRKKKKVILSFREGFRGERVRDRSPIMYIHDVTQLPHNGCRLRKQRRV

SEQ ID NO: 11955 - DNA, 816 bp, Sorghum bicolor
  misc_feature: Ceres ANNOT ID no. 6040636
  misc_feature: Encodes the peptide sequence at SEQ ID NO 11956
atgaccgtgatcgacatcctcacgcgggtggacgcgatctgccagaagtacgacaagtacgacgtcgacaagctcaacggcgccaacgtcgccggcgacgaccccttcgcccgcctctacgcgtccgtcgacgcggacatcaaccaatgcgtcgagaaagcagaaacggcaaagcaagagaagaaccgcgccgcggtggtggcgcttaacgccgagatccggcgcaccaaggccaagctcatcgaggaggacctgcccaagctgcagcgcctcgccgtgaagaaggtgaaagggctcacaagagaagaaattgcgacccgtagtgatctggttgccgccttacctgacagaatacaatctatcccagatggtagttctaccgccacaaagaaaaatggaacttgggggggagcctcaggatctcgtactggaggagccataaagttcgactctactgctgatgggaactttgatgacgagtactttaaggggacagaagaatctaatcagttccgtcgggaatatgagatgcggagaatgaaacaggatgaaggtttggacgttattggtgaaggactggaaactttgaaaaacatggcatctgatatgaatgaggaattggatagacaagtccctctgatggacgaaatggatgacaaggtggatagagccaatgcagatttgaagaataccaatgtgagactgaaggagactgttcttcagcttagatcaagccgcaacttctgcatcgacatcatccttctgtgtgtcattcttggtattgcggcctacctttacaatgttctaaaaaagtga

SEQ ID NO: 11956 - protein, 271 aa, Sorghum bicolor
  misc_feature: Ceres ANNOT ID no. 6040636
  misc_feature (181)..(243): Pfam Id: SNARE Pfam Desc: SNARE domain
  misc_feature (1)..(271): NCBI GI: 115465329 NCBI Desc: os05g0553700 [oryza sativa (japonica cultivar-group)]
  misc_feature (1)..(269): NCBI GI: 13811650 NCBI Desc: syntaxin of plants 72 [arabidopsis thaliana]
  misc_feature (1)..(270): NCBI GI: 87241198 NCBI Desc: target snare coiled-coil region [medicago truncatula]
  misc_feature (1)..(242): NCBI GI: 140042792 NCBI Desc: t-snare [medicago truncatula]
  misc_feature (1)..(270): NCBI GI: 13811652 NCBI Desc: syntaxin of plants 73 [arabidopsis thaliana]
  misc_feature: The sequence is a functional homolog of SEQ ID NO. 342 in the 11/188,298 US application
MTVIDILTRVDAICQKYDKYDVDKLNGANVAGDDPFARLYASVDADINQCVEKAETAKQEKNRAAVVALNAEIRRTKAKLIEEDLPKLQRLAVKKVKGLTREEIATRSDLVAALPDRIQSIPDGSSTATKKNGTWGGASGSRTGGAIKFDSTADGNFDDEYFKGTEESNQFRREYEMRRMKQDEGLDVIGEGLETLKNMASDMNEELDRQVPLMDEMDDKVDRANADLKNTNVRLKETVLQLRSSRNFCIDIILLCVILGIAAYLYNVLKK

SEQ ID NO: 11957 - DNA, 306 bp, Sorghum bicolor
  misc_feature: Ceres ANNOT ID no. 6040684
  misc_feature: Encodes the peptide sequence at SEQ ID NO 11958
atgcaaatgagtgccggtggtgcttttggtggaaataggggggtgaggcctgtacctcctgaaaaaggtgtattcccattggatcacttacatgagtgtgacttggagaagaaagactatctttcttgcctgaaatctacaggattccagtctgaaaaatgtcggctgttctcaaagaagtatctggaatgtcggatggagagaaacttgatggcaaagcaagacatgtcagagcttgggttcagaattgtggacgaagtggatatatctcctgacaaagaacagcaaactggagagccctcctaa

SEQ ID NO: 11958 - protein, 101 aa, Sorghum bicolor
  misc_feature: Ceres ANNOT ID no. 6040684
  misc_feature (26)..(67): Pfam Id: CHCH Pfam Desc: CHCH domain
  misc_feature (1)..(94): NCBI GI: 115445755 NCBI Desc: os02g0313500 [oryza sativa (japonica cultivar-group)]
  misc_feature (5)..(99): NCBI GI: 18408552 NCBI Desc: cox19 family protein [arabidopsis thaliana]
  misc_feature (3)..(82): NCBI GI: 92879471 NCBI Desc: 2-oxo acid dehydrogenase, lipoyl-binding site; chch [medicago truncatula]
  misc_feature (16)..(100): NCBI GI: 74682963 NCBI Desc: cytochrome c oxidase assembly protein cox19
  misc_feature (3)..(96): NCBI GI: 37574050 NCBI Desc: riken cdna 2810437l13 [mus musculus]
MQMSAGGAFGGNRGVRPVPPEKGVFPLDHLHECDLEKKDYLSCLKSTGFQSEKCRLFSKKYLECRMERNLMAKQDMSELGFRIVDEVDISPDKEQQTGEPS

SEQ ID NO: 11959 - DNA, 1311 bp, Sorghum bicolor
  misc_feature: Ceres ANNOT ID no. 6040748
  misc_feature: Encodes the peptide sequence at SEQ ID NO 11960
atggagccgaagcgggtgttggcagggcccgaccggctctcctccctcccggcggagctgcgggacgagatcctcgtccgcctcgacctccgggacgccgtgcgcacctccgtgctctcccgcacctggcgccacctctggaagtcgctctcggtactctccctctccttccccttcggcacgcacccctcggtcgtcgacagcgtcctcctcccctacatcggcccccgcgtctccctcttcgacatctgcgtcgacgacgagtctgccggccgcatcgacgattggttcgccgcgctctcccgctgccgcgtcgagtccatccacatgtgtggccgactcagatcaggctacttcaacctccactcctccatcttctccttcggtgatctcgtgtccctgcggttgcgatgctgcaacatcccacccctccccgtaggattcgctggcttccccacgctccaggagctcgacctcatctttgttgtcttcccagccaatggggacaaacagttggaggctatcattcgtcggtcacccttgcttcgtaccctggatatgtttgatgtatgcatctctgatgactacccagaatcagtgattgaggcgcccaatctccgtatcctatcaatctattcagagtatgactatggctggcgatttggagagctgccgtgcctcgaatatgccaacattgatctgttgttctgtccgcagcatgaacgtgattttggagatttccttgctcggtttgctcacgttcaaaagctcagtctcttctcgccggctgatgatgttaagatgccgtatacacttccattcaccttttataacttgaagaacttgatgttatctatggactttactgaaatgcgccccattttgttcatgtttaccttgctaaggagttgtgacaaccttcaaaagctagaaatagagtcgcgggacgtctttggtcagggttttgaggcagattgggagttcttaaatgctctgtggactgatggcatgtgtgccagtcttcaaattgtgcagatgagtcgtgtcatttggcttccaaatgaaattttacttatgaagcttatcctctctaaagcaaggcttcttcgcacattatatgttgatacacacccagatgattttgatgatccaataattgacttactaaaatgcaaaagagcttcagctcaagctcgtgtcctgtttgaagaagaaactgatgtgctattggttgttcactggttcagtaggatattcgtggtagtacccagagtagtttggttaatgaagcattcctccaaacttgcctga

SEQ ID NO: 11960 - protein, 436 aa, Sorghum bicolor
  misc_feature: Ceres ANNOT ID no. 6040748
  misc_feature (11)..(58): Pfam Id: F-box Pfam Desc: F-box domain
  misc_feature (11)..(404): NCBI GI: 51536004 NCBI Desc: f-box protein-like protein [oryza sativa (japonica cultivar-group)]
  misc_feature (4)..(402): NCBI GI: 42409041 NCBI Desc: f-box protein family-like protein [oryza sativa (japonica cultivar-group)]
  misc_feature (11)..(402): NCBI GI: 42409507 NCBI Desc: f-box protein family-like protein [oryza sativa (japonica cultivar-group)]
  misc_feature (2)..(257): NCBI GI: 42409506 NCBI Desc: f-box protein family-like protein [oryza sativa (japonica cultivar-group)]
  misc_feature (8)..(400): NCBI GI: 42409365 NCBI Desc: f-box protein family-like [oryza sativa (japonica cultivar-group)]
MEPKRVLAGPDRLSSLPAELRDEILVRLDLRDAVRTSVLSRTWRHLWKSLSVLSLSFPFGTHPSVVDSVLLPYIGPRVSLFDICVDDESAGRIDDWFAALSRCRVESIHMCGRLRSGYFNLHSSIFSFGDLVSLRLRCCNIPPLPVGFAGFPTLQELDLIFVVFPANGDKQLEAIIRRSPLLRTLDMFDVCISDDYPESVIEAPNLRILSIYSEYDYGWRFGELPCLEYANIDLLFCPQHERDFGDFLARFAHVQKLSLFSPADDVKMPYTLPFTFYNLKNLMLSMDFTEMRPILFMFTLLRSCDNLQKLEIESRDVFGQGFEADWEFLNALWTDGMCASLQIVQMSRVIWLPNEILLMKLILSKARLLRTLYVDTHPDDFDDPIIDLLKCKRASAQARVLFEEETDVLLVVHWFSRIFVVVPRVVWLMKHSSKLA

SEQ ID NO: 11961 - DNA, 738 bp, Sorghum bicolor
  misc_feature: Ceres ANNOT ID no. 6040823
  misc_feature: Encodes the peptide sequence at SEQ ID NO 11962
atggcgcctccacgccggccgagcatggggcggcaaaagatcgagatccggcgcatagaaagcgacgaggcgcggcaggtgtgcttctccaagcgccgcgcggggctgttcaagaaggccagcgagctctccatcctctgcggcgccgacgtagccgccgtcgtcttctcccccgccggcaaggccttctcgttcggccacccttccgtggagtccgtcgtcgagcgcttcctcgcctcctcctccccctcgcctgcaggtgccggtgccggccactcctccgccggcggcggcgaggaccgcgcggtctcggagctgaaccgccagcacggcgagctgcgcgcgcagctggacgcggagaagacgaggcaggagcgcgcggacgaggcgatccggaaggagcgcgaggcgaggagccccgccatggcgtggatcgacgcggacctgagcgccatgggccacgacgacctggtcgcattctggaccgcgctggctggcgtgcaggccgccgtggcggcgagcgccgaccagctgctgcgtgacgcgctgctcgtcgggcgcaggggccggcaccagcagcccgcccagcttgccggcggtggtgtggccttcgacgtcggcgcgtttggcattggcatgcaggtgcagccgcctccaggattcgccggcgtcgacctgcaggggttcggactcggaggacaggctgctgccatcctcggcgccgccggtccctcatga

SEQ ID NO: 11962 - protein, 245 aa, Sorghum bicolor
  misc_feature: Ceres ANNOT ID no. 6040823
  misc_feature (17)..(67): Pfam Id: SRF-TF Pfam Desc: SRF-type transcription factor (DNA-binding and dimerisationdomain)
  misc_feature (2)..(188): NCBI GI: 46806648 NCBI Desc: mads-box protein-like [oryza sativa (japonica cultivar-group)]
  misc_feature (6)..(179): NCBI GI: 140062386 NCBI Desc: transcription factor, mads-box [medicago truncatula]
  misc_feature (1)..(174): NCBI GI: 67633540 NCBI Desc: mads-box family protein [arabidopsis thaliana]
  misc_feature (10)..(164): NCBI GI: 92894432 NCBI Desc: transcription factor, mads-box [medicago truncatula]
  misc_feature (6)..(175): NCBI GI: 92894435 NCBI Desc: transcription factor, mads-box [medicago truncatula]
  misc_feature: The sequence is a functional homolog of SEQ ID NO 215 in the 11/479,226US patent application
  misc_feature: The sequence is a functional homolog of SEQ ID NO 348 in the 10/666,642US patent application
  misc_feature: The sequence is a functional homolog of SEQ ID NO 470 in the 11/435,388US patent application
  misc_feature: Useful for making plants with modulated growth and phenotype characteristics
  misc_feature: The sequence is a functional homolog of SEQ ID NO 470 in the 20060272060 US patent application
  misc_feature: The sequence is a functional homolog of SEQ ID NO 348 in the 20070033671 US patent application
  misc_feature: The sequence is a functional homolog of SEQ ID NO 1701 in the 10/412,699 US patent application
  misc_feature: Useful for making plants with modulated biomass
  misc_feature: Functional homolog of the protein sequence given in SEQ ID NO 13659
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 359 in the 11/188,298 US application
  misc_feature: The sequence is a functional homolog of SEQ ID NO. 377 in the 11/188,298 US application
  misc_feature: The sequence is a functional homolog of SEQ ID NO. 518 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 420 in the 11/188,298 US application
MAPPRRPSMGRQKIEIRRIESDEARQVCFSKRRAGLFKKASELSILCGADVAAVVFSPAGKAFSFGHPSVESVVERFLASSSPSPAGAGAGHSSAGGGEDRAVSELNRQHGELRAQLDAEKTRQERADEAIRKEREARSPAMAWIDADLSAMGHDDLVAFWTALAGVQAAVAASADQLLRDALLVGRRGRHQQPAQLAGGGVAFDVGAFGIGMQVQPPPGFAGVDLQGFGLGGQAAAILGAAGPS

SEQ ID NO: 11963 - DNA, 750 bp, Sorghum bicolor
  misc_feature: Ceres ANNOT ID no. 6040869
  misc_feature: Encodes the peptide sequence at SEQ ID NO 11964
atggcggaattgtcgacgtcttcggatggattggtggccgaagaagcgaggcagcaggaaccaggccaaggaagctctggaggtagtcatggtttgcaagacacaaaggagcaggaaataagaaaggggaaggcggctcttgtttccactgaactgctgagggaggatctggttcagagtgctgttacttttctgaaacacccaaaagtagtagcatcttcggatggacagaggcgatctttccttgaaaataaaggactcactatggatgaaatagatgaagcgtttcgacgtttacaaagcccatcatcgaattctgtgagctcagatatgtgcacatctcaagagaggttgttacctgaagctgaacctgtggcccctgtggtacctcgtcatccaaaatcatatatggagatcatggaaatgatacaaaggggtgagcgaccagatgatatccaggatattaatgatgaccctccaaatcctgatcaaccaatctcagaacctcgtatggcaccgaaaccaaagccatgggaaaagcaaggtcaaggaagttcggcctgggatttgaaatcaccacaaagggaacccgacgtgttgagatcagaagttcagcacgatggcaccaacaaggccacagagttggccgatgactctcaacaaggcggggactcattgctgcaagcagaagtagctgctggttctgaatctcctgcaactccgaatgaagccacttcttcgccggagtaa

SEQ ID NO: 11964 - protein, 249 aa, Sorghum bicolor
  misc_feature: Ceres ANNOT ID no. 6040869
  misc_feature (53)..(143): Pfam Id: Pex14_N Pfam Desc: Peroxisomal membrane anchor protein (Pex14p) conserved region
  misc_feature (100)..(194): NCBI GI: 11121113 NCBI Desc: peroxin pex14 [arabidopsis thaliana]
  misc_feature (100)..(194): NCBI GI: 11094252 NCBI Desc: pex14 [arabidopsis thaliana]
  misc_feature (47)..(116): NCBI GI: 115434046 NCBI Desc: os01g0107000 [oryza sativa (japonica cultivar-group)]
  misc_feature (54)..(136): NCBI GI: 111609732 NCBI Desc: peroxin 14 [penicillium chrysogenum]
  misc_feature (53)..(146): NCBI GI: 126139896 NCBI Desc: peroxisomal membrane protein per10 (peroxin-14) [pichia stipitis cbs 6054]
MAELSTSSDGLVAEEARQQEPGQGSSGGSHGLQDTKEQEIRKGKAALVSTELLREDLVQSAVTFLKHPKVVASSDGQRRSFLENKGLTMDEIDEAFRRLQSPSSNSVSSDMCTSQERLLPEAEPVAPVVPRHPKSYMEIMEMIQRGERPDDIQDINDDPPNPDQPISEPRMAPKPKPWEKQGQGSSAWDLKSPQREPDVLRSEVQHDGTNKATELADDSQQGGDSLLQAEVAAGSESPATPNEATSSPE

SEQ ID NO: 11965 - DNA, 1488 bp, Sorghum bicolor
  misc_feature: Ceres ANNOT ID no. 6040967
  misc_feature: Encodes the peptide sequence at SEQ ID NO 11966
  misc_feature: Up-regulated in shoot tissues in response to methyl jasmonate treatment
atggcgccccccaccgccaccgcctgcgcattcctctacccctcccctctccctcccgcatccctgcgcggcacgccccgcctgaccgtcggccggcgactcccgcggcccctccgcgcgggccgcccgcgcctgcatgcgccgccgccagcgcctcccacggtggcggaggccgcggaagagcgggacgacacgcctccgctcaggctgatcgggccgccgcaggaggacgaccctttcccgcccgagatggagcccgcggaccctgacttctaccggataggatacgcgcggatgatgcgcgcctacgggatcgagttcctcgaaggccccgacgggatgggcgtctacgcttcccgggacgtggagccactccgcagagctagagtgattatggagattccgttggagctgatgctgactataactcaaaggaaaccttggatgttcttccccgacattattccactaggccatcctatatttgacattattgagtcaacagatccagagacagattgggatctaagattagcatgtcttcttctatatgcatttgatatagaagacaacttttggcagttatattctgattttttgccaagtgctgatgaatgcactagtttgctgctggcaccaaaggaagatctaatggaactagaagatgaagatcttgcctcacaaatgttacaacaccagcggcgagcaattgacttttggcaaaagcattgggataaaccaattcctctcaaactgaaacggcttgcccgtgaccatgagagatttctctgggcgctgagtatcgtgcaatctcgttctgtaaacttgaagttgagaatgggagccttcatccaagatgcgaatgtgctagctccttatgctgatatgttgaaccactcaccaaatgctaattgcttcctgcattggcgttttaaagatcgtatgcttgaaattatgattaaggctggacacgctatcaagaaaggagatgagatgacaatagattacatgagtggcgtgaacagcaaatttatggaaagatatggcttctcatcaccaacgaatccttgggagctcataaatttctcgagccctgcaacgattcacatggattccttcttatcggtcttcaatattgctggcttgcatgatgagctgtaccacaattccacattgccctcagtagaaaccgactttgtggatggagcagttgtagcagcagccagagcattgccaacatggtcagacggcgacgttcctgcaatacctagcgtggagagaaaatctgctcaggcgctgcaagaggagtgccgccaaatgttggattcattctcgactaccattgaacaagaccagcagatcctagattccgatgtgcatatcaacaaaacccgagaaattgcaatcaagtatcggctgcaccgaaagatgctcctacagaaaatcatggatgcactggatatctaccaggataaaattttgttctag

SEQ ID NO: 11966 - protein, 495 aa, Sorghum bicolor
  misc_feature: Ceres ANNOT ID no. 6040967
  misc_feature (97)..(343): Pfam Id: SET Pfam Desc: SET domain
  misc_feature (137)..(482): NCBI GI: 3403236 NCBI Desc: ribulose-1,5-bisphosphate carboxylase/oxygenase small subunit n-methyltransferase i [spinacia oleracea]
  misc_feature (170)..(360): NCBI GI: 18395523 NCBI Desc: set domain-containing protein [arabidopsis thaliana]
  misc_feature (101)..(360): NCBI GI: 144923593 NCBI Desc: nuclear protein set [medicago truncatula]
  misc_feature (111)..(494): NCBI GI: 8778402 NCBI Desc: f16a14.25 [arabidopsis thaliana]
  misc_feature (105)..(460): NCBI GI: 85110711 NCBI Desc: related to histone-lysine n-methyltransferase [mips] [neurospora crassa n150]
  misc_feature: Up-regulated in shoot tissues in response to methyl jasmonate treatment
MAPPTATACAFLYPSPLPPASLRGTPRLTVGRRLPRPLRAGRPRLHAPPPAPPTVAEAAEERDDTPPLRLIGPPQEDDPFPPEMEPADPDFYRIGYARMMRAYGIEFLEGPDGMGVYASRDVEPLRRARVIMEIPLELMLTITQRKPWMFFPDIIPLGHPIFDIIESTDPETDWDLRLACLLLYAFDIEDNFWQLYSDFLPSADECTSLLLAPKEDLMELEDEDLASQMLQHQRRAIDFWQKHWDKPIPLKLKRLARDHERFLWALSIVQSRSVNLKLRMGAFIQDANVLAPYADMLNHSPNANCFLHWRFKDRMLEIMIKAGHAIKKGDEMTIDYMSGVNSKFMERYGFSSPTNPWELINFSSPATIHMDSFLSVFNIAGLHDELYHNSTLPSVETDFVDGAVVAAARALPTWSDGDVPAIPSVERKSAQALQEECRQMLDSFSTTIEQDQQILDSDVHINKTREIAIKYRLHRKMLLQKIMDALDIYQDKILF

SEQ ID NO: 11967 - DNA, 2064 bp, Sorghum bicolor
  misc_feature: Ceres ANNOT ID no. 6041002
  misc_feature: Encodes the peptide sequence at SEQ ID NO 11968
  misc_feature: Up-regulated in shoot tissues in response to salicylic acid treatment
atgtccttcactgggtccgcccctggatggaggcagctgattcggcaacagcggaagtcgctccccattgcgtcagtggagaagaggctagttgaggaggtgaggaagaacgacacgctgattattgttggtgagactgggagtggcaaaactactcagcttccacagtttttgtatgatggtgggttttgtaaggatggtaaagtcattggcatcactcagcctcgcagagttgcagctgttacagtagcaaagcgtgtagcggaggaatgcaatgaccagctcggcaaaaaggttggatactccatcagatttgatgattcgacatctaatgcaacaaggattaaatacatgactgatggtttgcttctgagggaagcacttttggatccactcttgtctaagtacagtgttatagttgtcgatgaggctcatgaaagaactgttcataccgatgtcttgttgggtttgttgaaaaaagtgcaacattcccgagctaatgccaataaaaatgggaagactttgcctgatgtacagggccattctcaaaatttaactcttaaggaatgccaaggaataagatgtgctcctctaaagctgataattatgtctgctagtttggatgctaagtgtttttctgattattttggtggtgctaaagctgtacatattcaaggtcggcaatatccggtcgacatactatatacttatcagcctgagtctgattatatggatgccacactagttactatctttcagatccatttggaggaagggcctggagacattctcgcatttctgacaggccaagaggagattgaatcactggagagacttattcatgagcgtgctcgtttatttccaccagaaagtagtaagatatgggttacacctatctattcatctctcccatcagaacagcaaatgaatgctttcaagccagcaccagctggaacccgcaaggtagttctagctacaaatattgctgagacttcagtaacaatacctggcatcaaatatgttatagatcctgggatggtaaaagctcgtgcttacaatcctgtgactggaatggaatcactaatcatcatcccagtctctaaagcgcaggctcttcaaaggagtggtcgtgctggacgcgagggaccagggaagtgcttccgattgttccaagaaagtgagtttgataaactggtggattctactgtgcctgagatcaagcggtgtaacctctcaaatgttgttctgcaactcaaggctcttggaattgatgacatcataggtttcgattttatggagaaaccatcaaggactgctattttgaaatcactggagcagttaatcttactaggggctctgactgatgattataagctctcagatccagttggtcatcagatggctaggctgcctttggatccaatgtactccaaggcattaatagtagccagcaaattcaagtgcttggaagaaatgctcattgttgtatctatgctttcagtggaatcaattttcttctctgtgcgtgagaagttagaagaggcaagagctgccaggaagggttttgaaagcgccgaaggagaccatatcacattggtgaatgtctatcgagcagctgcagaatgcttggagaagagcagaaatgcaaatgccaaagaaaaaacaatggagaaggctttgaacaggtggtgcagggaaaactttatcaactaccgctctctaagacatgctcgcgatgttcacagtcaaattcagggccatgcacaacaaatgggtctgaacctgtcatcatgtggagatgacatggttctatttcggagatgccttacgtctgccttcttcttgaatgcagcgatgcgacagccagatggatcatacagggcccttgcaactggccagagcgtgcagatccacccttcatccgtgcttttcaggaccaagcccgactgtgtcatcttcaacgagctagttcggacgacacagaactatgtcaagaacctgacccgtattgaccccttgtggctggctgagctcgcccctcagtactacgcaacagaggagtaa

SEQ ID NO: 11968 - protein, 687 aa, Sorghum bicolor
  misc_feature: Ceres ANNOT ID no. 6041002
  misc_feature (442)..(533): Pfam Id: HA2 Pfam Desc: Helicase associated domain (HA2)
  misc_feature (288)..(382): Pfam Id: Helicase_C Pfam Desc: Helicase conserved C-terminal domain
  misc_feature (26)..(687): NCBI GI: 9797766 NCBI Desc: strong similarity to rna helicase (hrh1) from homo sapiens gbd50487 and contains a helicases conserved c-terminal pf00271 domain. est gbav567077 comes from this gene. [arabidopsis
  misc_feature (26)..(687): NCBI GI: 9797766 (continued) thaliana]
  misc_feature (11)..(374): NCBI GI: 51091124 NCBI Desc: rna helicase-like [oryza sativa (japonica cultivar-group)]
  misc_feature (197)..(683): NCBI GI: 49250365 NCBI Desc: dhx33 protein [xenopus tropicalis]
  misc_feature (198)..(687): NCBI GI: 4826690 NCBI Desc: deah (asp-glu-ala-his) box polypeptide 8 [homo sapiens]
  misc_feature (198)..(687): NCBI GI: 127797813 NCBI Desc: deah (asp-glu-ala-his) box polypeptide 8 [homo sapiens]
  misc_feature: Up-regulated in shoot tissues in response to salicylic acid treatment
MSFTGSAPGWRQLIRQQRKSLPIASVEKRLVEEVRKNDTLIIVGETGSGKTTQLPQFLYDGGFCKDGKVIGITQPRRVAAVTVAKRVAEECNDQLGKKVGYSIRFDDSTSNATRIKYMTDGLLLREALLDPLLSKYSVIVVDEAHERTVHTDVLLGLLKKVQHSRANANKNGKTLPDVQGHSQNLTLKECQGIRCAPLKLIIMSASLDAKCFSDYFGGAKAVHIQGRQYPVDILYTYQPESDYMDATLVTIFQIHLEEGPGDILAFLTGQEEIESLERLIHERARLFPPESSKIWVTPIYSSLPSEQQMNAFKPAPAGTRKVVLATNIAETSVTIPGIKYVIDPGMVKARAYNPVTGMESLIIIPVSKAQALQRSGRAGREGPGKCFRLFQESEFDKLVDSTVPEIKRCNLSNVVLQLKALGIDDIIGFDFMEKPSRTAILKSLEQLILLGALTDDYKLSDPVGHQMARLPLDPMYSKALIVASKFKCLEEMLIVVSMLSVESIFFSVREKLEEARAARKGFESAEGDHITLVNVYRAAAECLEKSRNANAKEKTMEKALNRWCRENFINYRSLRHARDVHSQIQGHAQQMGLNLSSCGDDMVLFRRCLTSAFFLNAAMRQPDGSYRALATGQSVQIHPSSVLFRTKPDCVIFNELVRTTQNYVKNLTRIDPLWLAELAPQYYATEE

SEQ ID NO: 11969 - DNA, 978 bp, Sorghum bicolor
  misc_feature: Ceres ANNOT ID no. 6041239
  misc_feature: Encodes the peptide sequence at SEQ ID NO 11970
atggactgggcagcggcttccggggctccgtcgtggggcgcggcggcgacggaccccggcccgaccatgctgtccttcgcgggcccgtcctcctccaccacacccgccgccgacgccgaggcgcggctccaggatttcgccgcgggtctcgcccagagcgcgcggccggcgggggcggcgggagccgggaggaggtcccgcgcggccgggggaggtgctggcgtggaggcgtgctccgtcgacgggtgccgctctgatctcagccggtgccgcgagtaccaccggcggcataaggtctgtgaggcgcactctaagacgccggtggtggtcgtcgccggccaggagcagcgcttctgccagcaatgcagccggtttcacatgctgtccgagtttgatgagggaaaaagaagttgccggaagcgtttggatggtcataataggcgtcgaagaaagccacagcatgatctgacgaatctagggggtttctttccataccaccaagtgaatcaatttgaggtctatccacgaacaattccaacagtcggccagaattctgatgccatgcacttggtcggtcgtcagcagcccttctccatatcattctcaagaacaccaaatcagttcccttttccacagggtggcggtagcacgctccatgcagcccgccctggtcatcttctggctgaaggtagcagccacactggaagcagcacatgcagcaaccctctctccggcacgctgggccccgagtgtgctctctctcttctgtcatcgtcgctgcatcacccctccgctgctggcatccccaccgctggccagccccaggttgcctcttcactctctcggatcgctgctgtgtcgcaggctgcaacaacagctatggccactgcattcgcggccggtgttggccaccatgtgtttgttcctgatgctatgtttgaggatccttcacaggcactgccattctcttggcagtag

SEQ ID NO: 11970 - protein, 325 aa, Sorghum bicolor
  misc_feature: Ceres ANNOT ID no. 6041239
  misc_feature (77)..(155): Pfam Id: SBP Pfam Desc: SBP domain
  misc_feature (8)..(249): NCBI GI: 42761373 NCBI Desc: sbp-domain protein-like [oryza sativa (japonica cultivar-group)]
  misc_feature (4)..(305): NCBI GI: 115480037 NCBI Desc: os09g0507100 [oryza sativa (japonica cultivar-group)]
  misc_feature (4)..(302): NCBI GI: 62467446 NCBI Desc: teosinte glume architecture 1 [zea mays]
  misc_feature (4)..(302): NCBI GI: 62467440 NCBI Desc: teosinte glume architecture 1 [zea mays]
  misc_feature (4)..(302): NCBI GI: 62467432 NCBI Desc: teosinte glume architecture 1 [zea mays]
  misc_feature: The plant flowers significantly late compared to wild-type.
  misc_feature: Useful for making plants with modulated flowering time
  misc_feature: Functional homolog of the protein sequence given in SEQ ID NO 13558
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO. 452 in the 11/188,298 US application
MDWAAASGAPSWGAAATDPGPTMLSFAGPSSSTTPAADAEARLQDFAAGLAQSARPAGAAGAGRRSRAAGGGAGVEACSVDGCRSDLSRCREYHRRHKVCEAHSKTPVVVVAGQEQRFCQQCSRFHMLSEFDEGKRSCRKRLDGHNRRRRKPQHDLTNLGGFFPYHQVNQFEVYPRTIPTVGQNSDAMHLVGRQQPFSISFSRTPNQFPFPQGGGSTLHAARPGHLLAEGSSHTGSSTCSNPLSGTLGPECALSLLSSSLHHPSAAGIPTAGQPQVASSLSRIAAVSQAATTAMATAFAAGVGHHVFVPDAMFEDPSQALPFSWQ

SEQ ID NO: 11971 - DNA, 537 bp, Sorghum bicolor
  misc_feature: Ceres ANNOT ID no. 6041275
  misc_feature: Encodes the peptide sequence at SEQ ID NO 11972
atggaccccgcgccagcgccgccgcccccattcgccgtgcacctcgtcaccggcggcgggtcctcgccggagctttccctcctactccgctccctcgccgcatcccgcgtcgtcgcccttgacgcagagtggaagccgcgccgccgcggtagccctgccgctgccgcccctgcggccctgggcgacggcagcacgtcgctggcgttagaggcatctccagcgccgccgaagttcccgacggtgacgctgctccaggtggcctgccgcttcggcgatggaagtgagggcgagcgcagcgaggtgtttgtcgtcgacctcctctccgttccgctcgccgacctgtgggcgcccctgcgagagctgttcgagcggcctgatgcgctgaagctggggttcaggtttaagcaggacctggtgtacctctccgccacattctccgctgccctcgggtgcgactccggattcgataggtaccaaattatacaggatcaacccctctgtgagaaaggaattagctctggaaatgcttacaactag

SEQ ID NO: 11972 - protein, 178 aa, Sorghum bicolor
  misc_feature: Ceres ANNOT ID no. 6041275
  misc_feature (1)..(163): NCBI GI: 115471903 NCBI Desc: os07g0452400 [oryza sativa (japonica cultivar-group)]
  misc_feature (78)..(159): NCBI GI: 92898861 NCBI Desc: 3-5 exonuclease [medicago truncatula]
MDPAPAPPPPFAVHLVTGGGSSPELSLLLRSLAASRVVALDAEWKPRRRGSPAAAAPAALGDGSTSLALEASPAPPKFPTVTLLQVACRFGDGSEGERSEVFVVDLLSVPLADLWAPLRELFERPDALKLGFRFKQDLVYLSATFSAALGCDSGFDRYQIIQDQPLCEKGISSGNAYN

SEQ ID NO: 11973 - DNA, 507 bp, Sorghum bicolor
  misc_feature: Ceres ANNOT ID no. 6041285
  misc_feature: Encodes the peptide sequence at SEQ ID NO 11974
atggaggtggcggcggcggcggcgggggtggcatgctgccgtggccgggacgacggacacgccggcgaggaggagaggagtagcgccaaggacgccgccaaggtggttgtgcctatcgccgacgacaaggaggtggtggagccgtgcgtcatcgccgtcgacgactgctccgtcgaccgcgccctcgtcaccgcgctccttcgccgctccaagtacagagtcaccgcggttgacagcgggaagagggcgctggagattctgggctcggagcccaatgtgagcatgatcatcacagactactggatgccagagatgaccggctacgacctgctcaagaaggtcaaggagtcttcgaagctgaagcagatcccagtggtgattatgtcctccgagaacgtgcccaccaggattaccagatgcctggaggaaggcgcggaggacttcctgctgaagcccgtcaggccgtccgacatctcccgcataactaccaggattctgctgcactga

SEQ ID NO: 11974 - protein, 168 aa, Sorghum bicolor
  misc_feature: Ceres ANNOT ID no. 6041285
  misc_feature (48)..(163): Pfam Id: Response_reg Pfam Desc: Response regulator receiver domain
  misc_feature (41)..(166): NCBI GI: 110617744 NCBI Desc: response regulator [oryza sativa (japonica cultivar-group)]
  misc_feature (41)..(166): NCBI GI: 71273487 NCBI Desc: type a response regulator 7 [oryza sativa (indica cultivar-group)]
  misc_feature (48)..(166): NCBI GI: 11041692 NCBI Desc: response regulator [zea mays]
  misc_feature (48)..(166): NCBI GI: 57834122 NCBI Desc: osjnbb0065j09.13 [oryza sativa (japonica cultivar-group)]
  misc_feature (48)..(166): NCBI GI: 87116378 NCBI Desc: typea response regulator 5 [oryza sativa (japonica cultivar-group)]
  misc_feature: The sequence is a functional homolog of SEQ ID NO 932 in the 10/666,642US patent application
  misc_feature: Useful for making plants with altered Lignin content
  misc_feature: Useful for making plants with altered carotene content
  misc_feature: Useful for making plants with altered terpenoid content
  misc_feature: Useful for making plants with modulated growth and phenotype characteristics
  misc_feature: Functional homolog of the protein sequence given in SEQ ID NO 13463
  misc_feature: The sequence is a functional homolog of SEQ ID NO 932 in the 20070033671 US patent application
  misc_feature: The sequence is a functional homolog of SEQ ID NO 932 in the 10/666,642 US patent application
  misc_feature: Useful for making plants with modulated low light sensitivity
  misc_feature: Useful for making plants with modulated nitrogen use efficiency
  misc_feature: Functional homolog of the protein sequence given in SEQ ID NO 13599
  misc_feature: The sequence is a functional homolog of SEQ ID NO. 378 in the 11/188,298 US application
MEVAAAAAGVACCRGRDDGHAGEEERSSAKDAAKVVVPIADDKEVVEPCVIAVDDCSVDRALVTALLRRSKYRVTAVDSGKRALEILGSEPNVSMIITDYWMPEMTGYDLLKKVKESSKLKQIPVVIMSSENVPTRITRCLEEGAEDFLLKPVRPSDISRITTRILLH

SEQ ID NO: 11975 - DNA, 1017 bp, Sorghum bicolor
  misc_feature: Ceres ANNOT ID no. 6041545
  misc_feature: Encodes the peptide sequence at SEQ ID NO 11976
atggccggaggtacaacggtgtgcgtgaccggcgccggcgggttcatcgcctcgtggctcgtgaagctcctgctctcccgcggctacaccgtgcacggcaccgtccgcgacctcagtgacgagaagacgaaccatctgaagcgcctggagaatgctgccggaaacctcaggattttcaaggctgatctgctggactacgacgccatggcagctgcggtcgtcgggtgccagggagttctccatgtggccactccagtgccttcagagaacctgactgacccagagctacaaatgttgggtcctgctgtcactggtacaactaatgtgctcaaggctgcctctgccgcgaatgtccagcgagtggtggttgtgtcatccatggttgccgttgagatcagccccaaagattggcctgaaggtaagatccgagatgagagctgctggtcagacaaagaattctgcaggagcattgagagctggtacccggtcgccaagatcatctcagaagaggcggcgctcgcatacgggcggcaaaccgggcttgacgtggtgactatcaatccagggttggtgttcggccccctgctgcagccgacggtgaacgcaagcatccagttcctcatctacttcctcaaaggaggccccgacctggtgaggaacaagctctggcacgtcgtcgatgtccgtgacctcgccgacgcgctgctgctgctctacgaggtgcctgaagcagccggcaggcacatctgcgcgcctcatgttatcagtgcccgcgacctgctggacttgctgaagagcatgtaccctgacaaccctttcattgccaaggagagcatatgtgatagagatcacccagcaccgatgacttctgacaagctaaagaacctcgggtggagctgccggccgctggaagagacgatcctggacacagtcgagtgctgccagcgggctgggtttcttgacggtgtggctggggagactccctgtcgtttccctcctatcttcaacaaaatctag

SEQ ID NO: 11976 - protein, 338 aa, Sorghum bicolor
  misc_feature: Ceres ANNOT ID no. 6041545
  misc_feature (7)..(251): Pfam Id: Epimerase Pfam Desc: NAD dependent epimerase/dehydratase family
  misc_feature (8)..(257): Pfam Id: 3Beta_HSD Pfam Desc: 3-beta hydroxysteroid dehydrogenase/isomerase family
  misc_feature (9)..(235): Pfam Id: NAD_binding_4 Pfam Desc: Male sterility protein
  misc_feature (1)..(320): NCBI GI: 145337634 NCBI Desc: cinnamoyl-coa reductase [arabidopsis thaliana]
  misc_feature (2)..(326): NCBI GI: 2239260 NCBI Desc: cinnamoyl coa reductase [zea mays]
  misc_feature (2)..(326): NCBI GI: 3242328 NCBI Desc: cinnamoyl-coa reductase [zea mays]
  misc_feature (4)..(326): NCBI GI: 3341511 NCBI Desc: cinnamoyl-coa reductase [saccharum officinarum]
  misc_feature (4)..(320): NCBI GI: 9964087 NCBI Desc: cinnamoyl coa reductase [lolium perenne]
  misc_feature: Useful for making plants with altered cell wall content and/or composition
  misc_feature: Functional homolog of the protein sequence encoded by LOCUS at1g76470
  misc_feature: Useful for making plants with altered carbohydrate content
  misc_feature: Functional homolog of the protein sequence given in SEQ ID NO 13705
MAGGTTVCVTGAGGFIASWLVKLLLSRGYTVHGTVRDLSDEKTNHLKRLENAAGNLRIFKADLLDYDAMAAAVVGCQGVLHVATPVPSENLTDPELQMLGPAVTGTTNVLKAASAANVQRVVVVSSMVAVEISPKDWPEGKIRDESCWSDKEFCRSIESWYPVAKIISEEAALAYGRQTGLDVVTINPGLVFGPLLQPTVNASIQFLIYFLKGGPDLVRNKLWHVVDVRDLADALLLLYEVPEAAGRHICAPHVISARDLLDLLKSMYPDNPFIAKESICDRDHPAPMTSDKLKNLGWSCRPLEETILDTVECCQRAGFLDGVAGETPCRFPPIFNKI

SEQ ID NO: 11977 - DNA, 1665 bp, Sorghum bicolor
  misc_feature: Ceres ANNOT ID no. 6041602
  misc_feature: Encodes the peptide sequence at SEQ ID NO 11978
atggatccgcgacgcgcctgctgggagagctcgacggaggacgtgacgaggccactgctgctgcccgtgcacgatgacaggcggcctgcgggtgcgggacgacgctggtgctccgcgctcaggtcgtccgtgctcgccaacaagtacctggccgtcgcgtcgggcccgctggcgtgcgcgctcatctccgcactgcgagtaggagacctcggcgggcaccccgcggcgcgcaacatgctcggggtgctggcctgggtgttcctgtggtggatcacggacgccgtgccgctcggcgtcgcgtccatggtgccgctcttcctcttcccggcgttcggcatctcctccgccgacgccgtcgccaaggcctacatggacgacgtcatctccctcgtcctcggaagcttcatcctcgcgctcgccatcgagcactacggcatccaccgccgccttgccctcaacatcacgtctctgttctgcggtgacccggtgaagccgcacctgctgctcctcggcatctgcggcaccaccgtgttcatcagcatgtggatccacaacacgccgtgcaccgtgatgatgatccaggtgacgacggggatcctgcagcggttcccgcgcgaccagctggacggcggcggcggcgccgacgcacgggagctccagtggttctccaaggcgctggtgctcggcatcatgtacgcgtcgaccatcggcgggatggccacgctgacgggcacgggcgccaacatcatcctggtggggatgtggtccacctacttcccggagcagcggcccatcaccttcagctcctggatgtccttcgggctccccatgacgctcgtcctgttcgtggcgctctgggtcacgctctgcctcaagtactgcaccaacaacacggggagggtgctctcggcttacctcgacaggaatcacctcagaagagagctcagcttgatgggtccgatggcatttgcagagaagatggttttggccgtctttggggttttggatagcatgagtctcactcaaatcatcaatggacaattcttgcaggctctcattgtcctatggatgaccaggagcctgacggatgacatccctggatgggcagtcctcttcgacggcagagttggggatggaacagtgactatcatgatggcaacgctgctgttcatcatcccaagcggcaagaacgacggcgagaagctcatggactggggcaagtgccggaagctgcagtggcacatcatcctgctcctcggcgcgggcttcgccatcgccgacgggttcaagtcgagcggcttgaccgacatcctctcctcggggctgggtttcctgaagggcgcgccggcgctggccatcgcgcccgtggcctgcatcttcagcggcctgatcacggagttcacctccgacgacgccaccaccacgctggtgctgccgctgctcgccgagctgggcaagtccatcggcgtgcacccactgctgctcatggtccccggcaccgtcggcgcgcagctgtcgtacctgctgcccaccgcaacgccagggaacgtcgtcgggttcggcaccggctacatcaccatcaaggacatggtggtcactggaatgccaataaaactcgtcggcatcgcagctctcacgatactactgccaacgttagcttgctaa

SEQ ID NO: 11978 - protein, 554 aa, Sorghum bicolor
  misc_feature: Ceres ANNOT ID no. 6041602
  misc_feature (47)..(555): Pfam Id: Na_sulph_symp Pfam Desc: Sodium:sulfate symporter transmembrane region
  misc_feature (14)..(344): NCBI GI: 116804319 NCBI Desc: vacuolar citrate/h+ symporter [citrus sinensis]
  misc_feature (31)..(552): NCBI GI: 115479845 NCBI Desc: os09g0484900 [oryza sativa (japonica cultivar-group)]
  misc_feature (10)..(344): NCBI GI: 21536650 NCBI Desc: sodium-dicarboxylate cotransporter-like [arabidopsis thaliana]
  misc_feature (10)..(344): NCBI GI: 12057074 NCBI Desc: sdat(at) [arabidopsis thaliana]
  misc_feature (79)..(344): NCBI GI: 9758784 NCBI Desc: sodium-dicarboxylate cotransporter-like [arabidopsis thaliana]
MDPRRACWESSTEDVTRPLLLPVHDDRRPAGAGRRWCSALRSSVLANKYLAVASGPLACALISALRVGDLGGHPAARNMLGVLAWVFLWWITDAVPLGVASMVPLFLFPAFGISSADAVAKAYMDDVISLVLGSFILALAIEHYGIHRRLALNITSLFCGDPVKPHLLLLGICGTTVFISMWIHNTPCTVMMIQVTTGILQRFPRDQLDGGGGADARELQWFSKALVLGIMYASTIGGMATLTGTGANIILVGMWSTYFPEQRPITFSSWMSFGLPMTLVLFVALWVTLCLKYCTNNTGRVLSAYLDRNHLRRELSLMGPMAFAEKMVLAVFGVLDSMSLTQIINGQFLQALIVLWMTRSLTDDIPGWAVLFDGRVGDGTVTIMMATLLFIIPSGKNDGEKLMDWGKCRKLQWHIILLLGAGFAIADGFKSSGLTDILSSGLGFLKGAPALAIAPVACIFSGLITEFTSDDATTTLVLPLLAELGKSIGVHPLLLMVPGTVGAQLSYLLPTATPGNVVGFGTGYITIKDMVVTGMPIKLVGIAALTILLPTLAC

SEQ ID NO: 11979 - DNA, 1752 bp, Sorghum bicolor
  misc_feature: Ceres ANNOT ID no. 6041645
  misc_feature: Encodes the peptide sequence at SEQ ID NO 11980
atggccggcgcaagtaaccatggatccctcatggacgaatggttgccgccccctacaccaagcccaagaacactcatgtcaagcttcctgaatgaagaattcagctccgagccattctctggttttttcagtgaacatggcaccaacaagccccatgatcaatccgaaaagagcagagaagttgtgaattcgagcgaggaggtccctgctcatgctgtcaatgatccatttcaaaagggtttctccctgaagccaaatttgttcagtgctaatcataaatcaaactccaatggtggtttggcggagcgcagggctgcgagagcaggtttcagcgtcgcaaaaattgatacttctcgagttggttcatcagcagttattcgatctcctgtgtcaattccaccaggtctaagtccaactacacttcttgagtctcctgtgtttctctacaataaaatggcacaaccttctccaaccactggcacgttgccatttttgatggctacgaatgataagtcaacaataccaccagctgccaagataactgaagattctccatttgataatgatgtgttttctttccaaccccacttaggttctgaagcaacaggtttctctactgcagaaaaggactatggcgcctatcagcaaaagcagtccttgtcgaatattcatcagcaggaatccagtcttcagtcaagctttacagcagtcaaggataacactagtgcaacaattgttaaagcgaagacgtctagctccatgttcagtgatagtcactattcagctgaccaacagcaagctgacgagacaaatataaaggtgcaaggcaaaggtgtcgaggctagatcagctgcttttcttcctgtatcagcgcatagtgatgcatctctcttggagtctcaagatgcagttgatgtctcgtcaacactgtctaatgaagaggagagggcaacgcatggtactgtttctatagagtgtgatggtgatgaagatgagactgaatccaaaagaaggaagctggaactagatgctttaggagctactgctatcactactacctccaccaccagtaccattgacatggggcctggagcctcaagagctgtccgggagcctagggttgttgttcagaccacaagtgaggtagacattcttgatgacggttatcggtggcgcaagtatgggcagaaggttgttaagggcaatccaaatccaaggagctactacaaatgtacacacccaggatgttcagtgcgcaagcatgtggaaagagcatcacatgatctgaaatcagtcatcacaacatatgagggaaagcacaaccatgaagttccagcagccagaaatagtgggcaaggcagttctggttccggcagtgctccatctgcaccacaagctggtggttctcaccgtaggcaagaatcagcacaagccagctttgctcacttcggcacgaccagtcctttcggctccttcggtctcccaccgagcagacagttgggaccaacaactggcaatttccgcttcgggatggttccgccgggcatgacgatcccaatgccctctctaggatcacttgcccctacaaagatggtaggaagttcatcaagcatgcaggggtacccagggcttatgatgccaggagagcccaaggtggagcctgtctcgcaacccctcttcccaatggcaaatgcatctccaccagcttaccaacagatgctgagcaggcctccttttggtcatcagatgtaa

SEQ ID NO: 11980 - protein, 583 aa, Sorghum bicolor
  misc_feature: Ceres ANNOT ID no. 6041645
  misc_feature (385)..(444): Pfam Id: WRKY Pfam Desc: WRKY DNA -binding domain
  misc_feature (1)..(265): NCBI GI: 86439762 NCBI Desc: wrky dna binding protein [triticum aestivum]
  misc_feature (274)..(583): NCBI GI: 115479807 NCBI Desc: os09g0481700 [oryza sativa (japonica cultivar-group)]
  misc_feature (274)..(583): NCBI GI: 23305051 NCBI Desc: wrky transcription factor [oryza sativa (indica cultivar-group)]
  misc_feature (283)..(583): NCBI GI: 14530687 NCBI Desc: wrky dna-binding protein [nicotiana tabacum]
  misc_feature (278)..(544): NCBI GI: 116310204 NCBI Desc: h0418a01.8 [oryza sativa (indica cultivar-group)]
  misc_feature: The sequence is a functional homolog of SEQ ID NO 1269 in the 11/479,226US patent application
  misc_feature: The sequence is a functional homolog of SEQ ID NO 1362 in the 10/666,642US patent application
  misc_feature: The sequence is a functional homolog of SEQ ID NO 138 in the 10/412,699US patent application
  misc_feature: The sequence is a functional homolog of SEQ ID NO 1388 in the 10/412,699US patent application
  misc_feature: The sequence is a functional homolog of SEQ ID NO 1389 in the 10/412,699US patent application
  misc_feature: The sequence is a functional homolog of SEQ ID NO 1390 in the 10/412,699US patent application
  misc_feature: The sequence is a functional homolog of SEQ ID NO 174 in the 10/374,780US patent application
  misc_feature: The sequence is a functional homolog of SEQ ID NO 199 in the 11/479,226US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 268 in the 10/714,887US patent application
  misc_feature: The sequence is a functional homolog of SEQ ID NO 268 in the 11/435,388US patent application
  misc_feature: The sequence is a functional homolog of SEQ ID NO 34 in the 10/666,642US patent application
  misc_feature: The sequence is a functional homolog of SEQ ID NO 50 in the 10/225,066US patent application
  misc_feature: The sequence is a functional homolog of SEQ ID NO 512 in the 10/374,780US patent application
  misc_feature: The sequence is a functional homolog of SEQ ID NO 513 in the 10/374,780US patent application
  misc_feature: The sequence is a functional homolog of SEQ ID NO 514 in the 10/374,780US patent application
  misc_feature: The sequence is a functional homolog of SEQ ID NO 515 in the 10/374,780US patent application
  misc_feature: The sequence is a functional homolog of SEQ ID NO 56 in the 10/666,642US patent application
  misc_feature: The sequence is a functional homolog of SEQ ID NO 58 in the 10/412,699US patent application
  misc_feature: The sequence is a functional homolog of SEQ ID NO 584 in the 10/412,699US patent application
  misc_feature: Useful for making plants with modulated growth and phenotype characteristics
  misc_feature: The sequence is a functional homolog of SEQ ID NO 138 in the 20040045049 US patent application
  misc_feature: The sequence is a functional homolog of SEQ ID NO 138 in the 20040045049 US patent application
  misc_feature: The sequence is a functional homolog of SEQ ID NO 1388 in the 20040045049 US patent application
  misc_feature: The sequence is a functional homolog of SEQ ID NO 1389 in the 20040045049 US patent application
  misc_feature: The sequence is a functional homolog of SEQ ID NO 1390 in the 20040045049 US patent application
  misc_feature: The sequence is a functional homolog of SEQ ID NO 58 in the 20040045049 US patent application
  misc_feature: The sequence is a functional homolog of SEQ ID NO 584 in the 20040045049 US patent application
  misc_feature: The sequence is a functional homolog of SEQ ID NO 204 in the 20060015972 US patent application
  misc_feature: The sequence is a functional homolog of SEQ ID NO 515 in the 20060162006 US patent application
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 515 in the 10/374,780 US patent application
  misc_feature: The sequence is a functional homolog of SEQ ID NO 86 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAGASNHGSLMDEWLPPPTPSPRTLMSSFLNEEFSSEPFSGFFSEHGTNKPHDQSEKSREVVNSSEEVPAHAVNDPFQKGFSLKPNLFSANHKSNSNGGLAERRAARAGFSVAKIDTSRVGSSAVIRSPVSIPPGLSPTTLLESPVFLYNKMAQPSPTTGTLPFLMATNDKSTIPPAAKITEDSPFDNDVFSFQPHLGSEATGFSTAEKDYGAYQQKQSLSNIHQQESSLQSSFTAVKDNTSATIVKAKTSSSMFSDSHYSADQQQADETNIKVQGKGVEARSAAFLPVSAHSDASLLESQDAVDVSSTLSNEEERATHGTVSIECDGDEDETESKRRKLELDALGATAITTTSTTSTIDMGPGASRAVREPRVVVQTTSEVDILDDGYRWRKYGQKVVKGNPNPRSYYKCTHPGCSVRKHVERASHDLKSVITTYEGKHNHEVPAARNSGQGSSGSGSAPSAPQAGGSHRRQESAQASFAHFGTTSPFGSFGLPPSRQLGPTTGNFRFGMVPPGMTIPMPSLGSLAPTKMVGSSSSMQGYPGLMMPGEPKVEPVSQPLFPMANASPPAYQQMLSRPPFGHQM

SEQ ID NO: 11981 - DNA, 363 bp, Sorghum bicolor
  misc_feature: Ceres ANNOT ID no. 6041798
  misc_feature: Encodes the peptide sequence at SEQ ID NO 11982
atggccgcttggacaagaaaggccaccgccaccgccaaggccttggcgagctgcgtgcccggtgctattcttcgtgacgacgatgacaagcagaggatcgtcgtcccgaaagggtacctccccctattgctggttcgcggcggcggcggcggcggcgacgacgacgaccaaggtgcaggctcggagacgagggtcctggtgcgcgtgagagacctcaaggagccctgcatggcggcgttgctggagatggccgagcaacagtttgggtacgggcagcaaggggtgctcaaggtcccctgtgacgcggaacgctttcaccatgtggttaacatggcacgcaagtacaaggttgctagtacataa

SEQ ID NO: 11982 - protein, 120 aa, Sorghum bicolor
  misc_feature: Ceres ANNOT ID no. 6041798
  misc_feature (5)..(113): Pfam Id: Auxin_inducible Pfam Desc: Auxin responsive protein
  misc_feature (35)..(109): NCBI GI: 90399386 NCBI Desc: h0818e11.6 [oryza sativa (indica cultivar-group)]
  misc_feature (36)..(116): NCBI GI: 53792934 NCBI Desc: auxin-induced protein-like [oryza sativa (japonica cultivar-group)]
  misc_feature (60)..(110): NCBI GI: 92870691 NCBI Desc: auxin responsive saur protein [medicago truncatula]
  misc_feature (33)..(111): NCBI GI: 115482888 NCBI Desc: os10g0510500 [oryza sativa (japonica cultivar-group)]
  misc_feature (64)..(110): NCBI GI: 416642 NCBI Desc: indole-3-acetic acid induced protein arg7
  misc_feature: The sequence is a functional homolog of SEQ ID NO. 402 in the 11/188,298 US application
  misc_feature: The sequence is a functional homolog of SEQ ID NO. 505 in the 11/188,298 US application
MAAWTRKATATAKALASCVPGAILRDDDDKQRIVVPKGYLPLLLVRGGGGGGDDDDQGAGSETRVLVRVRDLKEPCMAALLEMAEQQFGYGQQGVLKVPCDAERFHHVVNMARKYKVAST

SEQ ID NO: 11983 - DNA, 1089 bp, Sorghum bicolor
  misc_feature: Ceres ANNOT ID no. 6041922
  misc_feature: Encodes the peptide sequence at SEQ ID NO 11984
atggagttcaagaactgggggtcgtcgtcgcagcgccggccggcggtggtggtggacgaggggcaaccgttggcgagacaggggtcagtctattcgttgacgttcgacgaattccagagcgcgctcggcggggccgccaccggcggtggcggtggcggtagcggtggcatccccaaggatttcggctccatgaacatggacgagctgctccggagcatctggaccgcggaggagacccaggccatggcctccgcctctgccgcaggagcgggcgcggggatgccgctcacgccgctgcagcggcagggatcgtcgctcacactgccccgcacgctcagcgccaagacggtcgacgaggtgtggcgcaatctcgtgcgcgacgagccgccgcaggcgcaggtggcggacggcggcggacaccaccagcagcaccgccagtcgacgctcggggagatgactctggaggagttcttggtcagagctggcgtggtcagggaaaaccccgctccagctcctccagcgccacagcccttgaccatgatgccgccgcggccggtacctgttgcccctaaaagctccgcctttttcgggaatttaccgggcgccgacgacgccgcagctgcggcagcgctggggttcgcaccggtcggcatgggggatctggccctgataccgcccagggcggcggcaggcatgggaggcagcgccatggctgtgcaaacagcgcttgattctggcgggaaggggtacagcgacctgtcgtcgccaacggagccgctgcctttttcatttgaagggatgattcgggggagaaggcatggaggcggagtggagaaagtggtggagaggcggcagaggaggatgatcaagaacagggagtccgccgcgaggtcccgagcgcgcaaacaggcttatacaatggagttagaagctgaagttcagaaactcaaggagctgaatcaggaactggagaggaaacaggcagagattatggaaatgcagaagaacgagacaccagaaatgttgaaggatccattcggacggaagaaacggctgtgcttgcgaagaacactgactggcccttggtga

SEQ ID NO: 11984 - protein, 362 aa, Sorghum bicolor
  misc_feature: Ceres ANNOT ID no. 6041922
  misc_feature (279)..(336): Pfam Id: bZIP_2 Pfam Desc: Basic region leucine zipper
  misc_feature (279)..(338): Pfam Id: bZIP_1 Pfam Desc: bZIP transcription factor
  misc_feature (1)..(362): NCBI GI: 62898533 NCBI Desc: bzip transcription factor [triticum aestivum]
  misc_feature (1)..(362): NCBI GI: 27469352 NCBI Desc: bzip transcription factor abi5 [hordeum vulgare subsp. vulgare]
  misc_feature (64)..(362): NCBI GI: 33087069 NCBI Desc: bzip transcription factor [oryza sativa (japonica cultivar-group)]
  misc_feature (64)..(362): NCBI GI: 42407368 NCBI Desc: trab1 [oryza sativa (japonica cultivar-group)]
  misc_feature (217)..(362): NCBI GI: 83853821 NCBI Desc: bzip transcription factor [glycine max]
  misc_feature: The sequence is a functional homolog of SEQ ID NO 1481 in the 11/479,226US patent application
  misc_feature: The sequence is a functional homolog of SEQ ID NO 1761 in the 10/374,780US patent application
  misc_feature: The sequence is a functional homolog of SEQ ID NO 1762 in the 10/374,780US patent application
  misc_feature: The sequence is a functional homolog of SEQ ID NO 352 in the 10/666,642US patent application
  misc_feature: The sequence is a functional homolog of SEQ ID NO 710 in the 10/412,699US patent application
  misc_feature: The sequence is a functional homolog of SEQ ID NO 911 in the 10/374,780US patent application
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13371
  misc_feature: The sequence is a functional homolog of SEQ ID NO 710 in the 20040045049 US patent application
  misc_feature: The sequence is a functional homolog of SEQ ID NO 1761 in the 20060162006 US patent application
  misc_feature: The sequence is a functional homolog of SEQ ID NO 1762 in the 20060162006 US patent application
  misc_feature: The sequence is a functional homolog of SEQ ID NO 911 in the 20060162006 US patent application
  misc_feature: The sequence is a functional homolog of SEQ ID NO 352 in the 20070033671 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MEFKNWGSSSQRRPAVVVDEGQPLARQGSVYSLTFDEFQSALGGAATGGGGGGSGGIPKDFGSMNMDELLRSIWTAEETQAMASASAAGAGAGMPLTPLQRQGSSLTLPRTLSAKTVDEVWRNLVRDEPPQAQVADGGGHHQQHRQSTLGEMTLEEFLVRAGVVRENPAPAPPAPQPLTMMPPRPVPVAPKSSAFFGNLPGADDAAAAAALGFAPVGMGDLALIPPRAAAGMGGSAMAVQTALDSGGKGYSDLSSPTEPLPFSFEGMIRGRRHGGGVEKVVERRQRRMIKNRESAARSRARKQAYTMELEAEVQKLKELNQELERKQAEIMEMQKNETPEMLKDPFGRKKRLCLRRTLTGPW

SEQ ID NO: 11985 - DNA, 1275 bp, Sorghum bicolor
  misc_feature: Ceres ANNOT ID no. 6042033
  misc_feature: Encodes the peptide sequence at SEQ ID NO 11986
atgctcacgtgcatcgcctgctccaagcagcagttcgccgccggcggcggcccgccactgcatgagccgccggaggacgacgatgtcgttgacggaggaggcgccatcggcggcgcgggtacgcccagcacacggcacgccatcaaggcgctcaccgcccaggtgggttctcgccttctcgggacaatcaaggacatggcgctcaaggcgtcgggcgcgtaccggcactgcaagccctgcgcgggctcctccgcggcggcgtcgcggcggcaccacccgtaccaccaccgcggcggcagcggcgtcttcgggggctccgacgccggctcggcctccgaccgcttccactacgcgtaccgccgcgccgggagctcagcggcctccactccgcgactgcgcagcgggggcgccgccctgtcgagtggcgacgccacgccgtccatgagcgtgcgcaccgacttccctgccggcgacgacgaggaggacgacgagatggcgtcggaagccgctggcggatgtggtggtggtggcaaggacgacgacgccagggagtgggtagcgcaggtggagcccggcgtgctcattaccttcgtctcgctggcgcaaggtggcaacgacctgaaacgcattcgattcagccgtgagatgttcaacaaatggcaagcacaaagatggtgggctgaaaattatgacaaagttatggaactttacaatgtccagaggtttaatcaaactgtccctctcccgactaccccaaaatctgaagatgagagctccaaagaggacagcccagtaacaccaccactggacaaggaacggctacctcgcacattccacagacaaggtggtggagctatgggctactcttcatcagattctctcgagcatcactcaaaccactactgtactggccaccaccaccatcatggacaccaatgctgtgattcaatgggcctggcatcaacaccaaagctgtcaagtatcagtggagccaagacagaaacctcatcaatggacgcatcaatgaggacaagctcgtcacctgaagaggtcgacaggtctggtgagctctcggtgtccatcagcaatgcaagcgaccaggagagggagtgggtcgaggaagacgagcctggtgtatatattacaatccgggctttacctggtgggatcagagagcttcgccgtgttcggttcagccgggagaagttcagcgagatgcatgccaggctatggtgggaagagaaccgagcgaggatacacgaacagtacctctga

SEQ ID NO: 11986 - protein, 424 aa, Sorghum bicolor
  misc_feature: Ceres ANNOT ID no. 6042033
  misc_feature (202)..(237): Pfam Id: DZC Pfam Desc: Disease resistance/zinc finger/chromosome condensation-likeregion
  misc_feature (388)..(423): Pfam Id: DZC Pfam Desc: Disease resistance/zinc finger/chromosome condensation-likeregion
  misc_feature (103)..(294): NCBI GI: 56461772 NCBI Desc: at1g54180 [arabidopsis thaliana]
  misc_feature (245)..(398): NCBI GI: 51536140 NCBI Desc: major intrinsic protein-like [oryza sativa (japonica cultivar-group)]
  misc_feature (103)..(424): NCBI GI: 57222218 NCBI Desc: at1g54180 [arabidopsis thaliana]
  misc_feature (316)..(399): NCBI GI: 15221753 NCBI Desc: zinc finger protein-related [arabidopsis thaliana]
  misc_feature (107)..(370): NCBI GI: 109020194 NCBI Desc: brevis radix [arabidopsis thaliana]
MLTCIACSKQQFAAGGGPPLHEPPEDDDVVDGGGAIGGAGTPSTRHAIKALTAQVGSRLLGTIKDMALKASGAYRHCKPCAGSSAAASRRHHPYHHRGGSGVFGGSDAGSASDRFHYAYRRAGSSAASTPRLRSGGAALSSGDATPSMSVRTDFPAGDDEEDDEMASEAAGGCGGGGKDDDAREWVAQVEPGVLITFVSLAQGGNDLKRIRFSREMFNKWQAQRWWAENYDKVMELYNVQRFNQTVPLPTTPKSEDESSKEDSPVTPPLDKERLPRTFHRQGGGAMGYSSSDSLEHHSNHYCTGHHHHHGHQCCDSMGLASTPKLSSISGAKTETSSMDASMRTSSSPEEVDRSGELSVSISNASDQEREWVEEDEPGVYITIRALPGGIRELRRVRFSREKFSEMHARLWWEENRARIHEQYL

SEQ ID NO: 11987 - DNA, 1260 bp, Sorghum bicolor
  misc_feature: Ceres ANNOT ID no. 6042041
  misc_feature: Encodes the peptide sequence at SEQ ID NO 11988
atggctccccgccgccctctcaagaagcgccagattcctaattcctcggccatgccggtgggtgcggtggacaccgacgccctgctctccctgccccaggagatcctcgacgaggtcctcgcacgcctcgacctccgcgacgccgtccgcacctccgcactctgccgcgcctggcgccgccgctgggagacgctcccctccatcgacatctccatcccttccggcaaggaggcgctctcgaccatcgactgcgtcctcctccgctgctccggccgcgtccagcgcttctacgtatccctcgacaagctctcggcccgccgcctagacgactggctcctcgtcctctcccgccgcggctgcgtcgaggatattttcctcagtccggaaccccacgagttcttctcccttcattccgctgtcttctcttggcgctgcctcatctccgtcgacctctccgcctgtcacatcccgccgctacccccagacttcgagggctttcccgtccttaaagtgctaagccttgtcgatgtgaagttccagcagaacggagagtaccaactggaggagatcattgagacatccccattgctcgagcagctgatactatctgaagtccacatcgggggagacgagtttattgaatgggagatccgggcgcccaatctgcgtcacataacaatttgctcaactatcgattatggctgggcatattcgcaagaagttagtggcttagtgcctaattgtgttgcttgtgttagtcacttcttcattgttctgatattattctctttccttttattttcccaggtaaatgggaccaagatacttgaaaaccttccatgcaactttgacaacttgaagagcctgaaattgttcatggacttctgtgaactgccccccattttgtcagtgttttgcttactaaagagtatgccgaatcttgaaaaacttaaaatgaagatctacaatggcgaagtgcagaaagttgagctaaatggagagttcctaaatgcacagtgggaagatggcatgtgtgccaatcttcaaattttggagatgactggtatcaattggcttccaaatgaaatatcttttatgaagctcattctttccaaagctaggcttcttcgtacgttatggattagtcatcatggtgattgctcagtgtctcatgtggatccactgcatgaactagtaacatgtggaaaagcttcagctcaagctcaggttctgtttaaaggtgcagttgaaaatcattag

SEQ ID NO: 11988 - protein, 419 aa, Sorghum bicolor
  misc_feature: Ceres ANNOT ID no. 6042041
  misc_feature (26)..(73): Pfam Id: F-box Pfam Desc: F-box domain
  misc_feature (3)..(413): NCBI GI: 51536004 NCBI Desc: f-box protein-like protein [oryza sativa (japonica cultivar-group)]
  misc_feature (13)..(414): NCBI GI: 42409041 NCBI Desc: f-box protein family-like protein [oryza sativa (japonica cultivar-group)]
  misc_feature (26)..(414): NCBI GI: 42409507 NCBI Desc: f-box protein family-like protein [oryza sativa (japonica cultivar-group)]
  misc_feature (1)..(233): NCBI GI: 42409506 NCBI Desc: f-box protein family-like protein [oryza sativa (japonica cultivar-group)]
  misc_feature (22)..(414): NCBI GI: 42409365 NCBI Desc: f-box protein family-like [oryza sativa (japonica cultivar-group)]
MAPRRPLKKRQIPNSSAMPVGAVDTDALLSLPQEILDEVLARLDLRDAVRTSALCRAWRRRWETLPSIDISIPSGKEALSTIDCVLLRCSGRVQRFYVSLDKLSARRLDDWLLVLSRRGCVEDIFLSPEPHEFFSLHSAVFSWRCLISVDLSACHIPPLPPDFEGFPVLKVLSLVDVKFQQNGEYQLEEIIETSPLLEQLILSEVHIGGDEFIEWEIRAPNLRHITICSTIDYGWAYSQEVSGLVPNCVACVSHFFIVLILFSFLLFSQVNGTKILENLPCNFDNLKSLKLFMDFCELPPILSVFCLLKSMPNLEKLKMKIYNGEVQKVELNGEFLNAQWEDGMCANLQILEMTGINWLPNEISFMKLILSKARLLRTLWISHHGDCSVSHVDPLHELVTCGKASAQAQVLFKGAVENH

SEQ ID NO: 11989 - DNA, 1296 bp, Sorghum bicolor
  misc_feature: Ceres ANNOT ID no. 6042042
  misc_feature: Encodes the peptide sequence at SEQ ID NO 11990
atggctccgcgccgccctcgcaagaagcgcccgatttctgattcctcggccatgccggtgggtgcggtggacgccgacgctctgctctccctgccccaggaggtcctggacgaggtcctcgcccgcctcgacctccgcgacgtcgtccgaacctccgtactctgtcgcgcctggcgccgccgctgggagacgctcccctccatcgacatctacatcccctccgtcaagcaggcgctctgggccgtcgactgcgtcctcccccgctgccccggccgcgtccggcgcttccacgtctacctcgacgatctctccgcccgccgcctagacgactggctcctcctcctatcccgccgcggcggcgtcgaggctctctacctcagtccggaaccaccctacgagttcttctcccttcattccaccgtcttctcttggcgccgcctcatctccgtcgacctcttcgcgtgccacatcccgccgctacccccagacttcgagggctttccggaccttaaagtgctaagccttgccaatgtgacgttccagcagaacggggagtaccaactggaggagatcgttgagacatccccattgctcgagaagctgatactatgcgaagtctgcatcgagggagacgacttcattgaatgggagatccgggcacccaatctgcggcacataacaatttgctcaaatatcgattatggctggaatttcgcagagttgccatgcctgcactctgctgtcatcgatttgtgggagtatgttggtgaccgagatttcgccaatttttttgctgggctcgttcaagtcaggaagcttaggctctgcatgttttatgcaccggtaaatgggattaagatactggagacccttccatgcacctttgacaacttgaagagcctgaaattgttcatgcacttctgtgaactgccccccattttgttagtgttttgcttgctaaagagtatgccgaatcttgaaaaacttaaaatacggatctatgacggtgaagtgcagaaaattgagctaaatggagagttcctagatgcacagtgggcagatggcatgtgtgccaatcttcaaattctggagatgactggtatcaattggcttccaaatgaaatgtcttttatgaagctcattctttctaaagcgaggcttcttcgtacgttatgcatcagtcatcatgatgattgcttagtatctcatgtggatccattgcatgagctagtaacatgtggaaaagcttcagctcaagctcaggttctgtttaaaggtgcagctggaaattattag

SEQ ID NO: 11990 - protein, 431 aa, Sorghum bicolor
  misc_feature: Ceres ANNOT ID no. 6042042
  misc_feature (26)..(73): Pfam Id: F-box Pfam Desc: F-box domain
  misc_feature (3)..(425): NCBI GI: 51536004 NCBI Desc: f-box protein-like protein [oryza sativa (japonica cultivar-group)]
  misc_feature (26)..(426): NCBI GI: 42409041 NCBI Desc: f-box protein family-like protein [oryza sativa (japonica cultivar-group)]
  misc_feature (26)..(426): NCBI GI: 42409507 NCBI Desc: f-box protein family-like protein [oryza sativa (japonica cultivar-group)]
  misc_feature (1)..(278): NCBI GI: 42409506 NCBI Desc: f-box protein family-like protein [oryza sativa (japonica cultivar-group)]
  misc_feature (22)..(426): NCBI GI: 42409365 NCBI Desc: f-box protein family-like [oryza sativa (japonica cultivar-group)]
MAPRRPRKKRPISDSSAMPVGAVDADALLSLPQEVLDEVLARLDLRDVVRTSVLCRAWRRRWETLPSIDIYIPSVKQALWAVDCVLPRCPGRVRRFHVYLDDLSARRLDDWLLLLSRRGGVEALYLSPEPPYEFFSLHSTVFSWRRLISVDLFACHIPPLPPDFEGFPDLKVLSLANVTFQQNGEYQLEEIVETSPLLEKLILCEVCIEGDDFIEWEIRAPNLRHITICSNIDYGWNFAELPCLHSAVIDLWEYVGDRDFANFFAGLVQVRKLRLCMFYAPVNGIKILETLPCTFDNLKSLKLFMHFCELPPILLVFCLLKSMPNLEKLKIRIYDGEVQKIELNGEFLDAQWADGMCANLQILEMTGINWLPNEMSFMKLILSKARLLRTLCISHHDDCLVSHVDPLHELVTCGKASAQAQVLFKGAAGNY

SEQ ID NO: 11991 - DNA, 1557 bp, Sorghum bicolor
  misc_feature: Ceres ANNOT ID no. 6042080
  misc_feature: Encodes the peptide sequence at SEQ ID NO 11992
atggccgtccgcctcctcctcgccgttgccgtcgctctcctcctccgccccggggatgcgtccgtgcacgagtaccgcgggctcagcttcgccaacaagggcaacgccttcatcctccacgccggcagcgagggcctctacgcggcctcccacgccaacaccaccgccgaggacgatgaggacgccgccgcggtggccgacgccttcatccggtttgacaagattacttttaggcgaccagaagatactaacaattctgtgaaggagactagttcagctaaggttcaggtacttgtttttgagatagaagaccgtgaaatgattggtggatcagcctatggaggtcagaaggctatttgttgtacttcagatcttgcgaaattaggagcttgcacagaaggttctgtcatctaccgcccatcccaggtaaatcctggttggccaaagttgtttgttgcatcttttgatggaagcgatctgatcgcaacgctaccgtcaaggaccattccaattaccaaaactgggatgtacaatatgtactttatacactgcgatccttcacttgctagtttggaaatcgaggggaaaaccatatggaaaaatcctactgggtaccttccgggtcggatggcacctcttaagaacttttttggactgatgtcttttgcatttgttgtacttgggatctattggttttatcagtacatgaaatcttggagagaggttcttccacttcagaactgtattactcttgtgattacactgggcatgtttgagatggcattgtggtattttgagtatgctgagttcaatgagactggagttcggccaaaaggcatcacattttgggctgtcacgtttggaactgtcaagaggacggctgctgaagttattgttcttattgtctcaatgggatatggtgtcgtcacgcctactttgggtggcttgacatcaaaagtggtcatgctcggaggaacattttttctagcaacagaaattcttgaattggtagaaaatcttggtgctgttaatgatctatttggaaaagctcgtctgttcttgatctatccagtggccattttagatgccgcatttgttgtttggatatttatttctctagctaagactattggtaaacttcaggcaagaaggttgatggccaaacttgaaatttataggaaatttgcaactgcattgatcatatctgttctggtgtctattgggtggattggctatgagatttactccaaatcaacagatttatttaatgaacggtggcagcatgcctggattattcctgccttctggcatatcttgtctttcttacttctttgtgtcatttgctacctgtgggcaccttcacaaaactcaatgagattttcttatgatgcaagcgaattctttgatcgaaaggataatctctcattaattaggccagcacccagtgcttccaagaatggatggagtgtatcttctacaccagagcccaaagctacaaaggacatgaataccgtagcagatcttgaaggggatgatgaggaaagcaaaagggagtag

SEQ ID NO: 11992 - protein, 518 aa, Sorghum bicolor
  misc_feature: Ceres ANNOT ID no. 6042080
  misc_feature (171)..(458): Pfam Id: Lung_7-TM_R Pfam Desc: Lung seven transmembrane receptor
  misc_feature (5)..(518): NCBI GI: 51091402 NCBI Desc: membrane protein ptm1-like [oryza sativa (japonica cultivar-group)]
  misc_feature (5)..(518): NCBI GI: 124360430 NCBI Desc: lung seven transmembrane receptor [medicago truncatula]
  misc_feature (2)..(416): NCBI GI: 4508069
  misc_feature (13)..(382): NCBI GI: 140067186 NCBI Desc: lung seven transmembrane receptor [medicago truncatula]
  misc_feature (200)..(498): NCBI GI: 55237753 NCBI Desc: ensangp00000009944 [anopheles gambiae str. pest]
MAVRLLLAVAVALLLRPGDASVHEYRGLSFANKGNAFILHAGSEGLYAASHANTTAEDDEDAAAVADAFIRFDKITFRRPEDTNNSVKETSSAKVQVLVFEIEDREMIGGSAYGGQKAICCTSDLAKLGACTEGSVIYRPSQVNPGWPKLFVASFDGSDLIATLPSRTIPITKTGMYNMYFIHCDPSLASLEIEGKTIWKNPTGYLPGRMAPLKNFFGLMSFAFVVLGIYWFYQYMKSWREVLPLQNCITLVITLGMFEMALWYFEYAEFNETGVRPKGITFWAVTFGTVKRTAAEVIVLIVSMGYGVVTPTLGGLTSKVVMLGGTFFLATEILELVENLGAVNDLFGKARLFLIYPVAILDAAFVVWIFISLAKTIGKLQARRLMAKLEIYRKFATALIISVLVSIGWIGYEIYSKSTDLFNERWQHAWIIPAFWHILSFLLLCVICYLWAPSQNSMRFSYDASEFFDRKDNLSLIRPAPSASKNGWSVSSTPEPKATKDMNTVADLEGDDEESKRE

SEQ ID NO: 11993 - DNA, 519 bp, Sorghum bicolor
  misc_feature: Ceres ANNOT ID no. 6042326
  misc_feature: Encodes the peptide sequence at SEQ ID NO 11994
atggagcctcccaggaagcataagtccagtggcgtgccagtcaaggaggaagtggagtcagaagatggaaatgatttggtagccaagcgcagaaggactgaagtttcagggtccattatccaactacaacagcaaattgaagtctttggcatggagaacaaagcgccagctggtctgaaagttgaagattctactggcaaggatcccatggatgtgctcaatagttgtgcagtacagaactctggtcaagcgaatggtcgcagtaacgaaccggcaagcttgagactgctgaaaatatgcaaggtaattggctggaaagaaccacaatttgattttgaagaacaaggacctcaacataacaaaacattcaagtgcaaggtgactgttcacttggatggattgctcaacaccattatggagtgcttcagcaagcccaaccctaggaagaaagctgcacgagagaacgccgcacaaggggcattatggtgccttcagtgctctggttatgtcagaaagtga

SEQ ID NO: 11994 - protein, 172 aa, Sorghum bicolor
  misc_feature: Ceres ANNOT ID no. 6042326
  misc_feature (91)..(164): Pfam Id: dsrm Pfam Desc: Double-stranded RNA binding motif
  misc_feature (96)..(172): NCBI GI: 32488296 NCBI Desc: osjnbb0065l13.5 [oryza sativa (japonica cultivar-group)]
  misc_feature (96)..(172): NCBI GI: 116311061 NCBI Desc: osigba0157k09-h0214g12.2 [oryza sativa (indica cultivar-group)]
  misc_feature (12)..(169): NCBI GI: 30678641 NCBI Desc: double-stranded rna-binding domain (dsrbd)-containing protein [arabidopsis thaliana]
  misc_feature (96)..(172): NCBI GI: 115459356 NCBI Desc: os04g0509300 [oryza sativa (japonica cultivar-group)]
  misc_feature (46)..(170): NCBI GI: 76365064 NCBI Desc: dicer-like protein 4
  misc_feature: Useful for making plants with altered alkaloid content
  misc_feature: Functional homolog of the protein sequence given in SEQ ID NO 13310
MEPPRKHKSSGVPVKEEVESEDGNDLVAKRRRTEVSGSIIQLQQQIEVFGMENKAPAGLKVEDSTGKDPMDVLNSCAVQNSGQANGRSNEPASLRLLKICKVIGWKEPQFDFEEQGPQHNKTFKCKVTVHLDGLLNTIMECFSKPNPRKKAARENAAQGALWCLQCSGYVRK

SEQ ID NO: 11995 - DNA, 807 bp, Sorghum bicolor
  misc_feature: Ceres ANNOT ID no. 6042383
  misc_feature: Encodes the peptide sequence at SEQ ID NO 11996
atgttgccttaccctaaccctcaccatttcggcgtctcccaagaacccccacacccaaaccctaccagcttccccatgcttccgccgggcgcgcatctggatcagcagcactacgtggaccatcacttcttccccggccacggccacttcaactccgagacactggaggcggtgctgaggccgacgcgcgctgctccagagtgcgaggccgcagtggcggcggcggcgcagcagggtggaagacgaaacggtgtgcccgccggcggcggccagggccagggccacgcccgggcgcggaagcggccgttccggacggacaggcacagcaagatccggacggcgcagggcgtgcgcgaccgccggatgcggttgtccctcgacgtcgcgcgcgacttcttcgcgctgcaggaccggctcggcttcgataaggccagcaagacggtggactggctgctcacccagtccaagccggccatcgaacgcctcgccgccaccgatctctcccagcgaagcgtcggcggcggcagcgacgacgcagctttgtcacccccgacgtcaggggcggcggctgatggaccaggtaagaggggaggagttgccgagaagttgagctctagaagtggtggatcggcgtccatggagatggagcacacctgcgacctggaccgcctcgtgtccgcggcaccggtgcttcgggagtactactacggcctcagcgagatgatgagcaacgacaatggaggggacggcgacgacgatggtgagtacgaggaagacggtgatttcctggacggtatgcaatattag

SEQ ID NO: 11996 - protein, 268 aa, Sorghum bicolor
  misc_feature: Ceres ANNOT ID no. 6042383
  misc_feature (94)..(251): Pfam Id: TCP Pfam Desc: TCP family transcription factor
  misc_feature (87)..(184): NCBI GI: 13649866 NCBI Desc: teosinte branched1 protein [danthoniopsis dinteri]
  misc_feature (84)..(194): NCBI GI: 14326347 NCBI Desc: teosinte branched1 protein [zea mays]
  misc_feature (100)..(183): NCBI GI: 119873500 NCBI Desc: teosinte branched 1-like 1 protein [arabidopsis thaliana]
  misc_feature (100)..(186): NCBI GI: 116743826 NCBI Desc: branched1 [arabidopsis thaliana]
  misc_feature (1)..(200): NCBI GI: 15741046 NCBI Desc: teosinte branched1 protein [oryza sativa]
MLPYPNPHHFGVSQEPPHPNPTSFPMLPPGAHLDQQHYVDHHFFPGHGHFNSETLEAVLRPTRAAPECEAAVAAAAQQGGRRNGVPAGGGQGQGHARARKRPFRTDRHSKIRTAQGVRDRRMRLSLDVARDFFALQDRLGFDKASKTVDWLLTQSKPAIERLAATDLSQRSVGGGSDDAALSPPTSGAAADGPGKRGGVAEKLSSRSGGSASMEMEHTCDLDRLVSAAPVLREYYYGLSEMMSNDNGGDGDDDGEYEEDGDFLDGMQY

SEQ ID NO: 11997 - DNA, 807 bp, Sorghum bicolor
  misc_feature: Ceres ANNOT ID no. 6042489
  misc_feature: Encodes the peptide sequence at SEQ ID NO 11998
atgggtagcaggagatacgacatcgatacgaggagatgtgggattcactcagcaccaactaaatcaatgtatctggatgctcaacaagttgtcaactgccaagccacagtgagagaccacgatgttggttcctgcgctgtgaagcatcacttcccgtctccaattgtatcttggatagaagatctttcaagctttggcaatgcttcttttggccctgactctgagtatgtggatgagcaagccagagcttcggtgggacagtcttcgacatcaagtaatttgcatgacatgcaaatatcagtgagattgacagacgaattcatggagcttgcaaaggagaatacaagcaaaaatctagagacttgtggaattcttggtgcttcatttagggatggaacttactttgtgacaatgttgattataccgaagcaagaaggaactgctcactcatgtcaggccgttagtgaggaggagatacatgccgtgttatcagagcagtcactttaccctgcaggatggattcatactcatccttcacaaacatgctttctatcatcgatcgatttgcatactcagtactcttaccaggttatgctaccagaggctgttgcaattgtggtcgcacccacagatccaaccaggctgactgatcctggagggatggatgtgcttagggagtgtgatgaaagtgggttccacactcaccgagagacaaccaatggcagtccaatctatgaaacctgctcgaaagtgcacttcaaccccaatttgcggtttgagattgttgacctgcgctctggtcaatga

SEQ ID NO: 11998 - protein, 268 aa, Sorghum bicolor
  misc_feature: Ceres ANNOT ID no. 6042489
  misc_feature (92)..(201): Pfam Id: Mov34 Pfam Desc: Mov34/MPN/PAD-1 family
  misc_feature (5)..(266): NCBI GI: 115438999 NCBI Desc: os01g0661500 [oryza sativa (japonica cultivar-group)]
  misc_feature (68)..(265): NCBI GI: 56202279 NCBI Desc: stam binding protein-like protein [oryza sativa (japonica cultivar-group)]
  misc_feature (86)..(265): NCBI GI: 56381981 NCBI Desc: at4g16144 [arabidopsis thaliana]
  misc_feature (27)..(265): NCBI GI: 15623925 NCBI Desc: stam binding protein(associated molecule with the sh3 domain of stam)-like [oryza sativa (japonica cultivar-group)]
  misc_feature (214)..(265): NCBI GI: 6573732 NCBI Desc: f20b24.2 [arabidopsis thaliana]
MGSRRYDIDTRRCGIHSAPTKSMYLDAQQVVNCQATVRDHDVGSCAVKHHFPSPIVSWIEDLSSFGNASFGPDSEYVDEQARASVGQSSTSSNLHDMQISVRLTDEFMELAKENTSKNLETCGILGASFRDGTYFVTMLIIPKQEGTAHSCQAVSEEEIHAVLSEQSLYPAGWIHTHPSQTCFLSSIDLHTQYSYQVMLPEAVAIVVAPTDPTRLTDPGGMDVLRECDESGFHTHRETTNGSPIYETCSKVHFNPNLRFEIVDLRSGQ

SEQ ID NO: 11999 - DNA, 1485 bp, Sorghum bicolor
  misc_feature: Ceres ANNOT ID no. 6042499
  misc_feature: Encodes the peptide sequence at SEQ ID NO 12000
atggcgcgcacgcaccagctcaacgtcctagcggcgctcgaccgcgccaagacgcaccggtgccacctcgcagcagccgcgattgccggcacgggattcttcgccggagcctacaacctctactccgcgtcactcgcctacaggcccggcgaggcgggcacgctgccgcccgatgccgcggctgcgctgaacggcgccgtactctgcggaacgtttgtgggccagctcgcctttggctggctcggggatagcattggccgccggcgagcctatggcttcgcgttggcgctcgtggccgtctgtcccgccgcgtccggactatcctttggccgcacggcgaaggccgtcgtggcgacgctatgcttcttccgcttctggctcggcgtcggagccggcggcggctaccccctgagcgcggccatcgtggcggagtacgccaaccgacgcaaacgcggcgcgttcctcgccgccgtgtacgccatgcagggcatgggcatcctcctaagcaacgccgtcgctctggtcgtgtcggctgccatgacagaggccgactacgtgtggcgtaccatcctcatggtcggggcggtgccggccgcgctcgccttctatctgcgcatgaaattgccggagactgctcggtacacggcgctcgtcgccggagacctgaggagtgcagcggccgacatgtcactggtgttatgcgccaccatccgagagcaggaactcgacgccacagttagcggcgtcgacgacaagtggggcctcttctcggcgcagttcttgaggagccatggactcaacctcctggcaacctcgagcgcttggttcctcctcgatgtgacctactacagccagaacatcctccagaaggacctcctcggcaagcttggatgggtctcccattcgccggtggtgaccatgagcgccgtcgaggaagtctccaaactcgcccgcgcgctggcactcatcgcactctgcggcgccatcccagggtactgcttcgcgatcgccctcatcgacgtcctcggccggcggcaactgcagatcgccggtttcttggtgatgacgctgtccatgctcaccctcgcggcgctgtacgaacactggacatcgcacatcgccggcttcatggtgctctataacgtggccttcttcttcgccaacgttggtcccaacaccacgacgttcgtcgcacccgctgagctcttcccggcacggctacgatgcacgtgccaccgcatcgccgcggcgtcggggcgggctggtgcggttcttgggtcgttcggttttttccccaagaagggcgctgacggcggccagtatgcggcgggcattggcacccggaacgaggtgttcgtgctggcgggcaccaacttcctgggcatgctgatgactctgttcatcccagagacgaggggcacgtcgctggaggtgctgtccaaggaggtcatctacgaagccgtcgaggatgccgcctgcaattaa

SEQ ID NO: 12000 - protein, 494 aa, Sorghum bicolor
  misc_feature: Ceres ANNOT ID no. 6042499
  misc_feature (27)..(427): Pfam Id: MFS_1 Pfam Desc: Major Facilitator Superfamily
  misc_feature (22)..(483): Pfam Id: Sugar_tr Pfam Desc: Sugar (and other) transporter
  misc_feature (182)..(491): NCBI GI: 33242907 NCBI Desc: phosphate transporter [oryza sativa (japonica cultivar-group)]
  misc_feature (177)..(492): NCBI GI: 52550761 NCBI Desc: phosphate transporter 1 [oryza sativa (japonica cultivar-group)]
  misc_feature (182)..(491): NCBI GI: 52550763 NCBI Desc: phosphate transporter 2 [oryza sativa (japonica cultivar-group)]
  misc_feature (182)..(482): NCBI GI: 15594018 NCBI Desc: inorganic phosphate transporter [triticum aestivum/thinopyrum intermedium alien addition line]
  misc_feature (182)..(482): NCBI GI: 15594016 NCBI Desc: inorganic phosphate transporter [triticum aestivum/thinopyrum intermedium alien addition line]
  misc_feature: Useful for making plants with modulated carbohydrate content
  misc_feature: Useful for making plants with modulated phosphate use efficiency
  misc_feature: Functional homolog of the protein sequence given in SEQ ID NO 13396
  misc_feature: Functional homolog of the protein sequence given in SEQ ID NO 13397
  misc_feature: Functional homolog of the protein sequence given in SEQ ID NO 13398
  misc_feature: Functional homolog of the protein sequence given in SEQ ID NO 13407
  misc_feature: Functional homolog of the protein sequence given in SEQ ID NO 13408
  misc_feature: Useful for making plants with modulated phosphate use efficiency
  misc_feature: Functional homolog of the protein sequence given in SEQ ID NO 13398
  misc_feature: Useful for making plants with modulated carbohydrate content
  misc_feature: Functional homolog of the protein sequence given in SEQ ID NO 13408
  misc_feature: The sequence is a functional homolog of SEQ ID NO. 296 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MARTHQLNVLAALDRAKTHRCHLAAAAIAGTGFFAGAYNLYSASLAYRPGEAGTLPPDAAAALNGAVLCGTFVGQLAFGWLGDSIGRRRAYGFALALVAVCPAASGLSFGRTAKAVVATLCFFRFWLGVGAGGGYPLSAAIVAEYANRRKRGAFLAAVYAMQGMGILLSNAVALVVSAAMTEADYVWRTILMVGAVPAALAFYLRMKLPETARYTALVAGDLRSAAADMSLVLCATIREQELDATVSGVDDKWGLFSAQFLRSHGLNLLATSSAWFLLDVTYYSQNILQKDLLGKLGWVSHSPVVTMSAVEEVSKLARALALIALCGAIPGYCFAIALIDVLGRRQLQIAGFLVMTLSMLTLAALYEHWTSHIAGFMVLYNVAFFFANVGPNTTTFVAPAELFPARLRCTCHRIAAASGRAGAVLGSFGFFPKKGADGGQYAAGIGTRNEVFVLAGTNFLGMLMTLFIPETRGTSLEVLSKEVIYEAVEDAACN

SEQ ID NO: 12001 - DNA, 984 bp, Sorghum bicolor
  misc_feature: Ceres ANNOT ID no. 6042525
  misc_feature: Encodes the peptide sequence at SEQ ID NO 12002
atgtcgcgcgcgcgcacggtgcggatcttctgggacgatcctgacctgacggactcctccggcgaggaggacggctgcggggcccggcgggtcggcaggatggtgcgggagctgccgcccatggcggcaccagcagcagcagcagcagcagcaccggcggctgctgccgtgccggatcagtgtaacgccggggacggcgaccgcgggaggagggtcggcgtcggcgtcgctggccccgttggcgtgtgcagcggggcgcggagacggctgggcaagggtggtggcccgggcggcgcggcgagcaccaagttccgcggcgtccggaggcggccgtggggcaagttcgcggcggagatccgtgacccgtggcgcggcgtgcgcgtgtggctcggcaccttcgacaccgcggaggaggccgcgcgcgtctacgacaccgccgccatccagctccgcgggcccaacgccaccaccaacttctcctccgccggctccggggcggccggccagctgcaggacccggcgacccccggcgggtacgagtccggcgcggagtcctcgccggcggtgtcgtcgccgacgtccgtgctccgcaaggtcccctccgtgtcctccctcgccgaggactcctccaaggacttcgactccgacgtcgcggcggccccgtgcgagccggccgtaaccgagtgccgcagcctggccgtcctcgaggaggaggagcttggcgagttcgtgccgttcgaggacgcgccggtctacgccaccagcggcttctgggacttcgagcccgacgccgggttcctctacgccgagccgtcgtcgccggagctgtcgtggaacgccgcggccgctgcgggcgccgagcccgcctcgtctgatgacgcgcccagctgggccgcgccggcgtcgccgatgcaggagaacaacgactacttccaggacctgcgcgacctcttcccgctcaacccgcttcccgcgattttctga

SEQ ID NO: 12002 - protein, 327 aa, Sorghum bicolor
  misc_feature: Ceres ANNOT ID no. 6042525
  misc_feature (102)..(153): Pfam Id: AP2 Pfam Desc: AP2 domain
  misc_feature (1)..(287): NCBI GI: 33440022 NCBI Desc: ap24 [oryza sativa (japonica cultivar-group)]
  misc_feature (1)..(287): NCBI GI: 33087077 NCBI Desc: tsi-1-like protein [oryza sativa (japonica cultivar-group)]
  misc_feature (7)..(320): NCBI GI: 56784079 NCBI Desc: pti6 -like [oryza sativa (japonica cultivar-group)]
  misc_feature (103)..(216): NCBI GI: 3065895 NCBI Desc: tsi1 [nicotiana tabacum]
  misc_feature (85)..(196): NCBI GI: 2213785 NCBI Desc: pti6 [lycopersicon esculentum]
  misc_feature: The sequence is a functional homolog of SEQ ID NO 1157 in the 10/374,780US patent application
  misc_feature: The sequence is a functional homolog of SEQ ID NO 1158 in the 10/374,780US patent application
  misc_feature: The sequence is a functional homolog of SEQ ID NO 12 in the 10/225,068US patent application
  misc_feature: The sequence is a functional homolog of SEQ ID NO 1247 in the 11/479,226US patent application
  misc_feature: The sequence is a functional homolog of SEQ ID NO 136 in the 10/412,699US patent application
  misc_feature: The sequence is a functional homolog of SEQ ID NO 1360 in the 10/412,699US patent application
  misc_feature: The sequence is a functional homolog of SEQ ID NO 1361 in the 10/412,699US patent application
  misc_feature: The sequence is a functional homolog of SEQ ID NO 168 in the 10/374,780US patent application
  misc_feature: The sequence is a functional homolog of SEQ ID NO 1883 in the 10/374,780US patent application
  misc_feature: The sequence is a functional homolog of SEQ ID NO 1884 in the 10/374,780US patent application
  misc_feature: The sequence is a functional homolog of SEQ ID NO 325 in the 11/479,226US patent application
  misc_feature: The sequence is a functional homolog of SEQ ID NO 4 in the 10/225,068US patent application
  misc_feature: The sequence is a functional homolog of SEQ ID NO 406 in the 10/374,780US patent application
  misc_feature: The sequence is a functional homolog of SEQ ID NO 574 in the 10/412,699US patent application
  misc_feature: The sequence is a functional homolog of SEQ ID NO 628 in the 11/435,388US patent application
  misc_feature: The sequence is a functional homolog of SEQ ID NO 732 in the 10/225,066US patent application
  misc_feature: The sequence is a functional homolog of SEQ ID NO 90 in the 10/225,066US patent application
  misc_feature: Useful for making plants with altered sterol content
  misc_feature: Useful for making plants with altered terpenoid content
  misc_feature: Useful for making plants with modulated growth and phenotype characteristics
  misc_feature: Functional homolog of the protein sequence given in SEQ ID NO 13518
  misc_feature: The sequence is a functional homolog of SEQ ID NO 136 in the 20040045049 US patent application
  misc_feature: The sequence is a functional homolog of SEQ ID NO 1360 in the 20040045049 US patent application
  misc_feature: The sequence is a functional homolog of SEQ ID NO 1361 in the 20040045049 US patent application
  misc_feature: The sequence is a functional homolog of SEQ ID NO 574 in the 20040045049 US patent application
  misc_feature: The sequence is a functional homolog of SEQ ID NO 4 in the 20050120408 US patent application
  misc_feature: The sequence is a functional homolog of SEQ ID NO 1883 in the 20060162006 US patent application
  misc_feature: The sequence is a functional homolog of SEQ ID NO 1884 in the 20060162006 US patent application
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Useful for biocontainment applications
  misc_feature: Functional homolog of the protein sequence given in SEQ ID NO 13707
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO. 274 in the 11/188,298 US application
MSRARTVRIFWDDPDLTDSSGEEDGCGARRVGRMVRELPPMAAPAAAAAAAPAAAAVPDQCNAGDGDRGRRVGVGVAGPVGVCSGARRRLGKGGGPGGAASTKFRGVRRRPWGKFAAEIRDPWRGVRVWLGTFDTAEEAARVYDTAAIQLRGPNATTNFSSAGSGAAGQLQDPATPGGYESGAESSPAVSSPTSVLRKVPSVSSLAEDSSKDFDSDVAAAPCEPAVTECRSLAVLEEEELGEFVPFEDAPVYATSGFWDFEPDAGFLYAEPSSPELSWNAAAAAGAEPASSDDAPSWAAPASPMQENNDYFQDLRDLFPLNPLPAIF

SEQ ID NO: 12003 - DNA, 339 bp, Sorghum bicolor
  misc_feature: Ceres ANNOT ID no. 6042729
  misc_feature: Encodes the peptide sequence at SEQ ID NO 12004
atggcaacgatgtcgctgagctcgacgagggcgcagtggacggcgaagcagaacaagctgttcgagcaggcgctggcggtgtacgacagggacacgccggaccggtggcacaacatcgcgcgcgccgtcgggggcggcaagtcggcggacgaggtcaggcgctactacgagctgctggtgaaggacgtggagcacatcgaggccggcaaggtgcccttcccggcctacaggtgccccgccggctacgacgccgacagctgtcatagtggacgactggaggcccgttcttccaaacacttgtgcacatgggagcttggaatgggaacacagaaagtgtaa

SEQ ID NO: 12004 - protein, 112 aa, Sorghum bicolor
  misc_feature: Ceres ANNOT ID no. 6042729
  misc_feature (10)..(60): Pfam Id: Myb_DNA-binding Pfam Desc: Myb-like DNA-binding domain
  misc_feature (1)..(79): NCBI GI: 115438765 NCBI Desc: os01g0635200 [oryza sativa (japonica cultivar-group)]
  misc_feature (1)..(77): NCBI GI: 38566494 NCBI Desc: at4g36570 [arabidopsis thaliana]
  misc_feature (1)..(98): NCBI GI: 145356202 NCBI Desc: dna binding / transcription factor [arabidopsis thaliana]
  misc_feature (1)..(77): NCBI GI: 124360540 NCBI Desc: homeodomain-related [medicago truncatula]
  misc_feature (1)..(77): NCBI GI: 110931736 NCBI Desc: myb transcription factor myb142 [glycine max]
  misc_feature: The plant flowers significantly late compared to wild-type.
  misc_feature: The sequence is a functional homolog of SEQ ID NO 1404 in the 11/479,226US patent application
  misc_feature: The sequence is a functional homolog of SEQ ID NO 1973 in the 11/479,226US patent application
  misc_feature: The sequence is a functional homolog of SEQ ID NO 2720 in the 10/374,780US patent application
  misc_feature: The sequence is a functional homolog of SEQ ID NO 360 in the 10/225,066US patent application
  misc_feature: The sequence is a functional homolog of SEQ ID NO 510 in the 10/666,642US patent application
  misc_feature: The sequence is a functional homolog of SEQ ID NO 662 in the 10/412,699US patent application
  misc_feature: The sequence is a functional homolog of SEQ ID NO 876 in the 11/435,388US patent application
  misc_feature: The sequence is a functional homolog of SEQ ID NO 880 in the 11/435,388US patent application
  misc_feature: The sequence is a functional homolog of SEQ ID NO 944 in the 11/435,388US patent application
  misc_feature: The sequence is a functional homolog of SEQ ID NO 976 in the 11/435,388US patent application
  misc_feature: Useful for making plants with altered Lignin content
  misc_feature: Useful for making plants with modulated flowering time
  misc_feature: Useful for making plants with modulated growth and phenotype characteristics
  misc_feature: Useful for making plants with modulated low light sensitivity
  misc_feature: GREAT-hit functional homolog of the protein sequence given in SEQ ID NO 12938
  misc_feature: GREAT-hit functional homolog of the protein sequence given in SEQ ID NO 13095
  misc_feature: The sequence is a functional homolog of SEQ ID NO 662 in the 20040045049 US patent application
  misc_feature: The sequence is a functional homolog of SEQ ID NO 360 in the 20050160493 US patent application
  misc_feature: The sequence is a functional homolog of SEQ ID NO 880 in the 20060272060 US patent application
  misc_feature: The sequence is a functional homolog of SEQ ID NO 976 in the 20060272060 US patent application
  misc_feature: The sequence is a functional homolog of SEQ ID NO 510 in the 20070033671 US patent application
  misc_feature: Functional homolog of the protein sequence given in SEQ ID NO 13566
  misc_feature: Useful for making plants with altered lignin content
  misc_feature: Functional homolog of the protein sequence given in SEQ ID NO 13095
  misc_feature: Useful for making plants with modulated low light sensitivity
  misc_feature: Functional homolog of the protein sequence given in SEQ ID NO 12938
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 976 in the 11/435,388 US patent application
  misc_feature: Useful for making plants with modulated flowering time
  misc_feature: Functional homolog of the protein sequence given in SEQ ID NO 13566
  misc_feature: The sequence is a functional homolog of SEQ ID NO 510 in the 10/666,642 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
MATMSLSSTRAQWTAKQNKLFEQALAVYDRDTPDRWHNIARAVGGGKSADEVRRYYELLVKDVEHIEAGKVPFPAYRCPAGYDADSCHSGRLEARSSKHLCTWELGMGTQKV

SEQ ID NO: 12005 - DNA, 336 bp, Sorghum bicolor
  misc_feature: Ceres ANNOT ID no. 6042732
  misc_feature: Encodes the peptide sequence at SEQ ID NO 12006
atgtcgtccaactcgtcggcgtcgtcgtctgagtggacgaagccgcagcacaagctgttcgagcgcgccctggcggtgtacgacgcggacaccccggaccggtggcacaacgtggcgcgctacatgggcggcggcacgtccgtcgaggaggtgcgccgccactaccagcagctcgtcgtcgacgtcgcgcggatcgagtccgacggagtgcccttccactggtacgccaccgccccgccgccgtcgacgctgcatcgaggtatgcatgtagtaacgactgaacactgccggcgtcgtcgtcctcccgttaatttcttgcccttattcggctattaa

SEQ ID NO: 12006 - protein, 111 aa, Sorghum bicolor
  misc_feature: Ceres ANNOT ID no. 6042732
  misc_feature (9)..(59): Pfam Id: Myb_DNA-binding Pfam Desc: Myb-like DNA-binding domain
  misc_feature (1)..(77): NCBI GI: 10092271 NCBI Desc: myb-related protein; 20671-21051 [arabidopsis thaliana]
  misc_feature (1)..(71): NCBI GI: 38566494 NCBI Desc: at4g36570 [arabidopsis thaliana]
  misc_feature (1)..(77): NCBI GI: 87133603 NCBI Desc: rad-like protein 6 [arabidopsis thaliana]
  misc_feature (2)..(78): NCBI GI: 112292446 NCBI Desc: atrl1 [arabidopsis thaliana]
  misc_feature (2)..(78): NCBI GI: 145356202 NCBI Desc: dna binding / transcription factor [arabidopsis thaliana]
  misc_feature: The plant flowers significantly late compared to wild-type.
  misc_feature: The sequence is a functional homolog of SEQ ID NO 976 in the 11/435,388US patent application
  misc_feature: Useful for making plants with modulated flowering time
  misc_feature: Useful for making plants with modulated growth and phenotype characteristics
  misc_feature: The sequence is a functional homolog of SEQ ID NO 976 in the 20060272060 US patent application
  misc_feature: Functional homolog of the protein sequence given in SEQ ID NO 13566
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 510 in the 10/666,642 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
MSSNSSASSSEWTKPQHKLFERALAVYDADTPDRWHNVARYMGGGTSVEEVRRHYQQLVVDVARIESDGVPFHWYATAPPPSTLHRGMHVVTTEHCRRRRPPVNFLPLFGY

SEQ ID NO: 12007 - DNA, 2364 bp, Sorghum bicolor
  misc_feature: Ceres ANNOT ID no. 6042860
  misc_feature: Encodes the peptide sequence at SEQ ID NO 12008
atggaggcatcatcgtcttcctcccgccgcagcagacgcggccctgattctccctctcccacgacgcgacgtctgtgtctccttctgctctttgttcttcagacctgcatccgcccggcgtccccggcggtatcagcagcggcggcggcggcctcgccgtcgccgtacctggtgggggtagggagctacgacataacggggcctgcggcggacgtcaacatgatggggtacgcgaacgccgagcaggtcgcgtcagggatccacttcaggctcaaggcgcgcgcgtttatcgtcgctgagcctggtgggaatgggaagcgcgccgtgttcgtcaatctcgatgcctgcatggcgtcgcagctcgtcactatcaaggtgctcgaaaggctgaaagcaaggtacggtgacctttataacgagaagaatgtggctatcagtggaatccacactcatgctgggccaggaggttacctgcagtacgtggtttatattgtcacatctctcgggtttgttcgccaatcatttgatgtcattgtcaacggcattgagcagagtattgttgaagctcacagtaatctccgtcctggtgaactccttgatgctggtgtgaaccgcagcccgagcgcacacctaaacaacccagctgatgagagaagcaaatatcagtacaatgttgataaagaaatgacacttgttaagtttgtagatgatgaaattggcccaattgggagtttcaattggtttgcaacccatgggacatcaatgagccgtacaaactctttgattagcggcgataacaaaggtgcggctgcacgtttcatggaagattgggcagaacagaatgttgttccaaagcaggcagttcatgtgagttctgagcatccgcgaagagtctccgcgctaattcctgaaccaaatgagataactgatgacgacttaatacgattggcatcatcctacaaagcctcaggtggtaggcaaatatcaagttcaagtatggccaagcgcattagaagtgctgaacaaaacaagcttaaatttgtttctgcattctgccagtcaaactgtggagatgttagtccaaatgtcttgggagcattttgtacagacaccaaccgtccttgtgactttaatcacagtacgtgtaacgggcagaatgaattatgctacggacgaggcccgggatatcctgacgaatttgaaagtacccgtatcattggcaataggcaattcctcaaggctgttgatcttttcaattcagcttctgaagaaatacaaggcaaagttgactacaggcatacctacctagatttctcgcaactcgaagtgaatgtttcttcaagcacaggaggtcagcatcagacggtgaaaacatgcccagcggccatggggtttgcctttgctgctggaaccacagatggtcctggagcttttgattttaaacaaggagatgtcaagggaaacccattctggaggttagtacgaaatgtacttaggccaccgggcccagagcaagtgaaatgtcaggctccgaaaccaatactgctagataccggtgaaatgaaggttccatatgattgggcaccttcgatacttccaattcagatcataagaatcggtcagctggttatcttgtgtgtccctggagaattcacaacaatggctgggaggcggctacgtgatgctgtcaaaaaagtgctaaccaacagtggtcagtttgataacaatgttcatgttgttctcgcggggctaacaaacacctactctcaatatgtcacaacttatgaagaatatcagattcaaatatacgagggagcatcaacgttgtatggtcctcacaccttgagcgcctacattcaagaattccagaaacttgctacatccatggttacaaacaaggaggttgttccaacaaatctgcagcctcctgatctactaaaccggcaaattggtctgctcccaggtgtcatagtcgacgagacacctcccggcgtcaagtttggagatgtcaggtcagacgtccctgcgaactcaaccttcaggaagggcagcgttgtgaacgctacattctactcggcctgcccaaggaatgatctcctcaccgacggcactttcgcgctcgttgagaagctggatggcggaagcgattgggttcctgtctatgatgacgacgattggtcgctgcgcttcaggtggtcaaggccattgccggtgagtccaatgagttttgcaacgctggagtggacagttcctgaagatgccacatccggtgtttacagattgagacattttggtgcctctaagccgctgattgggtccatcaactatttcacagggacctctagcgcatttgtagtacgttag

SEQ ID NO: 12008 - protein, 787 aa, Sorghum bicolor
  misc_feature: Ceres ANNOT ID no. 6042860
  misc_feature (55)..(787): Pfam Id: Ceramidase_alk Pfam Desc: Neutral/alkaline non-lysosomal ceramidase
  misc_feature (52)..(787): NCBI GI: 115438677 NCBI Desc: os01g0624000 [oryza sativa (japonica cultivar-group)]
  misc_feature (56)..(786): NCBI GI: 42569717 NCBI Desc: ceramidase family protein [arabidopsis thaliana]
  misc_feature (308)..(786): NCBI GI: 42571109 NCBI Desc: ceramidase family protein [arabidopsis thaliana]
  misc_feature (52)..(786): NCBI GI: 15222380 NCBI Desc: ceramidase family protein [arabidopsis thaliana]
  misc_feature (52)..(772): NCBI GI: 8778548 NCBI Desc: f22g5.28 [arabidopsis thaliana]
  misc_feature (56)..(786): SWISSPROT Homolog: EC 3.5.1.23 Neutral ceramidase precursor
MEASSSSSRRSRRGPDSPSPTTRRLCLLLLFVLQTCIRPASPAVSAAAAAASPSPYLVGVGSYDITGPAADVNMMGYANAEQVASGIHFRLKARAFIVAEPGGNGKRAVFVNLDACMASQLVTIKVLERLKARYGDLYNEKNVAISGIHTHAGPGGYLQYVVYIVTSLGFVRQSFDVIVNGIEQSIVEAHSNLRPGELLDAGVNRSPSAHLNNPADERSKYQYNVDKEMTLVKFVDDEIGPIGSFNWFATHGTSMSRTNSLISGDNKGAAARFMEDWAEQNVVPKQAVHVSSEHPRRVSALIPEPNEITDDDLIRLASSYKASGGRQISSSSMAKRIRSAEQNKLKFVSAFCQSNCGDVSPNVLGAFCTDTNRPCDFNHSTCNGQNELCYGRGPGYPDEFESTRIIGNRQFLKAVDLFNSASEEIQGKVDYRHTYLDFSQLEVNVSSSTGGQHQTVKTCPAAMGFAFAAGTTDGPGAFDFKQGDVKGNPFWRLVRNVLRPPGPEQVKCQAPKPILLDTGEMKVPYDWAPSILPIQIIRIGQLVILCVPGEFTTMAGRRLRDAVKKVLTNSGQFDNNVHVVLAGLTNTYSQYVTTYEEYQIQIYEGASTLYGPHTLSAYIQEFQKLATSMVTNKEVVPTNLQPPDLLNRQIGLLPGVIVDETPPGVKFGDVRSDVPANSTFRKGSVVNATFYSACPRNDLLTDGTFALVEKLDGGSDWVPVYDDDDWSLRFRWSRPLPVSPMSFATLEWTVPEDATSGVYRLRHFGASKPLIGSINYFTGTSSAFVVR

SEQ ID NO: 12009 - DNA, 1194 bp, Sorghum bicolor
  misc_feature: Ceres ANNOT ID no. 6042901
  misc_feature: Encodes the peptide sequence at SEQ ID NO 12010
atggattcaagctaccagcgtagatcaaataatgaagaggaattttttttcttcgtactccctaccttacaagaagctagttcatcccaatcatcacaaaggcaagccatacatacatcagtccggaatggagccatatttattgatgaaacactaaatgggcatgaagtcgtatgccgaaggcgatttcatatggagagagagattttccgagctctagttcgaagattgcgtgaaaaaggacttgttgattcaaggtatgtctcggtggaagagcaattagctatattcctttatgcagtatcaaaaaatgcaagcaatcgagtattacaagatcaattccaacatagtggggaaacaattagccgtcactttgcagcagtgctcaatgcacttacacaactgacatgccactatatatgcttgccttctccacacccgcatcgtatattaaggcagcctaaattttctccatactttcagaactgtgttggagctatcgatggcactcatattccaatgattattcctgttgcacaacaagaaccatacagaaatagaaaacaaggtctatcacaaaacatgatggttgcatgtgacttcgatctaaaatttgtgcatgtccatgccggttgggaggggtctgcttctgatgcaagagttctacaggatgcacttaaccatggatttagtgtcccccccggtaaattctatcttgtagatgcaggctacgcaaatacaccacaatttcttgctccataccgtggaacaagataccacttacaagaacaaggaagagcaggtcaaaaaccacaaaatccaaaggaattattcaaccttcgacatgcacaactacggaatcatatagagagagctattggtgtattaaaaatgaggtaccctatactaaaggctgcttcaacatatgacatagagacacaagttgatatctctgtagcttgttgtttaacacacaatttcattcggttacacaatggagatgacagtttggtacatggtgctaccacagatatcaatgacagcaacatgatagatgtaccagaaggacatcaccaatacaataatgatgtgccagcatttaacaacttgcgacaagcaggaaatgagatgcgagatgacatagcaaacaagatgtgggaagattacattgccagacgtacaattcagcgataa

SEQ ID NO: 12010 - protein, 397 aa, Sorghum bicolor
  misc_feature: Ceres ANNOT ID no. 6042901
  misc_feature (165)..(327): Pfam Id: Transposase_11 Pfam Desc: Transposase DDE domain
  misc_feature (63)..(390): NCBI GI: 115468106 NCBI Desc: os06g0481800 [oryza sativa (japonica cultivar-group)]
  misc_feature (2)..(355): NCBI GI: 115449507 NCBI Desc: os02g0813200 [oryza sativa (japonica cultivar-group)]
  misc_feature (2)..(355): NCBI GI: 115468766 NCBI Desc: os06g0595700 [oryza sativa (japonica cultivar-group)]
  misc_feature (10)..(393): NCBI GI: 115445177 NCBI Desc: os02g0231600 [oryza sativa (japonica cultivar-group)]
  misc_feature (28)..(389): NCBI GI: 92871232 NCBI Desc: transposase, is4 [medicago truncatula]
MDSSYQRRSNNEEEFFFFVLPTLQEASSSQSSQRQAIHTSVRNGAIFIDETLNGHEVVCRRRFHMEREIFRALVRRLREKGLVDSRYVSVEEQLAIFLYAVSKNASNRVLQDQFQHSGETISRHFAAVLNALTQLTCHYICLPSPHPHRILRQPKFSPYFQNCVGAIDGTHIPMIIPVAQQEPYRNRKQGLSQNMMVACDFDLKFVHVHAGWEGSASDARVLQDALNHGFSVPPGKFYLVDAGYANTPQFLAPYRGTRYHLQEQGRAGQKPQNPKELFNLRHAQLRNHIERAIGVLKMRYPILKAASTYDIETQVDISVACCLTHNFIRLHNGDDSLVHGATTDINDSNMIDVPEGHHQYNNDVPAFNNLRQAGNEMRDDIANKMWEDYIARRTIQR

SEQ ID NO: 12011 - DNA, 312 bp, Sorghum bicolor
  misc_feature: Ceres ANNOT ID no. 6042905
  misc_feature: Encodes the peptide sequence at SEQ ID NO 12012
atggaagccaagtttttccgtttcctgaagctcgttggggtcggcttcaaagcgaggtctgagagccaaggccgcgagctgttcctgaagctgggctacagccacgaggtgcagttcaccgctcccccagcggtccgtgtcttctgcttcaaacccaacataatctgctgcactggcatcgacaaggacagggtgcaccagttcgccggtgctgtccggagctgcaagcctccagaggtgtacaaggggaaggggatcttgtacattgacgaggttatcaagctgaagcccgggaagaagcaaaagaagtga

SEQ ID NO: 12012 - protein, 103 aa, Sorghum bicolor
  misc_feature: Ceres ANNOT ID no. 6042905
  misc_feature (12)..(89): Pfam Id: Ribosomal_L6 Pfam Desc: Ribosomal protein L6
  misc_feature (1)..(101): NCBI GI: 786209 NCBI Desc: rpl6 [marchantia polymorpha]
  misc_feature (1)..(101): NCBI GI: 91208877 NCBI Desc: ribosomal protein l6 [physcomitrella patens]
  misc_feature (1)..(101): NCBI GI: 32966605 NCBI Desc: ribosomal protein l6 [chara vulgaris]
  misc_feature (1)..(101): NCBI GI: 22417017 NCBI Desc: ribosomal protein l6 [chaetosphaeridium globosum]
  misc_feature (5)..(100): NCBI GI: 118056017 NCBI Desc: ribosomal protein l6 [fervidobacterium nodosum rt17-b1]
MEAKFFRFLKLVGVGFKARSESQGRELFLKLGYSHEVQFTAPPAVRVFCFKPNIICCTGIDKDRVHQFAGAVRSCKPPEVYKGKGILYIDEVIKLKPGKKQKK

SEQ ID NO: 12013 - DNA, 930 bp, Sorghum bicolor
  misc_feature: Ceres ANNOT ID no. 6043027
  misc_feature: Encodes the peptide sequence at SEQ ID NO 12014
atgctcgagccgcagcgcgttcatcgcgacgccgacagcgatctccccgacaccgtgacctccccacttctcgcgcacccaccgtcgcctgatgagccttcgcctgcgaccgttggctcaccggagataaccgacgaggagatcgacgccgcgtccgccgcctgctgccgcatctgcctcgagtccgactctgagcctggtgatgagctaatatctccatgtatgtgcaagggaacacagcagttcgtgcatcgctcctgccttgaccattggaggtctgttaaggaaggatctgccttttcacactgcacaacatgcaaggcgcaattccatctacgggttgaatgtctggaggatgacatttgtcgtagaatgaagttccggttgtttgttgcaagagatgttatcgctatattccttgttatacaaaccatcgcagccataggtggtatggcattttttttggataaagatggaagcttcagaaacaaattttctgatgattgggagcggtttctgtcaaagcatccagtgcccttttactactgtgttggtgtggttgctttctttgtactggttggatttattgggctaatattacacctctcctcttacaacaacaacgatccgtgcttggttggatcccgtgactgttgctttgggtggggtctagtggacttaccagcttcaatggaagcctgttttgctttcgccgtcatatttgttatcatgttggccatccttggagttgcatatgggttctttgcggcaactgtggccatccagaggatctggcagcggcactaccatatacttaccaagaaggagctgacaaaggaatatgtggtggaggaccttcctgggggttacacaccgccaaagatggacccagagcatgagcagcgcttgaaggtgttgcagctcttgtag

SEQ ID NO: 12014 - protein, 309 aa, Sorghum bicolor
  misc_feature: Ceres ANNOT ID no. 6043027
  misc_feature (56)..(106): Pfam Id: zf-C3HC4 Pfam Desc: Zinc finger, C3HC4 type (RING finger)
  misc_feature (1)..(309): NCBI GI: 53791481 NCBI Desc: zinc finger (c3hc4-type ring finger) protein -like [oryza sativa (japonica cultivar-group)]
  misc_feature (33)..(309): NCBI GI: 40253895 NCBI Desc: zinc finger (c3hc4-type ring finger) protein -like [oryza sativa (japonica cultivar-group)]
  misc_feature (2)..(309): NCBI GI: 140040744 NCBI Desc: zinc finger, ring-type [medicago truncatula]
  misc_feature (45)..(196): NCBI GI: 41052575 NCBI Desc: zinc finger (c3hc4-type ring finger) protein-like [oryza sativa (japonica cultivar-group)]
  misc_feature (5)..(114): NCBI GI: 89297047 NCBI Desc: zinc finger, c3hc4 type [tetrahymena thermophila sb210]
MLEPQRVHRDADSDLPDTVTSPLLAHPPSPDEPSPATVGSPEITDEEIDAASAACCRICLESDSEPGDELISPCMCKGTQQFVHRSCLDHWRSVKEGSAFSHCTTCKAQFHLRVECLEDDICRRMKFRLFVARDVIAIFLVIQTIAAIGGMAFFLDKDGSFRNKFSDDWERFLSKHPVPFYYCVGVVAFFVLVGFIGLILHLSSYNNNDPCLVGSRDCCFGWGLVDLPASMEACFAFAVIFVIMLAILGVAYGFFAATVAIQRIWQRHYHILTKKELTKEYVVEDLPGGYTPPKMDPEHEQRLKVLQLL

SEQ ID NO: 12015 - DNA, 1257 bp, Sorghum bicolor
  misc_feature: Ceres ANNOT ID no. 6043143
  misc_feature: Encodes the peptide sequence at SEQ ID NO 12016
atggcgagagacagatctcggacccattctccgccaccggtgaaacgccagaagaaatcgagcaccaccaccgttgcctccctcgcagacgacatcttgctcgagatcttcctccgcctcccctcccttgccactctcgtccgagccgccctcacctgccgcgggtggcgccgcgcggtggcctcctcccctgccttccgccgccgcttccgtgagacccacccggcgcccctcctggggctcttctttaaccctcctggcgccgtccaggaccctgcactgcccgccttcccctccttcgtccccacccgcggcaccgatcgggaccaagccgccgccgtccgaggaggcgacttcttcctcacctccctccaggagcgccacggcgtccacaacggctggggaatccacgactgccgcggcgggtacctcctcctggcgaatgccgatcagttaacgatggcggtgaccaatcctttggcgcgacggagagaaagtttctttgatttcggccacgaggacacccttgaaggtcatcgcgtccacgcctttgcacaccaagcctgcttgctctgctccgacgaagaccccacgtcgttccgggtggtcaattgggtacgggccactgtcttcagctcggacaccggtgagtggtcggttcggccgtgggtggatatcccggcgaggccacagcgtggaagattctggcttctgaacggcaacatgcagacaaatgggttcttgtactgggtttacaagaactgcaagtatatggtctcactggacgcggcaacaatggatttctctgtcgctgagctcccggttttcctcaagaatcggctgtgcagcttcgttgtgggtgaaatgaacaatggtgagccttgtattgtctatgctattaacttcacagttggcgtgctgttgcgcagaacagacagtgatggtgttgagaggtgggtactggacagggctgaaatcctggagacacagcttggccttgtccttggcaaactaatggagaactacaatgaggtgcaggttgtggctgtcagggatggctttgcatacttggcaacatcagaaaggtcaaaccgttctagtactccaagttggtttttgtccctctgcttggaaacaatgaaattggagaagctgttttggaggacctatgacagttttgtgcaaccttatgttatgccgtggcctcctgctttagttggtaactatgggaggtttgcacttgaagatggtgtatga

SEQ ID NO: 12016 - protein, 418 aa, Sorghum bicolor
  misc_feature: Ceres ANNOT ID no. 6043143
  misc_feature (23)..(71): Pfam Id: F-box Pfam Desc: F-box domain
  misc_feature (20)..(406): NCBI GI: 115462089 NCBI Desc: os05g0147700 [oryza sativa (japonica cultivar-group)]
  misc_feature (190)..(319): NCBI GI: 115438318 NCBI Desc: os01g0604300 [oryza sativa (japonica cultivar-group)]
  misc_feature (4)..(153): NCBI GI: 115478659 NCBI Desc: os09g0341500 [oryza sativa (japonica cultivar-group)]
  misc_feature (250)..(323): NCBI GI: 115472393 NCBI Desc: os07g0518200 [oryza sativa (japonica cultivar-group)]
  misc_feature (9)..(150): NCBI GI: 115481050 NCBI Desc: os10g0135300 [oryza sativa (japonica cultivar-group)]
MARDRSRTHSPPPVKRQKKSSTTTVASLADDILLEIFLRLPSLATLVRAALTCRGWRRAVASSPAFRRRFRETHPAPLLGLFFNPPGAVQDPALPAFPSFVPTRGTDRDQAAAVRGGDFFLTSLQERHGVHNGWGIHDCRGGYLLLANADQLTMAVTNPLARRRESFFDFGHEDTLEGHRVHAFAHQACLLCSDEDPTSFRVVNWVRATVFSSDTGEWSVRPWVDIPARPQRGRFWLLNGNMQTNGFLYWVYKNCKYMVSLDAATMDFSVAELPVFLKNRLCSFVVGEMNNGEPCIVYAINFTVGVLLRRTDSDGVERWVLDRAEILETQLGLVLGKLMENYNEVQVVAVRDGFAYLATSERSNRSSTPSWFLSLCLETMKLEKLFWRTYDSFVQPYVMPWPPALVGNYGRFALEDGV

SEQ ID NO: 12017 - DNA, 537 bp, Sorghum bicolor
  misc_feature: Ceres ANNOT ID no. 6043326
  misc_feature: Encodes the peptide sequence at SEQ ID NO 12018
atggcgggctgcggcaaagcgccgggcagcgcgctcggcgtcgtcgtcctggctgtcgccgcgctcctcctcgccgcggcggcgagtgcggtggacgacgagcacatgtaccactggaagtgcttcaagtcgtgcacggggaactgccacgacgacacccccggctcgaacgtctctgccgtctccggcggcaagtgcaaggacaggtgcctgaacgagtgcttcgaggacctgccggccgtctgctaccaccagtgcgtcgtcaccaactgcctctgcttcccaccctttagcaaagagaaaatgacgtgcctgaagagctgctgcgacaagtgcttccaccacggcccgccaccgaggccgccatcgcctggtcctccgaagccgcctgcgccgaagccgaagccgaagccttgcccgcctgccccgaagccgaagccgaagccgaagccaaaaccaccgacgcccaaggcgccgccaccgcccaagaagccgtgtccctgtccccccggcagcgacgaggtgaacaagaactga

SEQ ID NO: 12018 - protein, 178 aa, Sorghum bicolor
  misc_feature: Ceres ANNOT ID no. 6043326
  misc_feature (26)..(171): NCBI GI: 20521304 NCBI Desc: proline-rich protein-like [oryza sativa (japonica cultivar-group)]
  misc_feature (86)..(170): NCBI GI: 76262498 NCBI Desc: pherophorin-c1 protein precursor [chlamydomonas reinhardtii]
  misc_feature (117)..(170): NCBI GI: 1655699 NCBI Desc: pherophorin-s [volvox carteri]
  misc_feature (117)..(170): NCBI GI: 76262506 NCBI Desc: pherophorin-c5 protein precursor [chlamydomonas reinhardtii]
  misc_feature (106)..(170): NCBI GI: 46396546 NCBI Desc: chitin-binding lectin 1 precursor (pl-i)
MAGCGKAPGSALGVVVLAVAALLLAAAASAVDDEHMYHWKCFKSCTGNCHDDTPGSNVSAVSGGKCKDRCLNECFEDLPAVCYHQCVVTNCLCFPPFSKEKMTCLKSCCDKCFHHGPPPRPPSPGPPKPPAPKPKPKPCPPAPKPKPKPKPKPPTPKAPPPPKKPCPCPPGSDEVNKN

SEQ ID NO: 12019 - DNA, 756 bp, Sorghum bicolor
  misc_feature: Ceres ANNOT ID no. 6043359
  misc_feature: Encodes the peptide sequence at SEQ ID NO 12020
atggcggaggcggtggcgtacgaggagcagcggcggaggcagatagaggcgaacaagcggaagctggaggagctgcagctccaccacctctctgccgccgtcagagaggccgccgccgctgccaaaccctcgtcggccaagaagcggaaggctcaggtgccgcgggacgccgccgcggagccgctacggcgttctggccgagtcgccaacctccccgagaagcccatctaccgcgaggtcaaggtgaactcgccatttctgcaggtcagcaagtccaatgcgtcggtgctgtgggacgctgccacctccgtggtggcggagccgctacggtggtccggccgactcgccaacctccccgagaagcccatgtaccgcgaggattcggacgaggaaaggagctacgccatctctaaggctgatgagctggtgcaagagctgggctccagcttccccatcttcacccagcccattacactgtcccatgtcaccggaggcttctggctggacctcccaaagtatttctgccagaagcacctgccgaagagtgatgagacgataaccctggtggatgaggaggatgacgagtcagacacactgtacctcgtaaggaagactggcctcagcactggatggaaagagttcgccatcgagcgcaagctgcttgatggagattgcttggtcttccaactgattgagcggacaaagttcaaggtctacataattcgagcaacttcgtactttgaaagtgagtactga

SEQ ID NO: 12020 - protein, 251 aa, Sorghum bicolor
  misc_feature: Ceres ANNOT ID no. 6043359
  misc_feature (152)..(246): Pfam Id: B3 Pfam Desc: B3 DNA binding domain
  misc_feature (128)..(250): NCBI GI: 51091016 NCBI Desc: transcriptional factor b3-like [oryza sativa (japonica cultivar-group)]
  misc_feature (128)..(249): NCBI GI: 30694114 NCBI Desc: transcriptional factor b3 family protein [arabidopsis thaliana]
  misc_feature (102)..(242): NCBI GI: 115435514 NCBI Desc: os01g0234100 [oryza sativa (japonica cultivar-group)]
  misc_feature (189)..(238): NCBI GI: 92884626 NCBI Desc: transcriptional factor b3 [medicago truncatula]
  misc_feature (140)..(241): NCBI GI: 92872624 NCBI Desc: transcriptional factor b3; cupredoxin [medicago truncatula]
  misc_feature: Useful for making plants with altered terpenoid content
  misc_feature: Functional homolog of the protein sequence given in SEQ ID NO 13124
  misc_feature: Useful for making plants with altered terpenoid content
  misc_feature: Functional homolog of the protein sequence given in SEQ ID NO 13124
  misc_feature: The sequence is a functional homolog of SEQ ID NO. 467 in the 11/188,298 US application
MAEAVAYEEQRRRQIEANKRKLEELQLHHLSAAVREAAAAAKPSSAKKRKAQVPRDAAAEPLRRSGRVANLPEKPIYREVKVNSPFLQVSKSNASVLWDAATSVVAEPLRWSGRLANLPEKPMYREDSDEERSYAISKADELVQELGSSFPIFTQPITLSHVTGGFWLDLPKYFCQKHLPKSDETITLVDEEDDESDTLYLVRKTGLSTGWKEFAIERKLLDGDCLVFQLIERTKFKVYIIRATSYFESEY

SEQ ID NO: 12021 - DNA, 822 bp, Sorghum bicolor
  misc_feature: Ceres ANNOT ID no. 6043568
  misc_feature: Encodes the peptide sequence at SEQ ID NO 12022
atggcggagcagctcagctcatcccaggatgcccccaatcgccctgcgccggcacagagggtactggtgacgaacacgcatggtgagactctcgtcggcctgctgcaccacatggggtccgacaaggttgtggtgctctgccatggctttagagcttccagggacgatagcctcattactgatcttgcggctgcactaacaaagcaagggattagcgtgtttcgttttgattttagtggaaatggagaaagtgaaggtgaattccagtatggcaactacaagaaggaggctgctgacttgcactctgttgtcttgtatcttcgccaggaaaagtacaatgtagcagcaattgttggtcacagcaaaggtggagatgtgatggttctatatgcctctatctacaacgatgtccccatggtggttaacctttctggtcgatttaatttggagaaaggcattgaagagcgcctaggcaaagagtttatggatagaataaacaaagaaggctacattgatgtcacaaacaaatcaggaaaggttttgtacagagtgaccaaagagaccttgatggaacgactgagtattgatatgcacgcatcaagcctttccatcagcaaagagtgcaggttctttacaattcatggttcagctgacgagatcatacccgtggaagatgcatacgagtttgcaaagcttataccaaaccacaaactgcgtgtcattgagggagcaaatcactgctacactgctcaccgtagagaactttctgatgctgtagtagaagccatcacatccagtgaggcaggggagaccaaaccctag

SEQ ID NO: 12022 - protein, 273 aa, Sorghum bicolor
  misc_feature: Ceres ANNOT ID no. 6043568
  misc_feature (71)..(262): Pfam Id: Abhydrolase_1 Pfam Desc: alpha/beta hydrolase fold
  misc_feature (1)..(270): NCBI GI: 115437876 NCBI Desc: os01g0579900 [oryza sativa (japonica cultivar-group)]
  misc_feature (1)..(266): NCBI GI: 18461257 NCBI Desc: esterase/lipase/thioesterase family protein-like [oryza sativa (japonica cultivar-group)]
  misc_feature (19)..(265): NCBI GI: 115465147 NCBI Desc: os05g0539500 [oryza sativa (japonica cultivar-group)]
  misc_feature (19)..(263): NCBI GI: 124359246 NCBI Desc: esterase/lipase/thioesterase [medicago truncatula]
  misc_feature (19)..(263): NCBI GI: 140051860 NCBI Desc: esterase/lipase/thioesterase [medicago truncatula]
MAEQLSSSQDAPNRPAPAQRVLVTNTHGETLVGLLHHMGSDKVVVLCHGFRASRDDSLITDLAAALTKQGISVFRFDFSGNGESEGEFQYGNYKKEAADLHSVVLYLRQEKYNVAAIVGHSKGGDVMVLYASIYNDVPMVVNLSGRFNLEKGIEERLGKEFMDRINKEGYIDVTNKSGKVLYRVTKETLMERLSIDMHASSLSISKECRFFTIHGSADEIIPVEDAYEFAKLIPNHKLRVIEGANHCYTAHRRELSDAVVEAITSSEAGETKP

SEQ ID NO: 12023 - DNA, 1650 bp, Sorghum bicolor; identical to SEQ ID NO: 11255
  misc_feature: Ceres ANNOT ID no. 6043679
  misc_feature: Encodes the peptide sequence at SEQ ID NO 12024

SEQ ID NO: 12024 - protein, 549 aa, Sorghum bicolor; identical to SEQ ID NO: 11256
  misc_feature: Ceres ANNOT ID no. 6043679
  misc_feature (218)..(252): Pfam Id: PPR Pfam Desc: PPR repeat
  misc_feature (319)..(352): Pfam Id: PPR Pfam Desc: PPR repeat
  misc_feature (14)..(538): NCBI GI: 115485079 NCBI Desc: os11g0275400 [oryza sativa (japonica cultivar-group)]
  misc_feature (1)..(529): NCBI GI: 115475451 NCBI Desc: os08g0238100 [oryza sativa (japonica cultivar-group)]
  misc_feature (112)..(526): NCBI GI: 54695180 NCBI Desc: ppr986-12 [physcomitrella patens]
  misc_feature (152)..(527): NCBI GI: 78183583 NCBI Desc: ppr1106-17 [physcomitrella patens]
  misc_feature (150)..(526): NCBI GI: 87240430 NCBI Desc: tetratricopeptide-like helical [medicago truncatula]

SEQ ID NO: 12025 - DNA, 1650 bp, Sorghum bicolor; identical to SEQ ID NO: 11255
  misc_feature: Ceres ANNOT ID no. 6043684
  misc_feature: Encodes the peptide sequence at SEQ ID NO 12026

SEQ ID NO: 12026 - protein, 549 aa, Sorghum bicolor; identical to SEQ ID NO: 11256
  misc_feature: Ceres ANNOT ID no. 6043684
  misc_feature (218)..(252): Pfam Id: PPR Pfam Desc: PPR repeat
  misc_feature (319)..(352): Pfam Id: PPR Pfam Desc: PPR repeat
  misc_feature (14)..(538): NCBI GI: 115485079 NCBI Desc: os11g0275400 [oryza sativa (japonica cultivar-group)]
  misc_feature (1)..(529): NCBI GI: 115475451 NCBI Desc: os08g0238100 [oryza sativa (japonica cultivar-group)]
  misc_feature (112)..(526): NCBI GI: 54695180 NCBI Desc: ppr986-12 [physcomitrella patens]
  misc_feature (152)..(527): NCBI GI: 78183583 NCBI Desc: ppr1106-17 [physcomitrella patens]
  misc_feature (150)..(526): NCBI GI: 87240430 NCBI Desc: tetratricopeptide-like helical [medicago truncatula]

SEQ ID NO: 12027 - DNA, 1452 bp, Sorghum bicolor
  misc_feature: Ceres ANNOT ID no. 6043693
  misc_feature: Encodes the peptide sequence at SEQ ID NO 12028
atgccaaggagaacaggaaatgctacttcgaccaaatcagttgaattgatcaaacaagaccaattggagtttgatgatcctgatgaggtagatgaggaggaagaagttgagtatgaagaaattgaggaggaggttgagtatgaagaggtagaggatgaagatgataacgaggaggagggggaggaagatgaggaggatgaggatgaggaggaggaggaggaggaggaggaggaggaagaggaggaagaaattgaaggtgtgcgtgaagttgatcctaatcatgacagtaaaatggtggttgatgatccgaaggatgagaatgaaaaagagaagcatgctgagcttcttgctcttcctcctcatggagctgaagtttatgttggggggctctcctctgatgtatcttctgaagatctcaaacgactgtttgaatctgttggagaagttgtggaagtgcgaatgcgaggaaagggggataacaaggcgtatgcttttattaatttcagaactaaagagatggctttaaaggccatccgaaagctgtgcaataaagacctaaagggaaagaagataaaagtttcatcctctcaggctaagaataggctatttattgggaatgtaccccgtgattggacacctgatgatttcaaaactgcagtggaagaagttggccctggagttttacaagttgatctcatgaaggcaccaggctcaggtcgcaataagggttatggctttattgaatactacaaccaggcatgtgcagagtatgctaagcagaagatgtctaccccagaattcaaactagatacaaatgctcctactgtcagctgggcagatcctaagaatgctaatgaagctacatctactgcacaggttaaatctctatatgtcaaaaacatccccaagactgttactcaagagcagctgaaaaagctgtttgagcatgttggagaaattacaaaagttgttattcctcctgcaaaatctggacatgaaaatcggtatggttttgttcattttaaggaacggtccatggctatgaaggctttgaagaacactgagagatatgaacttgatggtcagctgctggattgttcacttgcaaaacctcctgctgataagaaggatgatactgtatcagcacctactgcaaaaggagctccattactcccaagttatgccccacttggatatggactggtgggagcttataatccacttggaaatggattggcaggtgcttataatccccttggaagtggactagcaggtgcttatggtgtgctttctgctcgtgctgcacagccaatgttgtatgctccaggtgctcctccaggttcaacaatgatcccaatggtcctaccagacggccgtcttgtatatgtggcagcagcctgtgcatgtgacttcgcctccgccacagcaaggtggtcgtcgatttggcggtag

SEQ ID NO: 12028 - protein, 483 aa, Sorghum bicolor
  misc_feature: Ceres ANNOT ID no. 6043693
  misc_feature (125)..(193): Pfam Id: RRM_1 Pfam Desc: RNA recognition motif. (a.k.a. RRM, RBD, or RNP domain)
  misc_feature (202)..(276): Pfam Id: RRM_1 Pfam Desc: RNA recognition motif. (a.k.a. RRM, RBD, or RNP domain)
  misc_feature (296)..(366): Pfam Id: RRM_1 Pfam Desc: RNA recognition motif. (a.k.a. RRM, RBD, or RNP domain)
  misc_feature (20)..(463): NCBI GI: 115487230 NCBI Desc: os12g0136200 [oryza sativa (japonica cultivar-group)]
  misc_feature (1)..(449): NCBI GI: 124360410 NCBI Desc: rna-binding region rnp-1 (rna recognition motif) [medicago truncatula]
  misc_feature (28)..(291): NCBI GI: 140055117 NCBI Desc: rna-binding region rnp-1 (rna recognition motif); calcium-binding ef-hand [medicago truncatula]
  misc_feature (256)..(463): NCBI GI: 115484087 NCBI Desc: os11g0139500 [oryza sativa (japonica cultivar-group)]
  misc_feature (118)..(376): NCBI GI: 28317322 NCBI Desc: at01548p [drosophila melanogaster]
  misc_feature: The sequence is a functional homolog of SEQ ID NO. 339 in the 11/188,298 US application
  misc_feature: The sequence is a functional homolog of SEQ ID NO. 458 in the 11/188,298 US application
MPRRTGNATSTKSVELIKQDQLEFDDPDEVDEEEEVEYEEIEEEVEYEEVEDEDDNEEEGEEDEEDEDEEEEEEEEEEEEEEEIEGVREVDPNHDSKMVVDDPKDENEKEKHAELLALPPHGAEVYVGGLSSDVSSEDLKRLFESVGEVVEVRMRGKGDNKAYAFINFRTKEMALKAIRKLCNKDLKGKKIKVSSSQAKNRLFIGNVPRDWTPDDFKTAVEEVGPGVLQVDLMKAPGSGRNKGYGFIEYYNQACAEYAKQKMSTPEFKLDTNAPTVSWADPKNANEATSTAQVKSLYVKNIPKTVTQEQLKKLFEHVGEITKVVIPPAKSGHENRYGFVHFKERSMAMKALKNTERYELDGQLLDCSLAKPPADKKDDTVSAPTAKGAPLLPSYAPLGYGLVGAYNPLGNGLAGAYNPLGSGLAGAYGVLSARAAQPMLYAPGAPPGSTMIPMVLPDGRLVYVAAACACDFASATARWSSIWR

SEQ ID NO: 12029 - DNA, 747 bp, Sorghum bicolor
  misc_feature: Ceres ANNOT ID no. 6043707
  misc_feature: Encodes the peptide sequence at SEQ ID NO 12030
atgtcgcccacccctgcccctgcgccgggcgccgtcgccggcgaggagttgtccacggaggtggtggtggtccggcacggggagaccgcgtggaacgcctcccgcatcgtccaggggcaaatggacccggagctaaatgaggctggcaggcagcaagccgttgtggtggcccgccgactgtcaagagaagccaagcctgccgccgtgtactcttctgatctgaagcgagccgccgagactgcagagatcatagccaaagcttgcggtgtaccaaatgtggtgctgaatcaggcgctgagagagaggcacatggggtatctccaaggcctcaagtgggacgatgccgtggctaagagtccagattctttcagaggctttgatatcttcaagcttaccgagggttctgatcctgacagcagaaatcaagaactgccaggtggtggagagagcatgaatcagctgaaggagcgctgcgtctccttcttgaataagattgcccaagaacacattggggagcgagtggtggtggtctcccacggtgcatccatactggagctctgccggcaccctgacccacccaaccgctccatccgtaggcacatccccaacacttcgctgaacgttttccgcatctccggcgtcaccggccagtggaccctcgagaggtgtggagatgtcggccatctcaaaggaaatggaaatgaatttctcgagaactcgtttgggggcgatggggcctcagcctaa

SEQ ID NO: 12030 - protein, 248 aa, Sorghum bicolor
  misc_feature: Ceres ANNOT ID no. 6043707
  misc_feature (20)..(186): Pfam Id: PGAM Pfam Desc: Phosphoglycerate mutase family
  misc_feature (9)..(222): NCBI GI: 115484075 NCBI Desc: os11g0138400 [oryza sativa (japonica cultivar-group)]
  misc_feature (20)..(222): NCBI GI: 108862162 NCBI Desc: cytochrome p450 family protein [oryza sativa (japonica cultivar-group)]
  misc_feature (19)..(244): NCBI GI: 9955567 NCBI Desc: phosphoglycerate mutase-like protein [arabidopsis thaliana]
  misc_feature (19)..(244): NCBI GI: 15237633 NCBI Desc: phosphoglycerate/bisphosphoglycerate mutase family protein [arabidopsis thaliana]
  misc_feature (93)..(248): NCBI GI: 42408059 NCBI Desc: phosphoglycerate mutase-like protein [oryza sativa (japonica cultivar-group)]
MSPTPAPAPGAVAGEELSTEVVVVRHGETAWNASRIVQGQMDPELNEAGRQQAVVVARRLSREAKPAAVYSSDLKRAAETAEIIAKACGVPNVVLNQALRERHMGYLQGLKWDDAVAKSPDSFRGFDIFKLTEGSDPDSRNQELPGGGESMNQLKERCVSFLNKIAQEHIGERVVVVSHGASILELCRHPDPPNRSIRRHIPNTSLNVFRISGVTGQWTLERCGDVGHLKGNGNEFLENSFGGDGASA

SEQ ID NO: 12031 - DNA, 2001 bp, Sorghum bicolor
  misc_feature: Ceres ANNOT ID no. 6043758
  misc_feature: Encodes the peptide sequence at SEQ ID NO 12032
atggctgctaaacccctcctcccaatcgccgcggcggcggctcgccttcccttccgcctcctctccccgtcagctccacctccccgcggcctccccttgctgtccccgccattcctgccccaaaggcgcagcctttccgcctctgccgtacccaccggcaggcgtagcaggccgccggccccggtcatcagcgagggcagggatgacgaggaggccgccgtaggccggcctgtatgtcctggatgcggggtcttcatgcaggatgcggatcctaacctccctggcttcttcaagaacccatcccgcagctcccaggacgagacgggaggaggtggagaagtgctcctggccgccgccgatacggatgcgtttcttgaagatgagaaggagggggtggtggcggaggacgcgttggatgctgaattggagggcctggacagcgatatcgatgagttccttgaagatttcgaggatggggacgaagaggatgatggctcaccggtgaaaggtgccactgatatcgatgcttttgccagcgattgggactctgattgggaggagatggaagaagacgaggatgagaaatggaggaaagaactggacggtttcaccccgccgggagtcggctatgggaacatcactgaggagacgatccagaggctgaagaaagagaagctgtccaagtccgagaggaagcgccaagcgagggaggccaagagggctgaggctgaggaggactcggccctcgtctgtagccggtgccactcgctgaggaattatgggcttgtgaagaatgacaaggctgagaacctgatcccagactttgattttgatcggttcatttcgtctcgggtcatgaagcggtcggctggcacaccggtcatagtcatggtggtggactgtgcagactttgatgggtcgtttccgaagcgagctgccaagtcgttgttcgaggcacttgaaggaaggaggaattcaaaggtgagcgaaacaccgaggcttgttcttgttggtacaaaggtggatttgcttccatggcaacaaatgggtgtccggttggataggtgggttcgtggccgtgctaaggcttttggagcacccaagctagatgctgtgttcttgatcagcgtccacagagatttggctgttagaaacctaatttcgtacatcaaggagtcagcaggacctcggagcaacgtttgggtgattggtgcgcagaatgctgggaaatctacgctgatcaatgcttttgcaaagaaacagggtgttaagatcacaagattgactgaagctgctgtcccgggaacaacactcggcatattgagggtaacaggtgttttacctgcaaaggcaaagatgtacgacactcctggcctgttgcatccttacataatggcaatgagattaaacaatgaggaaaggaagatggttgaaataaggaaagaattgcggccacgatccttcagggtgaaagtaggacaatctgtccatattggaggcttaacacggctggatgtgctaaaatcatcagctcaaactatctatgttactgtttgggcatcttccaatgttcccctccatcttggaaagactgaaaatgctgatgaattgcgagagaaacattttggtatcagacttcagcctccaattggcccagagcgagtcaatgaattgggtcactggacagaaagacatattgaggtttctggggcaagctgggacgtcaacagtatggacattgctgtttctggccttggatggtactccttgggccttaaaggcactgccactgtttccttgtggacatttgagggcattggtgtgacagaacgagatgcgatgattctgcatcgagcccagtttctcgaaaggcctggattttggttacctattgccatcgctaatgctctaggtgaggagacaagaaagaagaacgagaagagaaaggctgagcaaagaagaagagaggaagaagagctccttttggaagaaattgtttag

SEQ ID NO: 12032 - protein, 666 aa, Sorghum bicolor
  misc_feature: Ceres ANNOT ID no. 6043758
  misc_feature (398)..(489): Pfam Id: MMR_HSR1 Pfam Desc: GTPase of unknown function
  misc_feature (131)..(649): NCBI GI: 87241448 NCBI Desc: imp dehydrogenase/gmp reductase [medicago truncatula]
  misc_feature (237)..(648): NCBI GI: 50726207 NCBI Desc: gtp-binding protein-like [oryza sativa (japonica cultivar-group)]
  misc_feature (328)..(618): NCBI GI: 28378240 NCBI Desc: gtpase [lactobacillus plantarum wcfs1]
  misc_feature (328)..(615): NCBI GI: 92090262 NCBI Desc: gtp-binding protein [lactobacillus reuteri 100-23]
  misc_feature (334)..(615): NCBI GI: 90820670 NCBI Desc: gtp-binding protein [lactobacillus salivarius subsp. salivarius ucc118]
MAAKPLLPIAAAAARLPFRLLSPSAPPPRGLPLLSPPFLPQRRSLSASAVPTGRRSRPPAPVISEGRDDEEAAVGRPVCPGCGVFMQDADPNLPGFFKNPSRSSQDETGGGGEVLLAAADTDAFLEDEKEGVVAEDALDAELEGLDSDIDEFLEDFEDGDEEDDGSPVKGATDIDAFASDWDSDWEEMEEDEDEKWRKELDGFTPPGVGYGNITEETIQRLKKEKLSKSERKRQAREAKRAEAEEDSALVCSRCHSLRNYGLVKNDKAENLIPDFDFDRFISSRVMKRSAGTPVIVMVVDCADFDGSFPKRAAKSLFEALEGRRNSKVSETPRLVLVGTKVDLLPWQQMGVRLDRWVRGRAKAFGAPKLDAVFLISVHRDLAVRNLISYIKESAGPRSNVWVIGAQNAGKSTLINAFAKKQGVKITRLTEAAVPGTTLGILRVTGVLPAKAKMYDTPGLLHPYIMAMRLNNEERKMVEIRKELRPRSFRVKVGQSVHIGGLTRLDVLKSSAQTIYVTVWASSNVPLHLGKTENADELREKHFGIRLQPPIGPERVNELGHWTERHIEVSGASWDVNSMDIAVSGLGWYSLGLKGTATVSLWTFEGIGVTERDAMILHRAQFLERPGFWLPIAIANALGEETRKKNEKRKAEQRRREEEELLLEEIV

SEQ ID NO: 12033 - DNA, 813 bp, Sorghum bicolor
  misc_feature: Ceres ANNOT ID no. 6043767
  misc_feature: Encodes the peptide sequence at SEQ ID NO 12034
atggctatggcgtccgcgctccggctctccctcctcgcgccgcgcgccgtctctatctccgtctccgcctccgcggggccagcagcctcgcgccatctcctctcccgccgcctcgctctgcgcctccctcgtcctcccccacgacccgccgccctctccgccccatccgccgtgcggccgcgcgaggccgggcgcgtccagccgctccgcgccgcttccttctcaagcggtaccgctccggccgcaggacccaccggcggaggaggcgccaaggactggcgcgtcttcctggcatggtacctgatggctctggataagaatccgattgccactaaggcggtcacgtctgctgtcctgactctggctggggacctcatctgccagcttgttattgatcaagttccagagcttgatttgaggagaacatttgtattcacatttttgggcctggcccttgtggcgccaactttacatttctggtacttgtatttgagtaaattagtgacaatcagtggagcaccaggtgccattgctcgccttatacttgatcagtttatttttgctcccattttcatcggtgtttttatgagcttactggtcaccttggaaggaaatccctctcttttagtgccaaagcttaagcaggagtggttctcatcagtgttggcaaattggcaattatggataccatttcagtttttcaatttttatttcgtccctcagaagtttcaggtccttgctgctaatgttgtatcccttgcatggaatgtgattttgtcatttaaagctcacaaggaagttatcgcaaaatag

SEQ ID NO: 12034 - protein, 270 aa, Sorghum bicolor
  misc_feature: Ceres ANNOT ID no. 6043767
  misc_feature (196)..(268): Pfam Id: Mpv17_PMP22 Pfam Desc: Mpv17 / PMP22 family
  misc_feature (77)..(270): NCBI GI: 15241166 NCBI Desc: peroxisomal membrane 22 kda family protein [arabidopsis thaliana]
  misc_feature (77)..(270): NCBI GI: 24111335 NCBI Desc: at5g19750/t29j13_170 [arabidopsis thaliana]
  misc_feature (1)..(232): NCBI GI: 115487140 NCBI Desc: os12g0127900 [oryza sativa (japonica cultivar-group)]
  misc_feature (1)..(234): NCBI GI: 115483989 NCBI Desc: os11g0131200 [oryza sativa (japonica cultivar-group)]
  misc_feature (33)..(245): NCBI GI: 87241014 NCBI Desc: wd-40 repeat [medicago truncatula]
MAMASALRLSLLAPRAVSISVSASAGPAASRHLLSRRLALRLPRPPPRPAALSAPSAVRPREAGRVQPLRAASFSSGTAPAAGPTGGGGAKDWRVFLAWYLMALDKNPIATKAVTSAVLTLAGDLICQLVIDQVPELDLRRTFVFTFLGLALVAPTLHFWYLYLSKLVTISGAPGAIARLILDQFIFAPIFIGVFMSLLVTLEGNPSLLVPKLKQEWFSSVLANWQLWIPFQFFNFYFVPQKFQVLAANVVSLAWNVILSFKAHKEVIAK

SEQ ID NO: 12035 - DNA, 915 bp, Sorghum bicolor
  misc_feature: Ceres ANNOT ID no. 6043770
  misc_feature: Encodes the peptide sequence at SEQ ID NO 12036
atggccgaccgcgtccacccggcgcctcctccacctccaccaccggcgctgatctcctcctcctccccacctcatcagcagcagccacacgaccagcacgccggtgccgccggcgcggtgcccccgccgccggcgccgacgacggacacaaccccactacagcagcacccgtccttcgcccgcccggcggcgcccccaccggggacctacatcgtgcaagtccccaaggaccaggtgctccgcgtcccaccgccagaccgcgcgcgccggtacaagaagctctcctcccgcccggcgcggcgccgcgcgctgcgccgcgcctgctgctgcgccatcgccatcgtcctcctgctcgtcgccctcgccgccgcgttcgtcggcgccgtctacctcatctaccgcccgcgcgcgccgtctttctccgtcgcgtccctctccatccacggcctcaacaccacctccctctcctcctccctgtccccgcggctcgacgccgtcgtgcgcgcggacaacgcgcggaacaagaaggtcggcatcgagtaccgcggcggcggggaggtcgcggtgtcctacgactccggcggcagcggcgcgaggctcgcggcgggcgcgtggccggcgttccggcagccgccgaggaacgtgacggcgttcgcggtgtccatgacgggcaacggcgtgcggctcacggaggaccaggcgaagcggatcgccaccgagcaggccgccggcgccgtgccgctgcaggtggaggccacgctccacgtcaggctccggttcggcggcgtgctccggacatggaccgtcgacgtcagggcaaggtgtgatgtggctgttgataggctcgacggcgacgccgtcgctgttaatagagggtgcaaggtcaaggtcaggccactctggtggtggtggtga

SEQ ID NO: 12036 - protein, 304 aa, Sorghum bicolor
  misc_feature: Ceres ANNOT ID no. 6043770
  misc_feature (130)..(275): Pfam Id: Hin1 Pfam Desc: Harpin-induced protein 1 (Hin1)
  misc_feature (23)..(261): NCBI GI: 115483979 NCBI Desc: os11g0130400 [oryza sativa (japonica cultivar-group)]
  misc_feature (20)..(302): NCBI GI: 18844773 NCBI Desc: harpin-induced protein-related-like [oryza sativa (japonica cultivar-group)]
  misc_feature (49)..(301): NCBI GI: 140044063 NCBI Desc: harpin-induced 1 [medicago truncatula]
  misc_feature (98)..(298): NCBI GI: 90399035 NCBI Desc: h0402c08.7 [oryza sativa (indica cultivar-group)]
  misc_feature (98)..(298): NCBI GI: 38344198 NCBI Desc: osjnba0064g10.14 [oryza sativa (japonica cultivar-group)]
MADRVHPAPPPPPPPALISSSSPPHQQQPHDQHAGAAGAVPPPPAPTTDTTPLQQHPSFARPAAPPPGTYIVQVPKDQVLRVPPPDRARRYKKLSSRPARRRALRRACCCAIAIVLLLVALAAAFVGAVYLIYRPRAPSFSVASLSIHGLNTTSLSSSLSPRLDAVVRADNARNKKVGIEYRGGGEVAVSYDSGGSGARLAAGAWPAFRQPPRNVTAFAVSMTGNGVRLTEDQAKRIATEQAAGAVPLQVEATLHVRLRFGGVLRTWTVDVRARCDVAVDRLDGDAVAVNRGCKVKVRPLWWWW

SEQ ID NO: 12037 - DNA, 1590 bp, Sorghum bicolor
  misc_feature: Ceres ANNOT ID no. 6043785
  misc_feature: Encodes the peptide sequence at SEQ ID NO 12038
atggatgagcaaagtagcggcggcggtgaggcggcggcgaaggtgccactgctggagccacgggcggcggcggcggcggaggaggaggagcaccaccaccaccacaacggggcaggaggaggaggaggaggggcggcggcggcggtggtcgtgggcaagtcggacgaggcggagtggtcggcgcagccgctgcggcggcgggcgtgggaggagaacaagcggctgtgggtggtggcggggccgtccatctgcgcgcgcttcgcgtcgttcggcgtcaccgtcatcagccaggccttcatcggccacatcggcgccaccgagctcgccgcctacgccctcgtctccaccgtcctcatgaggttcagcaacggcgtcctcctggggatggcgagcgcactggagacgctatgtgggcaatcctacggcgcgaagcagtaccacatgctgggcatctacctacagcggtcctggatcatcctcttcgcgtgctccgtcgtgctgctcccgatctacctcttcacggcgccgctgctggtcgcgctgggccaggacccggagatcgccgtggtggcgggcaccatctcgctctggtacatccccgtcatgttctcctacgtctgggccttcacgctccagatgtacctgcaggcgcagagcaagaacatcatcatcacctacctggcattgctcaacctcggcctccacctcctcctgtcatggctcatgactgtcaagttccagctcggcgtggcgggggtcatggggtcgatggtcatcgccatgtggatccccgtgtttgggcagcttgccttcgtcttctttggtggatgccctcacacgtggactgggttctcctcggctgcgtttgctgatctcggtgccatcgtcaagctctcgctatcttctggtgtcatgctctgtttggaattgtggtacaacaccatattggtgctgctcacagggtacatgaagaatgcagaggttgcactcgacgccctttcaatatgccttaatatcaacggttgggagatgatgatttccttcggctttttggctgcaacaggagtgcgagtggcaaatgagcttggagctggaagcgcaagaagggcaaagtttgccatttacaatgtggtcatcacatctttctcgatcggatttgtgttgttcgtgctcttccttttcttccgtggaggccttgcctacatatttaccgacagtcaagcggtagctgagtcagttgctgacctctcacctctgctagccttctccatattgctaaacagtgttcagccagtgctatcaggcgtcgccgtcggcgcaggctggcaaagcgtagtcgcctatgtcaacgtcacttcctactacctgattggcatccctcttggagcagtcctgggatatgtggtgggatttgaagtaaagggcatttggattggcatgctgctcggaacactagtccaaactattgtgcttctcttcataacattaaagaccgactgggaaaaacaggtggcggttgctcaagagagactgaagagatggtacatgcaagagaacagaagacttcaggggttgagtggaaactcttga

SEQ ID NO: 12038 - protein, 529 aa, Sorghum bicolor
  misc_feature: Ceres ANNOT ID no. 6043785
  misc_feature (81)..(241): Pfam Id: MatE Pfam Desc: MatE
  misc_feature (301)..(464): Pfam Id: MatE Pfam Desc: MatE
  misc_feature (53)..(257): NCBI GI: 115483959 NCBI Desc: os11g0129000 [oryza sativa (japonica cultivar-group)]
  misc_feature (57)..(519): NCBI GI: 140057052 NCBI Desc: multi antimicrobial extrusion protein mate [medicago truncatula]
  misc_feature (55)..(519): NCBI GI: 92893030 NCBI Desc: multi antimicrobial extrusion protein mate [medicago truncatula]
  misc_feature (41)..(526): NCBI GI: 15223391 NCBI Desc: mate efflux family protein [arabidopsis thaliana]
  misc_feature (64)..(504): NCBI GI: 42571729 NCBI Desc: mate efflux family protein [arabidopsis thaliana]
MDEQSSGGGEAAAKVPLLEPRAAAAAEEEEHHHHHNGAGGGGGGAAAAVVVGKSDEAEWSAQPLRRRAWEENKRLWVVAGPSICARFASFGVTVISQAFIGHIGATELAAYALVSTVLMRFSNGVLLGMASALETLCGQSYGAKQYHMLGIYLQRSWIILFACSVVLLPIYLFTAPLLVALGQDPEIAVVAGTISLWYIPVMFSYVWAFTLQMYLQAQSKNIIITYLALLNLGLHLLLSWLMTVKFQLGVAGVMGSMVIAMWIPVFGQLAFVFFGGCPHTWTGFSSAAFADLGAIVKLSLSSGVMLCLELWYNTILVLLTGYMKNAEVALDALSICLNINGWEMMISFGFLAATGVRVANELGAGSARRAKFAIYNVVITSFSIGFVLFVLFLFFRGGLAYIFTDSQAVAESVADLSPLLAFSILLNSVQPVLSGVAVGAGWQSVVAYVNVTSYYLIGIPLGAVLGYVVGFEVKGIWIGMLLGTLVQTIVLLFITLKTDWEKQVAVAQERLKRWYMQENRRLQGLSGNS

SEQ ID NO: 12039 - DNA, 999 bp, Sorghum bicolor
  misc_feature: Ceres ANNOT ID no. 6043821
  misc_feature: Encodes the peptide sequence at SEQ ID NO 12040
atggtggagcgtagtgtgaaatcagagcatggagtcgacctgttcctgcctcctggcttcaggttccatccgacagacgaggaggtcatcaccagctacctcctgcagaagttcttgaaccctagctttgcgccgcacgccatcggggaggtggatctcaacaagtgcgaaccatgggatctcccaagcaaggcgaacatgggagagaaggagtggtacttcttctgccacaaggacatgaaatacccgacgggcacgcgcacgaaccgcgccaccaaggagggctactggaaggccaccggcaaggacagggagatcttcaagcagcctgggcgtgagctggtggggatgaagaagacgctggtgttctacatgggcagggctccaaggggcaccaagaccaactgggtgatgcacgaatttcgccttgatggcaagtccaggcacaccaacgactccaactccaatctacgattcaatcccaaggatgaatgggtcgtgtgcaaggtgcaccacaaaggaggcgaagaggccagcagcaagaaggccggcggcggcggcggcgaggagcactactcctccgccggaacgcccaacgtcagctccgtcgaggccggcgaaggcggcgacgagttcctcgtcgactctttgctggattactccagctacttcaactccagcttgcctttgacgcccagcacgacgacgacgaccatcagcgccgcagcgccgccctccgcctcctggaacatgcttcgtcacgcggcagacaacaaagcagcaatggggacgaactacagcttgcaccaccaggcaatggtggcgaaagttctaggaagcggctgcggcgtctctccgaacttcggcgctggtttgccgccggcgggttcctcggtggcggcggccggaataattgcgcagaataatgttgtgccgcagcagaggcttgctgggaactacaggggaaattatgctgcaggttaccatacaagcaagtag

SEQ ID NO: 12040 - protein, 332 aa, Sorghum bicolor
  misc_feature: Ceres ANNOT ID no. 6043821
  misc_feature (16)..(144): Pfam Id: NAM Pfam Desc: No apical meristem (NAM) protein
  misc_feature (1)..(298): NCBI GI: 84029362 NCBI Desc: nac domain-containing protein 77 (onac077) (onac300)
  misc_feature (1)..(298): NCBI GI: 60677628 NCBI Desc: onac300 [oryza sativa (japonica cultivar-group)]
  misc_feature (1)..(181): NCBI GI: 42573407 NCBI Desc: no apical meristem (nam) family protein [arabidopsis thaliana]
  misc_feature (16)..(268): NCBI GI: 27529808 NCBI Desc: osnac1 protein [oryza sativa]
  misc_feature (9)..(243): NCBI GI: 10177257 NCBI Desc: cuc2 [arabidopsis thaliana]
  misc_feature: The sequence is a functional homolog of SEQ ID NO 106 in the 10/225,068US patent application
  misc_feature: The sequence is a functional homolog of SEQ ID NO 155 in the 11/479,226US patent application
  misc_feature: The sequence is a functional homolog of SEQ ID NO 22 in the 10/714,887US patent application
  misc_feature: The sequence is a functional homolog of SEQ ID NO 22 in the 11/435,388US patent application
  misc_feature: The sequence is a functional homolog of SEQ ID NO 2216 in the 10/374,780US patent application
  misc_feature: The sequence is a functional homolog of SEQ ID NO 2348 in the 10/374,780US patent application
  misc_feature: The sequence is a functional homolog of SEQ ID NO 330 in the 10/412,699US patent application
  misc_feature: The sequence is a functional homolog of SEQ ID NO 34 in the 10/412,699US patent application
  misc_feature: The sequence is a functional homolog of SEQ ID NO 340 in the 10/412,699US patent application
  misc_feature: The sequence is a functional homolog of SEQ ID NO 52 in the 10/903,236US patent application
  misc_feature: The sequence is a functional homolog of SEQ ID NO 778 in the 11/479,226US patent application
  misc_feature: The sequence is a functional homolog of SEQ ID NO 780 in the 10/225,066US patent application
  misc_feature: Useful for making plants with modulated growth and phenotype characteristics
  misc_feature: The sequence is a functional homolog of SEQ ID NO 330 in the 20040045049 US patent application
  misc_feature: The sequence is a functional homolog of SEQ ID NO 34 in the 20040045049 US patent application
  misc_feature: The sequence is a functional homolog of SEQ ID NO 340 in the 20040045049 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered lignin content
  misc_feature: Functional homolog of the protein sequence given in SEQ ID NO 13250
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MVERSVKSEHGVDLFLPPGFRFHPTDEEVITSYLLQKFLNPSFAPHAIGEVDLNKCEPWDLPSKANMGEKEWYFFCHKDMKYPTGTRTNRATKEGYWKATGKDREIFKQPGRELVGMKKTLVFYMGRAPRGTKTNWVMHEFRLDGKSRHTNDSNSNLRFNPKDEWVVCKVHHKGGEEASSKKAGGGGGEEHYSSAGTPNVSSVEAGEGGDEFLVDSLLDYSSYFNSSLPLTPSTTTTTISAAAPPSASWNMLRHAADNKAAMGTNYSLHHQAMVAKVLGSGCGVSPNFGAGLPPAGSSVAAAGIIAQNNVVPQQRLAGNYRGNYAAGYHTSK

SEQ ID NO: 12041 - DNA, 1893 bp, Sorghum bicolor
  misc_feature: Ceres ANNOT ID no. 6043831
  misc_feature: Encodes the peptide sequence at SEQ ID NO 12042
atggacgcctgggaggccaccaaggtggtgttcgaccgggtgcgggagctggacccggagaacgcgtccaggatgatgggcctgctgctcatccaggacaacagcgacaaggagctcatccgcctcgccttcggcccggaccacctgctccacgccttcgtcgccaccgcgcgcgccgagctcgccgccaacggcaagcccgcgtccccgccgtcgcccgtgctcggcccgctgcagaccggcccgccctggggcctcccgagccccggcgctggcgccgaccaccaccaccaccaacactcgcccttcgccgaccaccagctcgggtacgacggcgccgccgccgacgcgttctacgccgacgactacgacgtctggtcccccgctggcggcgcccactgccgcagcttctcgctcagcgacgccgaggcggcggccgcgtcgtggaggccctgcatgtactacgcgcgcgggtactgcaagaacggctcctcctgccgcttcctccacggcgtgcctgaggacgacgccgcggagcgggagatggccgtcatgcgcgccaaggccctcgccgccgcgccgccgccgcagctcatggcgtccgcgtacccgttctcgccgtcgcccaaaggagctggcgtcagcctcagcttcctgctccagcagcatcagcagcagagcgacacccaaagggcggcggcggcggcggggatggtgctcggcggcgaggacatgcacaggttcccggtgcgctcccctcggatggaccgcggcgacctcatcggcagccccgccgcgcggcagatctacctcacgttcccggccgactccaccttcagcgaggaggacgtgtccaactacttcagcatgttcgggccggtgcaggacgtgcgcatcccgtaccagcagaagcgcatgttcggcttcgtcaccttcgtctacgccgagacggtgaaggtcctcctcagcaagggcaacccgcatttcgtgtgcgacgcccgcgtgctcgtcaagccctacaaggagaagggcaaggtccccgacaggttcaggaagctgcagcacgcgcaccatggcgtcggcgagttcgccggttgcacgtcgcccaccggattgctggattccagggacccctacgatctccagcagccccagatcggaccaaggatgatgtacgggaacatggctaaccatgaggcgttcctgaggaggaagctggaggagcagcagcaggcggccgagctgcagcaagccattgagctggaaggccgccgcttcatggggctgcagctgcttgacctcaagagcaggggccaccaccatctcgggctcggctcccccgttggtgcaggttcgcccatgtctctggggcaagctgatggcaaaggcagcggcaaccacgggaatggcggcaatgcctcccatttggaggatgtcaccggcatccaagagaggatgagcagtactagtagcgttgcaatgagtgctcctgctgctgcctctgcaactgctgatgcagaaggcaagcacgaggagcagcagggagagggtggtgatggcagccccaagcagaagcaggcagtcaaccctggggaagaggagaaggtggaatatggtcctgtgacagcaacacccaatgctgcttgtggattccaagaaagtggcgtggtggagcacattttgcctgacagcccctttgcatcccccgccaaggcctccattgatactgttactgctgcaactgttcagaatggtagcatcagcaacagcagccctcatcatctggcttcggcccttttcccagctgtatccacccttgagctgcccccatacaactcctgcttttttcaggtgcccaggttttctcctgggcatgaagccattgggctgtga

SEQ ID NO: 12042 - protein, 630 aa, Sorghum bicolor
  misc_feature: Ceres ANNOT ID no. 6043831
  misc_feature (147)..(172): Pfam Id: zf-CCCH Pfam Desc: Zinc finger C-x8-C-x5-C-x3-H type (and similar)
  misc_feature (62)..(569): NCBI GI: 115474123 NCBI Desc: os07g0682400 [oryza sativa (japonica cultivar-group)]
  misc_feature (195)..(349): NCBI GI: 79316196 NCBI Desc: rna binding / nucleic acid binding [arabidopsis thaliana]
  misc_feature (62)..(448): NCBI GI: 22331232 NCBI Desc: rna recognition motif (rrm)-containing protein [arabidopsis thaliana]
  misc_feature (133)..(447): NCBI GI: 30684113 NCBI Desc: zinc finger (ccch-type) family protein [arabidopsis thaliana]
  misc_feature (266)..(346): NCBI GI: 27817837 NCBI Desc: rrm-containing protein-like [oryza sativa (japonica cultivar-group)]
MDAWEATKVVFDRVRELDPENASRMMGLLLIQDNSDKELIRLAFGPDHLLHAFVATARAELAANGKPASPPSPVLGPLQTGPPWGLPSPGAGADHHHHQHSPFADHQLGYDGAAADAFYADDYDVWSPAGGAHCRSFSLSDAEAAAASWRPCMYYARGYCKNGSSCRFLHGVPEDDAAEREMAVMRAKALAAAPPPQLMASAYPFSPSPKGAGVSLSFLLQQHQQQSDTQRAAAAAGMVLGGEDMHRFPVRSPRMDRGDLIGSPAARQIYLTFPADSTFSEEDVSNYFSMFGPVQDVRIPYQQKRMFGFVTFVYAETVKVLLSKGNPHFVCDARVLVKPYKEKGKVPDRFRKLQHAHHGVGEFAGCTSPTGLLDSRDPYDLQQPQIGPRMMYGNMANHEAFLRRKLEEQQQAAELQQAIELEGRRFMGLQLLDLKSRGHHHLGLGSPVGAGSPMSLGQADGKGSGNHGNGGNASHLEDVTGIQERMSSTSSVAMSAPAAASATADAEGKHEEQQGEGGDGSPKQKQAVNPGEEEKVEYGPVTATPNAACGFQESGVVEHILPDSPFASPAKASIDTVTAATVQNGSISNSSPHHLASALFPAVSTLELPPYNSCFFQVPRFSPGHEAIGL

SEQ ID NO: 12043 - DNA, 1254 bp, Sorghum bicolor
  misc_feature: Ceres ANNOT ID no. 6043915
  misc_feature: Encodes the peptide sequence at SEQ ID NO 12044
atggcgtcaccagggttgtcaccagagttcggcgcgagtgctagcattgttgacgaccagagaagtgccttctcactggcggcgcgacagacatgctctacttcttctggatcttatgtttgtgcagatctcctagacagcctgcttcatgaaatcattgttctcatcaactcattccaggatttccttgcttttactggcacctgccactcttggcgtgcagcagtctcttccttcccctctgtgtatgctttcagcttcccacctctccacctcaaaccagatggtccttatgtccctccacatagcagaggtatgaagcacctcagtttgtctagttgcaaatggaatctctgtgacattaccaagaaaaatttgtcccttcaatgttcagtgcctcaaaacactccaaatgaaatggactacctgggctgctcacatgggtattttatctttacatatgaggaacactgcctccttgtcgatgcatacactggtgccaaggtgatgccccccaaactcccatgcaacaacaatatcgactactatccttatattggcgtccttacggctccattcagttcacccaactcgtgcctcctcctcttctcaatggcctccatgttcgagtggcaggttggaacaaactcctggtcagagcatcctcttcatcttgaccatgaacgcatctatcaggttgtcttcttcaaatgtcatatccttgtcacagatactcttatgaggcttcacactatccaattgacaccccagttcagcatgaaaagaatagcagttacgtggagctccctgcgggccctgcctcttaacccatggttggtggtctgtggtgacatgcttctcatggttgacctcgcaattagctttggtgagtccaatggctccattagatttttcgaggtctttcgccttgacttctcagtgaagccagccaggtgggtacagctggagaagttggaaaaccttgcgctatttattagtctggataggcggaaccctgcagtttcttgcatgaaccccgagagatggggaggaaagagtaactgtgtttacgttgccaggctatttgatgatgctgatcctgaagagacttggactgtgctggaggttggtcagtcagttccccaccaccgtgtatttgacaccatgatgtatggtcatgcattcccaccagaatacagacaaatcggtagcctctggctgttccccagtatggtttatggcgccagccagtga

SEQ ID NO: 12044 - protein, 417 aa, Sorghum bicolor
  misc_feature: Ceres ANNOT ID no. 6043915
  misc_feature (31)..(417): NCBI GI: 55295888 NCBI Desc: selenium-binding protein-like [oryza sativa (japonica cultivar-group)]
  misc_feature (109)..(417): NCBI GI: 55295904 NCBI Desc: selenium-binding protein-like [oryza sativa (japonica cultivar-group)]
  misc_feature (42)..(415): NCBI GI: 115465968 NCBI Desc: os06g0111200 [oryza sativa (japonica cultivar-group)]
  misc_feature (39)..(413): NCBI GI: 115465996 NCBI Desc: os06g0113500 [oryza sativa (japonica cultivar-group)]
  misc_feature (140)..(413): NCBI GI: 55295887 NCBI Desc: selenium-binding protein-like [oryza sativa (japonica cultivar-group)]
MASPGLSPEFGASASIVDDQRSAFSLAARQTCSTSSGSYVCADLLDSLLHEIIVLINSFQDFLAFTGTCHSWRAAVSSFPSVYAFSFPPLHLKPDGPYVPPHSRGMKHLSLSSCKWNLCDITKKNLSLQCSVPQNTPNEMDYLGCSHGYFIFTYEEHCLLVDAYTGAKVMPPKLPCNNNIDYYPYIGVLTAPFSSPNSCLLLFSMASMFEWQVGTNSWSEHPLHLDHERIYQVVFFKCHILVTDTLMRLHTIQLTPQFSMKRIAVTWSSLRALPLNPWLVVCGDMLLMVDLAISFGESNGSIRFFEVFRLDFSVKPARWVQLEKLENLALFISLDRRNPAVSCMNPERWGGKSNCVYVARLFDDADPEETWTVLEVGQSVPHHRVFDTMMYGHAFPPEYRQIGSLWLFPSMVYGASQ

SEQ ID NO: 12045 - DNA, 501 bp, Sorghum bicolor
  misc_feature: Ceres ANNOT ID no. 6043924
  misc_feature: Encodes the peptide sequence at SEQ ID NO 12046
atggcgagttttgacctgacgggtttgcttctctggctcggcgacgcttttctgatcatcgccatggtcgccgtctgctgctgctacaacggtgaacgacgacgccgggaacgggcggtggacgatgacgaccggaggcatcaagaggcagcggcagcggcagcatcccgcgcgcagccggcgcctggagcggcggccgtgcagatggcggccatggccgtggccctactgcaccacgtcacgttcccacgccagaacgtcgtcggtgatgacggcggcggcggcggcgatgatcaccgtctgtcggcggcggcggaggaggatgtgtgcgcgatctgcttgggccagtttgaggacggcgactggtacagcgtcatgcccggctgccgccacgagttccaccggagctgcattgccaagtggctcaccgcgtgcaacaacacgtgcccgttgtgtagggctcagctgcaatggaatgttgttgctcatgacatggtgtag

SEQ ID NO: 12046 - protein, 166 aa, Sorghum bicolor
  misc_feature: Ceres ANNOT ID no. 6043924
  misc_feature (110)..(152): Pfam Id: zf-C3HC4 Pfam Desc: Zinc finger, C3HC4 type (RING finger)
  misc_feature (110)..(164): NCBI GI: 140052506 NCBI Desc: zinc finger, ring-type [medicago truncatula]
  misc_feature (50)..(153): NCBI GI: 32487554 NCBI Desc: osjnba0013k16.6 [oryza sativa (japonica cultivar-group)]
  misc_feature (6)..(156): NCBI GI: 115436206 NCBI Desc: os01g0311400 [oryza sativa (japonica cultivar-group)]
  misc_feature (89)..(156): NCBI GI: 47497754 NCBI Desc: ring zinc finger protein-like [oryza sativa (japonica cultivar-group)]
  misc_feature (45)..(157): NCBI GI: 20160754 NCBI Desc: p0503c12.20 [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 424 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
MASFDLTGLLLWLGDAFLIIAMVAVCCCYNGERRRRERAVDDDDRRHQEAAAAAASRAQPAPGAAAVQMAAMAVALLHHVTFPRQNVVGDDGGGGGDDHRLSAAAEEDVCAICLGQFEDGDWYSVMPGCRHEFHRSCIAKWLTACNNTCPLCRAQLQWNVVAHDMV

SEQ ID NO: 12047 - DNA, 1092 bp, Sorghum bicolor
  misc_feature: Ceres ANNOT ID no. 6044072
  misc_feature: Encodes the peptide sequence at SEQ ID NO 12048
atggcgggaggtagcaaaggctgcgatgagagctctgcagatcatcagctgctgctatccagcggccaggccggggacgacggggaggatgatgctggtggcgccgacgacgtgcctcccgccggtcgtcatgacgggagctcaagcaatagcagcacggtggagctggatgaagccggcggggacagcggtaggaaggtcgccggcgcctcgccgtcctcggtgcgcccctacgtccgctccaagaacccccgcctccgctggacgccggagctccacctctgcttcctccgcgccgtcgacaggctcggcggccaagaccgtgcaactccaaagctcgttcttcaattgatggacgtgaaagggctgagcataggccatgtcaagagccatctccaaatgtataggagcaagaagatcgacgactcggaccagggtgctactggttcatggagagatcttcatcatcagttgcaggatgggggacaagcgtacaacctcggtcatctctccttccatcacggccagactggtgctagtaccatattgtcagcaaggtttggtgcatggccccattggagcaattttcatgatccatcatatttgcttcacagtcaccatcttcttggatcaaaacactactactcatcaacagctgaagccgatgtattccttagaaaccgagctcagtatactgctagagctactagcaacactccagcgtctactactcttcagaggtgtttaaatgatcaattcatgaatcatcatcaacgacgactgtcgcaaaatgaggataatatccaccatgatccccttgatcttgaactcgcattggatattggcccaagccaagacaagagaataaagagatcatcaggttgtagctggagaagacatcaagaagaggagaatgtcgggaatcaagaagtcgagagtgctactgatgatactcggctatctctttctttgttcccatctcctccttatgtgaggaccagtagtggtggtcatcataaagtcctaggtctcaatatggaaaaaggcacagcgcatccgacaaggacaagtactcttgatctcaccatatga

SEQ ID NO: 12048 - protein, 363 aa, Sorghum bicolor
  misc_feature: Ceres ANNOT ID no. 6044072
  misc_feature (85)..(136): Pfam Id: Myb_DNA-binding Pfam Desc: Myb-like DNA-binding domain
  misc_feature (26)..(325): NCBI GI: 115483751 NCBI Desc: os11g0106100 [oryza sativa (japonica cultivar-group)]
  misc_feature (9)..(212): NCBI GI: 92871144 NCBI Desc: homeodomain-related [medicago truncatula]
  misc_feature (7)..(190): NCBI GI: 140057815 NCBI Desc: homeodomain-related [medicago truncatula]
  misc_feature (61)..(173): NCBI GI: 7527727 NCBI Desc: t5e21.10 [arabidopsis thaliana]
  misc_feature (61)..(173): NCBI GI: 79344640 NCBI Desc: dna binding / transcription factor [arabidopsis thaliana]
  misc_feature: The plant is abnormally small.
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 254 in the 10/666,642US patent application
  misc_feature: Useful for making plants with modulated biomass
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 254 in the 20070033671 US patent application
  misc_feature: Functional homolog of the protein sequence given in SEQ ID NO 13530
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MAGGSKGCDESSADHQLLLSSGQAGDDGEDDAGGADDVPPAGRHDGSSSNSSTVELDEAGGDSGRKVAGASPSSVRPYVRSKNPRLRWTPELHLCFLRAVDRLGGQDRATPKLVLQLMDVKGLSIGHVKSHLQMYRSKKIDDSDQGATGSWRDLHHQLQDGGQAYNLGHLSFHHGQTGASTILSARFGAWPHWSNFHDPSYLLHSHHLLGSKHYYSSTAEADVFLRNRAQYTARATSNTPASTTLQRCLNDQFMNHHQRRLSQNEDNIHHDPLDLELALDIGPSQDKRIKRSSGCSWRRHQEEENVGNQEVESATDDTRLSLSLFPSPPYVRTSSGGHHKVLGLNMEKGTAHPTRTSTLDLTI

SEQ ID NO: 12049 - DNA, 825 bp, Sorghum bicolor
  misc_feature: Ceres ANNOT ID no. 6044073
  misc_feature: Encodes the peptide sequence at SEQ ID NO 12050
atgtggacggacagtccgctgctccgggatgccggcgccgccgtgctcaccggagtgaccgccggtgttgtgctccgcttctgggaagaggtcgccaaccgcgcgctgctggaccagaaactctgcaggaaactggtgcacataactgtcggattagtgtatttcctgatgtggcctttgttcagttcagatgatgcgtttgctccatttcttgctccacttatcctcgtcatcaacatcataaaggtgacagtgattggacttggtttggtgaaagatgaaggtatggttaattcgatgaccaggcatggagaccacagagaactactcaagggcccattgtattatgcttgtgctataactgtaacaacaatagttttctggaggacatctcccatctcaatcgccgtgatctgcaatttgtgtgccggagacggtgttgctgacatatttgggagacgatttgggcatgtgaagctccctcacaaccctgaaaaatcatatgcaggaagcattgccatgttcttggcaggtttcatcgcatcagtgctgttcatgtgctacttcaacatttttgggtttgttgagaagagctggaccatggtcgctgcctttggtgtcatatccctggttgcagcagttgtggagtcactcccgatcagcacatgccttgacgacaatctgactgttcctgtcgcatctgtgctatttagcgccctggttttctattccatcggagccagaaacctgtgctgcatgagcggcgaagactggagaagtatttcagctaccgttggaatgatgtttgcaggcagcagcagctga

SEQ ID NO: 12050 - protein, 274 aa, Sorghum bicolor
  misc_feature: Ceres ANNOT ID no. 6044073
  misc_feature (41)..(245): Pfam Id: CTP_transf_1 Pfam Desc: Cytidylyltransferase family
  misc_feature (1)..(265): NCBI GI: 115483745 NCBI Desc: os11g0105800 [oryza sativa (japonica cultivar-group)]
  misc_feature (4)..(271): NCBI GI: 115486890 NCBI Desc: os12g0105500 [oryza sativa (japonica cultivar-group)]
  misc_feature (5)..(242): NCBI GI: 92039815 NCBI Desc: probable phytol kinase 2, chloroplast precursor
  misc_feature (5)..(242): NCBI GI: 115440847 NCBI Desc: os01g0832000 [oryza sativa (japonica cultivar-group)]
  misc_feature (6)..(241): NCBI GI: 76443939 NCBI Desc: phytol kinase [glycine max]
  misc_feature: Useful for making plants with modulated nitrogen use efficiency
  misc_feature: Functional homolog of the protein sequence given in SEQ ID NO 13064
  misc_feature: Useful for making plants with modulated nitrogen use efficiency
  misc_feature: Functional homolog of the protein sequence given in SEQ ID NO 13064
MWTDSPLLRDAGAAVLTGVTAGVVLRFWEEVANRALLDQKLCRKLVHITVGLVYFLMWPLFSSDDAFAPFLAPLILVINIIKVTVIGLGLVKDEGMVNSMTRHGDHRELLKGPLYYACAITVTTIVFWRTSPISIAVICNLCAGDGVADIFGRRFGHVKLPHNPEKSYAGSIAMFLAGFIASVLFMCYFNIFGFVEKSWTMVAAFGVISLVAAVVESLPISTCLDDNLTVPVASVLFSALVFYSIGARNLCCMSGEDWRSISATVGMMFAGSSS

SEQ ID NO: 12051 - DNA, 1134 bp, Sorghum bicolor
  misc_feature: Ceres ANNOT ID no. 6044094
  misc_feature: Encodes the peptide sequence at SEQ ID NO 12052
atgaagagccggcagcaggtggtggacgccggcttcgacgccgggaagccgccgccgttccgcatcggcgacgtgcgcgcggcggtgccggagcactgctggcgcaagagcccctggcggtcgctgtggtacgtggcgcgcgacgtcgcggtggtggcggcgctgggcgcggcggcggcggccatggacagctgggcggtgtggccgctctactgggcggcgcaggggaccatgttctgggcgctattcgtcctgggacacgactgtgggcatgggagtttctcggacaacgcgacactgaacagcgtggtggggcatctcctacactccttcatcctcgtcccctaccatggatggaggatcagccacagaacacaccatcagaaccacggccacatccacagggacgagtcatggcatccgatcacggaggggctgtaccggcaactggagacgcgcaccaagaagctcagattcaccgtgcccttcccgctgctcgcattccctgtctacctcctgtaccggagccccggcaagacgggctcccactttcttcccagcagcgagctgttcagccccaaggagaagggcgacgtcatgctgtcaaccacctgctggtgcatcatgctcgcctccctcttcgccatggcgtgcgcgttcggtccagcccaggtgctcaagatgtacggcctcccataccttgtgtttgtgatgtggcttgacttggtgacgtacctgcaccaccatggccaccatgagcgcctcccctggtaccgcggcgaggagtggagctacctgcgcggcggcctgacgacggtggacagagactacggctggatcaacaagatccaccacgacatcggcacccatgtcatccatcacctcttcccgcagatcccgcactaccatctcgtcgaagctaccaaggcagccaagccggtgctggggcgatactaccgggagccacagaagtcagggccgctgccgcttcacctccttggcgtgcttctgagaagcctcagagtcgaccacttcgtcagcgaccatggcgatgttgtctactaccaaactgaccatgaattgaacactagtgctcccggctgggccgcccaaaaccatcataagcaaaaatga

SEQ ID NO: 12052 - protein, 377 aa, Sorghum bicolor
  misc_feature: Ceres ANNOT ID no. 6044094
  misc_feature (71)..(315): Pfam Id: FA_desaturase Pfam Desc: Fatty acid desaturase
  misc_feature (2)..(362): NCBI GI: 125661167 NCBI Desc: fatty acid desaturase des1 [sorghum bicolor]
  misc_feature (12)..(375): NCBI GI: 1777376 NCBI Desc: w-3 fatty acid desaturase [oryza sativa (indica cultivar-group)]
  misc_feature (12)..(375): NCBI GI: 3157460 NCBI Desc: omega-3 fatty acid desaturase [triticum aestivum]
  misc_feature (3)..(365): NCBI GI: 45385976 NCBI Desc: chloroplast omega-3 desaturase [malus x domestica]
  misc_feature (12)..(365): NCBI GI: 1345971 NCBI Desc: omega-3 fatty acid desaturase, chloroplast precursor
  misc_feature: Useful for making plants with modulated heat sensitivity
  misc_feature: Functional homolog of the protein sequence given in SEQ ID NO 13709
MKSRQQVVDAGFDAGKPPPFRIGDVRAAVPEHCWRKSPWRSLWYVARDVAVVAALGAAAAAMDSWAVWPLYWAAQGTMFWALFVLGHDCGHGSFSDNATLNSVVGHLLHSFILVPYHGWRISHRTHHQNHGHIHRDESWHPITEGLYRQLETRTKKLRFTVPFPLLAFPVYLLYRSPGKTGSHFLPSSELFSPKEKGDVMLSTTCWCIMLASLFAMACAFGPAQVLKMYGLPYLVFVMWLDLVTYLHHHGHHERLPWYRGEEWSYLRGGLTTVDRDYGWINKIHHDIGTHVIHHLFPQIPHYHLVEATKAAKPVLGRYYREPQKSGPLPLHLLGVLLRSLRVDHFVSDHGDVVYYQTDHELNTSAPGWAAQNHHKQK

SEQ ID NO: 12053 - DNA, 2181 bp, Sorghum bicolor
  misc_feature: Ceres ANNOT ID no. 6044109
  misc_feature: Encodes the peptide sequence at SEQ ID NO 12054
atgcccatggcgcccgaccgccccttagaggccttcatcactgccgcccgtggcgcaatcgcgcaccttcaccttcctgtcatccacgtccccggatccaattccagtcccactcccaaccccaagcagcaggaggaacccggggccgactgcctggtccacctccacgtcgtggtcaccaacttcctccacaagcccctcaagtcattcgccagatgcttcaagcccaagcgacgggcaggcaaacacttctcgccgctccactgggatcacagcaatggcggcaccccacagcagcagctggagctcctgctctgcattgcgttcgacgccgtcgcccacaacctgcacttgctggaggatgcctgtaggcagaaaggtgaagaatttggtatggctacgcgacagctggagcaatttgtggttctcaggaagataatcgatgggaagagggccgatttcgatgggttcctttctaacctgggctttgcaaaggttggggcaccgccgccgcgagcaaggatcatgagcggtgcgtcccctgtcccagcaccagcaccagtaagcgaccaggaggatggtgctggaattgtggacagcgaccaggaggatggtggtggaattggggacagcgaggcggtggacaatgctagtggtacacagcagccagcacagaaattgcctgcccggctgcttaacattcctttgtcgaatgtggagcgtctgcggtctacgctatcggcagtttcactgacagagctcattgaattagtcccgcagctggtgagcagatcatcaacatcggcggatgcacatcctgacaagaagaagcttttctcagtgcaagacttcttcagatatgcagaaattgaaggaaagcgattctttgaagagttagacagagatggtgatggccaagtcactctagaagatctcgaaattgcaatgaggaagaggcggttaccaaggaggtatgctcgagaattgttccgccatacaagaagcaacttcttttcgaaatcaattgggtggaagcaatttttatccttgatggaacagaaggaggcaaccattctccgagcatataccacgttgtgtttgagcaagtctggaacacttcacaagaatcaaattttgacttccttgaaaggtgctggacttccggccaatgaagataatgccactgccatgctacggtatctaaattctgattcagaaggatcaatctcatatggccatttccggaacttcatgcttctacttccttcagaacgccttgaggatgatcctcggaacatctggtttgaagctgctactgttgttgctgttgccccacctatagaaatatccacaggaagtgttttgaagtctgctttagctggaggtcttgcaagtgcgctctctacctctctgctgcatcctattgattcaatgaagacacgtgtccaagcatctacactctcatttccagagctcatttcaaagcttccacaaattgggcttcagggattgtatcggggttctatcccagcaattctcggccaattttcaagccatggtttgaggacaggaatctttgaagcaaccaagcttgtgttaattaatgtcgctccgacacttccagagattcaggtgcaatcaatggcttccttctgcagcacagtcctagggactgcagtccgtataccttgcgaggttcttaagcagcgggaggcaattgttggcaccatgcgacaagatggcccaaagggttttttttggggcacgggggcccccttttgtgggggggttcccttttatgttgggggaaagggcctttttgcagaagcacagcatgttttgaagagagacttggaagcatgggaaacagtggcagttggagcattgtctggaggacttgcggcaatagtgaccactccatttgacgtgatgaaaacgcggatgatgactgcccctccaggcacaccagtgtctatgcagatgatagtcttctccatccttcgaaatgagggtccacttgggcttttcaagggtgcgatcccccgcttcttctggattgcccctcttggtgcaatgaactttgcaggctacgagcttgccaagaaggcgatgatcgaagatgagagcaagtccagagaatcaatagaggagaaaaaaaccatggtgggttccagaggataa

SEQ ID NO: 12054 - protein, 726 aa, Sorghum bicolor
  misc_feature: Ceres ANNOT ID no. 6044109
  misc_feature (453)..(537): Pfam Id: Mito_carr Pfam Desc: Mitochondrial carrier protein
  misc_feature (542)..(618): Pfam Id: Mito_carr Pfam Desc: Mitochondrial carrier protein
  misc_feature (619)..(708): Pfam Id: Mito_carr Pfam Desc: Mitochondrial carrier protein
  misc_feature (291)..(319): Pfam Id: efhand Pfam Desc: EF hand
  misc_feature (447)..(714): NCBI GI: 79563681 NCBI Desc: binding [arabidopsis thaliana]
  misc_feature (220)..(408): NCBI GI: 145352008 NCBI Desc: mc family transporter [ostreococcus lucimarinus cce9901]
  misc_feature (437)..(724): NCBI GI: 57900161 NCBI Desc: mitochondrial carrier protein-like [oryza sativa (japonica cultivar-group)]
  misc_feature (437)..(724): NCBI GI: 115442423 NCBI Desc: os01g0964900 [oryza sativa (japonica cultivar-group)]
  misc_feature (457)..(708): NCBI GI: 49250406 NCBI Desc: mgc69323 protein [xenopus tropicalis]
  misc_feature: The sequence is a functional homolog of SEQ ID NO. 517 in the 11/188,298 US application
MPMAPDRPLEAFITAARGAIAHLHLPVIHVPGSNSSPTPNPKQQEEPGADCLVHLHVVVTNFLHKPLKSFARCFKPKRRAGKHFSPLHWDHSNGGTPQQQLELLLCIAFDAVAHNLHLLEDACRQKGEEFGMATRQLEQFVVLRKIIDGKRADFDGFLSNLGFAKVGAPPPRARIMSGASPVPAPAPVSDQEDGAGIVDSDQEDGGGIGDSEAVDNASGTQQPAQKLPARLLNIPLSNVERLRSTLSAVSLTELIELVPQLVSRSSTSADAHPDKKKLFSVQDFFRYAEIEGKRFFEELDRDGDGQVTLEDLEIAMRKRRLPRRYARELFRHTRSNFFSKSIGWKQFLSLMEQKEATILRAYTTLCLSKSGTLHKNQILTSLKGAGLPANEDNATAMLRYLNSDSEGSISYGHFRNFMLLLPSERLEDDPRNIWFEAATVVAVAPPIEISTGSVLKSALAGGLASALSTSLLHPIDSMKTRVQASTLSFPELISKLPQIGLQGLYRGSIPAILGQFSSHGLRTGIFEATKLVLINVAPTLPEIQVQSMASFCSTVLGTAVRIPCEVLKQREAIVGTMRQDGPKGFFWGTGAPFCGGVPFYVGGKGLFAEAQHVLKRDLEAWETVAVGALSGGLAAIVTTPFDVMKTRMMTAPPGTPVSMQMIVFSILRNEGPLGLFKGAIPRFFWIAPLGAMNFAGYELAKKAMIEDESKSRESIEEKKTMVGSRG

SEQ ID NO: 12055 - DNA, 870 bp, Sorghum bicolor
  misc_feature: Ceres ANNOT ID no. 6047064
  misc_feature: Encodes the peptide sequence at SEQ ID NO 12056
atggcttccgacgccccgacgcagcagccggcgccccagcagaagcctacaagggtctcgctgtcctacgaggagatctccaagctcttctcgctccccatcgccgaggcggcctccatcctcggagtctgcaccagtgtcttgaagaggatctgccgcacccacgggattgttaggtggccctatcgtaagcttgtttctgggaaagctggggatgatacaaaaggtcctgatagagacaaagccaaggaactccttgagttatcaaaaatcgtgaaacaaaaggcttccagtgcatcaggcccatcaatagtgtcatcaagcacttcccaaggagcggcaaagtctcaacagggcagttctaaggcaggacaaatttcagtttcgcccccagcaggtaagcagaacacatcaccaagcttggcccacggtagccaagccaaggccatccctagttatatggatgatttcaagtacggattcccgtcatctggcttgtcttgtgaaacgatgaaatggtggggcacaagcagcgacacagactgtgtgcctgccaaagatggaagccatgaagcccatgatttaacaacgcatgagccgtcaaagggcatgactgatgatgacgagttggactggggagcagatgaagcagaagcggaagctgaagctgatggtgctgttacagcagaagcgtcggcgcagctgtgctccctaagaaggaaagcagtagatgatggacgcaagctattgaatggcggcaaccgcaggggccaagaattttctaggctgaacaaaaggcagaagctagtgctggcccaggtatttggggcttcactgccagatgttgtatttcttgtgtctagtgagtga

SEQ ID NO: 12056 - protein, 289 aa, Sorghum bicolor
  misc_feature: Ceres ANNOT ID no. 6047064
  misc_feature (17)..(68): Pfam Id: RWP-RK Pfam Desc: RWP-RK domain
  misc_feature (5)..(281): NCBI GI: 13486839 NCBI Desc: osjnba0004g10.17 [oryza sativa (japonica cultivar-group)]
  misc_feature (5)..(281): NCBI GI: 115435634 NCBI Desc: os01g0246500 [oryza sativa (japonica cultivar-group)]
  misc_feature (8)..(67): NCBI GI: 119672865 NCBI Desc: minus dominant protein [pleodorina starrii]
  misc_feature (1)..(69): NCBI GI: 86200409 NCBI Desc: mid [chlamydomonas reinhardtii]
  misc_feature (4)..(67): NCBI GI: 119672855 NCBI Desc: minus dominant protein [pleodorina starrii]
MASDAPTQQPAPQQKPTRVSLSYEEISKLFSLPIAEAASILGVCTSVLKRICRTHGIVRWPYRKLVSGKAGDDTKGPDRDKAKELLELSKIVKQKASSASGPSIVSSSTSQGAAKSQQGSSKAGQISVSPPAGKQNTSPSLAHGSQAKAIPSYMDDFKYGFPSSGLSCETMKWWGTSSDTDCVPAKDGSHEAHDLTTHEPSKGMTDDDELDWGADEAEAEAEADGAVTAEASAQLCSLRRKAVDDGRKLLNGGNRRGQEFSRLNKRQKLVLAQVFGASLPDVVFLVSSE

SEQ ID NO: 12057 - DNA, 513 bp, Sorghum bicolor
  misc_feature: Ceres ANNOT ID no. 6047068
  misc_feature: Encodes the peptide sequence at SEQ ID NO 12058
atggcgctgccggtggcgaagctggggaccctggcgctgcggacgctgtccaagcccatcgccagccgcctcaagagccaggccgccgtccaccccaaattccgcaacttcatcatcgccatcgcccagataaaccatcgtatcaccaccaagatacaaaggcgcatttacgggcacgctacagatgtggagatcaggcctttagacgagcagaaagctgttcaagctgctacagatctcatcggggaagcctttatcttttcggttgctgttgctgctctaatttttgaggtacagagaagtgcaaggtctgaggctagaaaggaggaagctcgtaaacaggaacttgaggaattgaaactaagggaagagagtttagctaaagaactggaagatcttaaagtgaggcttagtgaaattgagcggcttgctaaagggcgaggcttgacaggaatcttgaacttgaaaagggtccatgggccagaagtcggcaaggcagcaacacctgcgtga

SEQ ID NO: 12058 - protein, 170 aa, Sorghum bicolor
  misc_feature: Ceres ANNOT ID no. 6047068
  misc_feature (4)..(136): Pfam Id: OPA3 Pfam Desc: Optic atrophy 3 protein (OPA3)
  misc_feature (1)..(170): NCBI GI: 115435592 NCBI Desc: os01g0242300 [oryza sativa (japonica cultivar-group)]
  misc_feature (1)..(145): NCBI GI: 37202086 NCBI Desc: at3g58150 [arabidopsis thaliana]
  misc_feature (1)..(53): NCBI GI: 119404885 NCBI Desc: opa3 domain protein [aspergillus clavatus nrrl 1]
  misc_feature (2)..(148): NCBI GI: 116116462 NCBI Desc: ensangp00000017479 [anopheles gambiae str. pest]
  misc_feature (7)..(132): NCBI GI: 44981425 NCBI Desc: acl018wp [eremothecium gossypii]
MALPVAKLGTLALRTLSKPIASRLKSQAAVHPKFRNFIIAIAQINHRITTKIQRRIYGHATDVEIRPLDEQKAVQAATDLIGEAFIFSVAVAALIFEVQRSARSEARKEEARKQELEELKLREESLAKELEDLKVRLSEIERLAKGRGLTGILNLKRVHGPEVGKAATPA

SEQ ID NO: 12059 - DNA, 999 bp, Sorghum bicolor
  misc_feature: Ceres ANNOT ID no. 6047328
  misc_feature: Encodes the peptide sequence at SEQ ID NO 12060
  misc_feature: Up-regulated in root tissues in response to methyl jasmonate treatment
atggctgcctccacagcatcatcatggtctgccgccggcggcctaagtgccacctcctgtgtgtctccgccaccgcagcgccgccatggcagcagcttgaagccgccgcagcgctctggacagccggcggcgacgaccctatccgcatcagggaaccaaccgaacctatcgtacttagactgtaggacaaggactaggaggagaggcgaccgaatcagagctgccgatgccgtgaccatggatggctgggcagcacggcttgaagccccggtagcggttgtcactggagcgtctagagggattggcagagccatagctgtggcacttggcaaagcagggtgcaaggtgattgtgaactatgccaagtcaggcatggaagctgaagaagtgtgcagagagatcgaggagtccggtgggacggcgatcagcttcgctgccgacgtctcttgcgaggccgacgtcgaatccatgatgagggccgcaattgatgcttggggagctctggatgtcctggtgaacaatgcagggattacacgtgacgcgctgctgatgcggatgaagaagacccagtggcaagaggtggttgatgtcaacctcaccggcgtttacttctgcgcccaggctgcagccaccgtgatgatgaagaggaagaagggaaggatcatcaacatcgcatcagtttccggtatcatcggcaacgtcgggcaggccaactactgcgccgccaaggctggggttattggcctcaccaaggccatggccagggagtacggaggcagaaacatcaatgtgaacgccgtagcaccgggctgggtggcgtccgacatgaccaataaactaggggacgatgtggaaaggaaggcgctcgagaccataccattaggacggtttgggaggccagaagaggttgccgggctggtggggttcctggctgttcatcctgccgctagttacatcaccggacaggtgctcactattgatggtggcttgtcgatttga

SEQ ID NO: 12060 - protein, 332 aa, Sorghum bicolor
  misc_feature: Ceres ANNOT ID no. 6047328
  misc_feature (90)..(258): Pfam Id: adh_short Pfam Desc: short chain dehydrogenase
  misc_feature (90)..(275): Pfam Id: KR Pfam Desc: KR domain
  misc_feature (41)..(332): NCBI GI: 18046 NCBI Desc: 3-oxoacyl-[acyl-carrier protein] reductase; beta-ketoacyl-acp reductase [cuphea lanceolata]
  misc_feature (84)..(330): NCBI GI: 38346116 NCBI Desc: osjnbb0006n15.11 [oryza sativa (japonica cultivar-group)]
  misc_feature (54)..(332): NCBI GI: 14422263 NCBI Desc: beta-oxyacyl-[acyl-carrier protein] reductase [brassica napus]
  misc_feature (86)..(332): NCBI GI: 14422251 NCBI Desc: 3-oxyacyl-[acyl carrier protein] reductase [brassica napus]
  misc_feature (74)..(332): NCBI GI: 14422249 NCBI Desc: 3-oxyacyl-[acyl carrier protein] reductase [brassica napus]
  misc_feature (41)..(332): SWISSPROT Homolog: EC 1.1.1.100 3-oxoacyl-[acyl-carrier-protein] reductase, chloroplast precursor
  misc_feature: Up-regulated in root tissues in response to methyl jasmonate treatment
  misc_feature: The sequence is a functional homolog of SEQ ID NO. 389 in the 11/188,298 US application
  misc_feature: The sequence is a functional homolog of SEQ ID NO. 453 in the 11/188,298 US application
MAASTASSWSAAGGLSATSCVSPPPQRRHGSSLKPPQRSGQPAATTLSASGNQPNLSYLDCRTRTRRRGDRIRAADAVTMDGWAARLEAPVAVVTGASRGIGRAIAVALGKAGCKVIVNYAKSGMEAEEVCREIEESGGTAISFAADVSCEADVESMMRAAIDAWGALDVLVNNAGITRDALLMRMKKTQWQEVVDVNLTGVYFCAQAAATVMMKRKKGRIINIASVSGIIGNVGQANYCAAKAGVIGLTKAMAREYGGRNINVNAVAPGWVASDMTNKLGDDVERKALETIPLGRFGRPEEVAGLVGFLAVHPAASYITGQVLTIDGGLSI

SEQ ID NO: 12061 - DNA, 114 bp, Sorghum bicolor; identical to SEQ ID NO: 11247
  misc_feature: Ceres ANNOT ID no. 6048622
  misc_feature: Encodes the peptide sequence at SEQ ID NO 12062

SEQ ID NO: 12062 - protein, 37 aa, Sorghum bicolor; identical to SEQ ID NO: 11248
  misc_feature: Ceres ANNOT ID no. 6048622
  misc_feature (1)..(37): Pfam Id: PetG Pfam Desc: Cytochrome B6-F complex subunit 5
  misc_feature (1)..(37): NCBI GI: 109945536 NCBI Desc: cytochrome b6/f complex subunit v [populus alba]
  misc_feature (1)..(37): NCBI GI: 42795500 NCBI Desc: cytochrome b6/f complex subunit v; pete [oryza sativa (indica cultivar-group)]
  misc_feature (1)..(37): NCBI GI: 11466809 NCBI Desc: cytochrome b6/f complex subunit v [oryza sativa (japonica cultivar-group)]
  misc_feature (1)..(37): NCBI GI: 226628 NCBI Desc: cytochrome b/f complex 5
  misc_feature (1)..(37): NCBI GI: 902240 NCBI Desc: cytochrome b /f complex subunit 5 [zea mays]

SEQ ID NO: 12063 - DNA, 171 bp, Sorghum bicolor; identical to SEQ ID NO: 11245
  misc_feature: Ceres ANNOT ID no. 6048634
  misc_feature: Encodes the peptide sequence at SEQ ID NO 12064

SEQ ID NO: 12064 - protein, 56 aa, Sorghum bicolor; identical to SEQ ID NO: 11246
  misc_feature: Ceres ANNOT ID no. 6048634
  misc_feature (1)..(53): NCBI GI: 902218 NCBI Desc: atpase subunit i [zea mays]
  misc_feature (1)..(53): NCBI GI: 50812524 NCBI Desc: atp synthase i subunit [saccharum officinarum]
  misc_feature (1)..(53): NCBI GI: 118614488 NCBI Desc: atp synthase cf0 subunit i [sorghum bicolor]
  misc_feature (1)..(56): NCBI GI: 224349 NCBI Desc: orf 3
  misc_feature (1)..(53): NCBI GI: 311717 NCBI Desc: cf-o subunit i [triticum aestivum]
  misc_feature (1)..(53): SWISSPROT Homolog: EC 3.6.3.14 ATP synthase B chain

SEQ ID NO: 12065 - DNA, 273 bp, Sorghum bicolor
  misc_feature: Ceres ANNOT ID no. 6050469
  misc_feature: Encodes the peptide sequence at SEQ ID NO 12066
atggtcaggatagctcagttggtagagcagaggactgaaaatcctcgtgtcaccagttcaaatctggttcctggcacagaaaaaaggatctaccgaataggtattgataaaaattactcgagatggattgggaatcaggtccgacaacgggttttccaacaagctgtacaaggagctctaggaactctgaatagttgtttgaataccgagttacatttccgtacgattcgtgctaatattggcattcttggggccatagaatggaagagataa

SEQ ID NO: 12066 - protein, 90 aa, Sorghum bicolor
  misc_feature: Ceres ANNOT ID no. 6050469
  misc_feature (21)..(90): NCBI GI: 50812524 NCBI Desc: atp synthase i subunit [saccharum officinarum]
  misc_feature (21)..(90): NCBI GI: 118614488 NCBI Desc: atp synthase cf0 subunit i [sorghum bicolor]
  misc_feature (20)..(90): NCBI GI: 311717 NCBI Desc: cf-o subunit i [triticum aestivum]
  misc_feature (20)..(90): NCBI GI: 118430384 NCBI Desc: atp synthase cf0 subunit i [hordeum vulgare subsp. vulgare]
  misc_feature (20)..(90): NCBI GI: 118430298 NCBI Desc: atp synthase cf0 subunit i [agrostis stolonifera]
  misc_feature (21)..(90): SWISSPROT Homolog: EC 3.6.3.14 ATP synthase B chain
MVRIAQLVEQRTENPRVTSSNLVPGTEKRIYRIGIDKNYSRWIGNQVRQRVFQQAVQGALGTLNSCLNTELHFRTIRANIGILGAIEWKR

SEQ ID NO: 12067 - DNA, 2202 bp, Sorghum bicolor
  misc_feature: Ceres ANNOT ID no. 6051711
  misc_feature: Encodes the peptide sequence at SEQ ID NO 12068
atggctgcgctcgccgccgtcgactcctcggcacctccgccgccgtccgagtcatccaaaggcaagggcaagatggacgacgacgtggaggcggagggcgcggagaagatgtgcggcatctgctacgtcgacggccggcgggccatccgcggcgagctcgactgctgcgcccacttcttctgcttcgtctgcatcatggcctggggccgcgtcgagtcccgctgccccttctgcaaggcccgcttccgcaccatccgccgcccgcccgtcgccggccggttccccgacgagcgaatcgtctccgtccccgagcgcaaccaggtatacaatcctcagggcaacgggagcagcacagtgggcggagatccttacgtgaacaccatatgcaccgtctgcagcagctccagcgacgacgagctgctgctgctctgcgagctctgcgactcagctgcgcacacttactgtgtcgggctggggaacgccgtgccggagggggactggttctgcaaggactgcgggacgatcagagatgatcagttgagatggcaggctgagaatcaggctgaatttgagatcggggtcaatgttccggatgctgagccagttccagaccccttggtttctggtgttgtggatgaggagcatgatctggaaaggacagatgcgcggagcggtggcggcggttcgatgagtgacccggttccttccatttatgacattgtggatgatgatttcgctaccattgctgggatctttaggaggaggattcctgaggataatcgacctcagggtacttcagctggatctcagtgtccaaggtcgacccagggacgagacaatggtcttgcagcctatcatgctcgcattcgccttgaagttgagagagctagaacattgcgcaattctcgcaatcttgataagcgcataagggagctgcgggagaactgggcggctctgcgtgatggttctgtggggtttgctccgcatatgcctggcagaagaaggaaggatatggctggttctgcttctgttcctaccgagcatcagcgttatgcagagcctgaaactatcagttctcgaaatggcaccactgcagcttctgttccgctgcgaacacccttatctgaggaaactagtacctcactgggccatagtaaaaaagtcttgcacaaggacactcgtgatgcccgtaaggcatggaaaaggttggagatggcaaaatcatctggtgggaggaagatatctaacacacctgcctcccttaactgcagctccccattttccatggggaacagatcaacttcttacagtccgattgatacaattgtgggacacaagaaccagaacctgcctaataagttttgtcaaaaaagtaattcaatctgtggtcatggtacaaaagcggaacatacgccacccgcgaataactctagaggatgccatagcttgcctgagaacaatcgtgcctcagttcatgagaggatgatttcttttcagaatcgaataaatcaggaaagccttgatggcaaagttgcttcatcaacccacaatcggcatgttgatcaatcattagtatcttcctgtagcacacgcagatcagaaaaactcaaatcagacatgctgcatccacaaaagtacagttcatcatctggccagtcagctgtgacttcatccctacagttaggacctagtgttgaatctgggagccaatgcactatgatggtaaaccctgaggaatcttcagctgtttgcgttgaaggtatagatgcaaccattgaagttacgaaaagttctagtccagaccggcttgagcgtaagagaaaacacagttcagaaagatgccatgatcaaggatccaaaaggtccaggtcaacctgtaaaatcgcaaaaagtgagatttcttctttggccattcgcgaattgaaactactcaagatagacaaaacacatggttctgacagattcaaggaagttgctcggaccgcaacacattccatcttggctgcctgcagatttgagcattcgccatcgcaatcccttgcactctcaagacctgtctgcaagcacagccccaaagtcaaacaactgaagtcgtcagcaattacggatttttgcaaagaatgcttgcgtaactttgttaaagaagccgtcagtttggcgttgtctggcaagcagatggatcaaactggtacctcctattag

SEQ ID NO: 12068 - protein, 733 aa, Sorghum bicolor
  misc_feature: Ceres ANNOT ID no. 6051711
  misc_feature (128)..(175): Pfam Id: PHD Pfam Desc: PHD-finger
  misc_feature (11)..(524): NCBI GI: 55297405 NCBI Desc: 2x phd domain containing protein-like [oryza sativa (japonica cultivar-group)]
  misc_feature (40)..(364): NCBI GI: 46226407 NCBI Desc: 2x phd domain containing protein [cryptosporidium parvum]
  misc_feature (5)..(108): NCBI GI: 34394410 NCBI Desc: nucleolin-related protein nrp-like [oryza sativa (japonica cultivar-group)]
  misc_feature (40)..(172): NCBI GI: 67590829 NCBI Desc: kiaa1453 protein [cryptosporidium hominis]
  misc_feature (40)..(172): NCBI GI: 54656232 NCBI Desc: kiaa1453 protein [cryptosporidium hominis]
MAALAAVDSSAPPPPSESSKGKGKMDDDVEAEGAEKMCGICYVDGRRAIRGELDCCAHFFCFVCIMAWGRVESRCPFCKARFRTIRRPPVAGRFPDERIVSVPERNQVYNPQGNGSSTVGGDPYVNTICTVCSSSSDDELLLLCELCDSAAHTYCVGLGNAVPEGDWFCKDCGTIRDDQLRWQAENQAEFEIGVNVPDAEPVPDPLVSGVVDEEHDLERTDARSGGGGSMSDPVPSIYDIVDDDFATIAGIFRRRIPEDNRPQGTSAGSQCPRSTQGRDNGLAAYHARIRLEVERARTLRNSRNLDKRIRELRENWAALRDGSVGFAPHMPGRRRKDMAGSASVPTEHQRYAEPETISSRNGTTAASVPLRTPLSEETSTSLGHSKKVLHKDTRDARKAWKRLEMAKSSGGRKISNTPASLNCSSPFSMGNRSTSYSPIDTIVGHKNQNLPNKFCQKSNSICGHGTKAEHTPPANNSRGCHSLPENNRASVHERMISFQNRINQESLDGKVASSTHNRHVDQSLVSSCSTRRSEKLKSDMLHPQKYSSSSGQSAVTSSLQLGPSVESGSQCTMMVNPEESSAVCVEGIDATIEVTKSSSPDRLERKRKHSSERCHDQGSKRSRSTCKIAKSEISSLAIRELKLLKIDKTHGSDRFKEVARTATHSILAACRFEHSPSQSLALSRPVCKHSPKVKQLKSSAITDFCKECLRNFVKEAVSLALSGKQMDQTGTSY

SEQ ID NO: 12069 - DNA, 957 bp, Sorghum bicolor
  misc_feature: Ceres ANNOT ID no. 6052794
  misc_feature: Encodes the peptide sequence at SEQ ID NO 12070
atggcgtctcgggcgcgcccgccgggctcgccggcctcgatcgccgtcctcatcctctccttcttccaagggtcggtgtgcggcatcacgttcaccttcaccaaccgctgcggcgacacggtgtggccgggcctgctgtcgggctcggggacgccgccgctggagacgaccgggttcgcgctgtctccagggcagtcgcggtcgctgtacgcgccgcaggggtggtcgggccgcttctggggccggtccgggtgcgccttcgacggctccgggaagggctcgtgcgccacgggcgactgcgggtccggcgaggtcgagtgccggggcgccggggcgtcgccgcccgccacgctcgccgagttcacgctcgacggcgcggggggcaaggacttctacgacgtcagcctcgtcgatgggtacaacctgcccatgctcgtgcaggccgccgcgcccgactgccccgacacggggtgcctcgtcgacctcaacgagcgctgcccggatgagctccgcgccgacgacggccgcgcctgtcgtagcgcgtgcgaggcgttcggaagccccgagtactgctgcaacggcgcctatggcaaccccaacacctgccacccgtcgcagtactcgcagctcttcaagtcggcgtgccccaaatcctacagctacgcctacgacgacgccacatccaccttcacctgcaaccacaccgattacaccatcaccttctgccccaaatcaactccgaccagcgacaaatccaaacattcgtcgcggaggccaagccacgagcaactggaagattcagtgtggcttgcatccttgaaggcaagtgatgccagtgctcagacaataacgtcatggtggtcggcgtccattgtgctgcggtctgccttggcaatcgcagtgaccttgcttgttgcacaacttgcaccgggtcatcctatggtcagcttgctatga

SEQ ID NO: 12070 - protein, 318 aa, Sorghum bicolor
  misc_feature: Ceres ANNOT ID no. 6052794
  misc_feature (35)..(243): Pfam Id: Thaumatin Pfam Desc: Thaumatin family
  misc_feature (14)..(293): NCBI GI: 92894553 NCBI Desc: thaumatin, pathogenesis-related [medicago truncatula]
  misc_feature (14)..(308): NCBI GI: 144922857 NCBI Desc: thaumatin, pathogenesis-related [medicago truncatula]
  misc_feature (10)..(247): NCBI GI: 7269268 NCBI Desc: thaumatin-like protein [arabidopsis thaliana]
  misc_feature (16)..(266): NCBI GI: 144924329 NCBI Desc: thaumatin, pathogenesis-related [medicago truncatula]
  misc_feature (14)..(309): NCBI GI: 115480383 NCBI Desc: os09g0536300 [oryza sativa (japonica cultivar-group)]
MASRARPPGSPASIAVLILSFFQGSVCGITFTFTNRCGDTVWPGLLSGSGTPPLETTGFALSPGQSRSLYAPQGWSGRFWGRSGCAFDGSGKGSCATGDCGSGEVECRGAGASPPATLAEFTLDGAGGKDFYDVSLVDGYNLPMLVQAAAPDCPDTGCLVDLNERCPDELRADDGRACRSACEAFGSPEYCCNGAYGNPNTCHPSQYSQLFKSACPKSYSYAYDDATSTFTCNHTDYTITFCPKSTPTSDKSKHSSRRPSHEQLEDSVWLASLKASDASAQTITSWWSASIVLRSALAIAVTLLVAQLAPGHPMVSLL

SEQ ID NO: 12071 - DNA, 750 bp, Sorghum bicolor
  misc_feature: Ceres ANNOT ID no. 6052798
  misc_feature: Encodes the peptide sequence at SEQ ID NO 12072
atggcacgctacgaccgcgcgatcacggtgttctccccggacggccacctcttccaggtcgagtacgccctggaggcggtccgcaagggcaacgccgccgtcggcgtccgcggcgtcgacaccgtcgtcctcggcgtcgagaagaagtccacacccaagctccaggactccaggtccgtgcgcaagatcgcgagccttgacacccacatcgcgctggcgtgcgcggggctcaaggccgacgcgcgcgtgctcatcaaccgtgcccgcgtcgagtgccagagccaccgcctcaccgtcgaggaccccgtcaccgtcgagtacatcacgcgctacatcgccggcctgcagcagaagtacacgcagagcggaggggtgcgccccttcggcctgtccacgctcatcgtcggcttcgacccctacacccagaagcccgcgctgtaccagactgacccctcgggcaccttctccgcttggaaggccaacgccaccggccgcaactccaactccatgcgtgagtttcttgagaagaattacaaggagacgtctggcaaggagaccatcaagctcgctatcaaagcactccttgaggttgttgagagtggcggcaagaacatagagattgcagtgatgacacacaaggacggccttcgcgaactcgaagaggctgagatcgatgagtatgttgcggagattgaagcagagaaggccgctgccgaggctgcaaagaagggtgcgccaagggagaactga

SEQ ID NO: 12072 - protein, 249 aa, Sorghum bicolor
  misc_feature: Ceres ANNOT ID no. 6052798
  misc_feature (27)..(210): Pfam Id: Proteasome Pfam Desc: Proteasome A-type and B-type
  misc_feature (1)..(248): NCBI GI: 42407804 NCBI Desc: proteasome alpha subunit [oryza sativa (japonica cultivar-group)]
  misc_feature (1)..(248): NCBI GI: 1930070 NCBI Desc: proteasome alpha subunit [oryza sativa]
  misc_feature (1)..(248): NCBI GI: 109940122 NCBI Desc: proteasome subunit alpha type 7 (20s proteasome alpha subunit d) (20s proteasome subunit alpha-4)
  misc_feature (1)..(247): NCBI GI: 125662835 NCBI Desc: 20s proteasome alpha 4 subunit [zea mays]
  misc_feature (1)..(248): NCBI GI: 9186906 NCBI Desc: alpha 4 subunit of 20s proteasome [oryza sativa (japonica cultivar-group)]
  misc_feature (1)..(248): SWISSPROT Homolog: EC 3.4.25.1 Proteasome subunit alpha type 7
  misc_feature: The sequence is a functional homolog of SEQ ID NO. 409 in the 11/188,298 US application
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAPREN

SEQ ID NO: 12073 - DNA, 1812 bp, Sorghum bicolor
  misc_feature: Ceres ANNOT ID no. 6052867
  misc_feature: Encodes the peptide sequence at SEQ ID NO 12074
atggataagcaggagccagtagccaatgtcgaacaaaagataggtctctctgagaagcctaaggagcagcctgttgccagtaaggatgagaaagcagctgtaccaccaatttcagttgattcaaatgctatcgatctaccaagtgaaggccaaacccaagctggcacatccaacatggatgggggccataatggtgcacacaacttctatgcttctcaggcacagccattctattaccaaggctccggatatgaaaacactccacaagaatgggacacatatcctccctacatgagtgtcgaaggattggaagtgggcccaccagttgtatacaatgaggacccctcattgatgttccatggtggctatggttatgacccatatgctcattattctcctattgcaacacctgtaccgactgctgttagtggagatggtcagctctactcccctcagcagttctccttctcggctccttactaccagcagtcagtaccacctggcatgccatatttaagctctcctactccaatatcacagggtgatacaaatacaatgatgccgattgacccaacacaaggagcttttatcgctgataccctgagtccaaacagcttcctgtttggcccaagacctgaaggaactgggtcatttccatcacctgcagcttcacctcaaccttctagtggtgttccagggacctatggccaaagcaactttccaatggcttcaggaatggcatcgcctcaccagaagcccttctatggtttgggatccacagctgactcctacggaaggggtttttctcatggtggaatgttcccacaggccagcaattatggaggatccttcaccagctttggctttaatggtagaagttcgatctcgatcgagaaagggcgtaggaggggaaggggtaatgcacttatttgcagctgcaatggcccacttgactttcttaatgagcaaagtcggggtccacgtgctactaagcctaagaagcaaccagaggttgacagtaaggatgagaagcctaccacaggagttggtcgtgagtcatacaacaagcctgactttgttacagagtacatgaatgccaggtttttcatcataaaatcatacagtgaagataatgtgcacaagagtgtaaaatatggtgtttgggctagcaccacaaatggaaacaagaaactggacttagcatatcgtgaagctaaggagaaggaagagcactgtcccatttttctgttattttcggtgaatgccagtgcacaattctgtggtgttgctgagatgattggaccagtggactttgagaaaagtgtggattactggcagcaagataagtggactggtcaattccctgtgaagtggcacatagtgaaggatgtccccaataatcttttccggcatataattcttgaaaacaacgacaataaacctgtaacaaacagccgagatacacaggaggtgaaactagagcaaggactggagatgctgaagatctttaagaaccatgatgatgatgcatcaatccttgatgactttgacttttatgaggagcgtgagaaagcactgcaggaaaataaggcacgcctgcatcagcaacatctacccagttctattgttgttgagcccaagaaacccttgactgtacccactgacctcgtgagccatatcaccaagagttttgctcaggctgtgcggcttggtgaggccaagactgtaagccctttggctgagaaagtttctggcggtgattcgtctattcctgtgaagcctgttgaagttaagcagagtggtttatcttag

SEQ ID NO: 12074 - protein, 603 aa, Sorghum bicolor
  misc_feature: Ceres ANNOT ID no. 6052867
  misc_feature (416)..(506): Pfam Id: YTH Pfam Desc: YT521-B-like family
  misc_feature (127)..(572): NCBI GI: 92892065 NCBI Desc: yt521-b-like protein [medicago truncatula]
  misc_feature (122)..(602): NCBI GI: 90265071 NCBI Desc: h0702g05.3 [oryza sativa (indica cultivar-group)]
  misc_feature (122)..(602): NCBI GI: 115460434 NCBI Desc: os04g0608800 [oryza sativa (japonica cultivar-group)]
  misc_feature (237)..(536): NCBI GI: 50509741 NCBI Desc: high-glucose-regulated protein 8-like [oryza sativa (japonica cultivar-group)]
  misc_feature (268)..(542): NCBI GI: 124365566 NCBI Desc: yt521-b-like protein [medicago truncatula]
MDKQEPVANVEQKIGLSEKPKEQPVASKDEKAAVPPISVDSNAIDLPSEGQTQAGTSNMDGGHNGAHNFYASQAQPFYYQGSGYENTPQEWDTYPPYMSVEGLEVGPPVVYNEDPSLMFHGGYGYDPYAHYSPIATPVPTAVSGDGQLYSPQQFSFSAPYYQQSVPPGMPYLSSPTPISQGDTNTMMPIDPTQGAFIADTLSPNSFLFGPRPEGTGSFPSPAASPQPSSGVPGTYGQSNFPMASGMASPHQKPFYGLGSTADSYGRGFSHGGMFPQASNYGGSFTSFGFNGRSSISIEKGRRRGRGNALICSCNGPLDFLNEQSRGPRATKPKKQPEVDSKDEKPTTGVGRESYNKPDFVTEYMNARFFIIKSYSEDNVHKSVKYGVWASTTNGNKKLDLAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGLEMLKIFKNHDDDASILDDFDFYEEREKALQENKARLHQQHLPSSIVVEPKKPLTVPTDLVSHITKSFAQAVRLGEAKTVSPLAEKVSGGDSSIPVKPVEVKQSGLS

SEQ ID NO: 12075 - DNA, 804 bp, Sorghum bicolor
  misc_feature: Ceres ANNOT ID no. 6053084
  misc_feature: Encodes the peptide sequence at SEQ ID NO 12076
atgtataataattatgggaaccctccagggatgcagatgcccccacagaactctcaacctgtccagtttgacaatccattatatggtgcaagctcaggtcttatcagatctgggattggagtatatggggagaagttcttgggttctagttcagaattcatgcaaagcaatatcaatagatacctctccaatccacagtattacttccatgtgaatgatcaatatgtccggaacaagttgaaaattatcctgtttccattcttccacagggggcactggactcgaataagtgagccggttggtggccgtttgtcctacaaacctccaatctatgacataaatgccccagatctgtacatccctttcatggcatttggaagcttcatcattctttctgggtttacgctaggtttcatgggaaagtttactccagaagctataaatctgcactttacaagggcactcatcggatggggcttccagctcatgctcctgaagggcctgctctactcaatgggcggcggtgaggtgccactgctcgacttggtagcatatggcggatatttatttgctgggctttcactcgctgtcgttgcgaggctcatatgggcatactcatactacgtcatgatgccatggatgagcctgtgcatgggagtgttcctggtgaggacgatgaagcgggtgctcttcacggagatgagaagcagtgagagacactcgtcacgacagcattacttccttctcttcatggcaatagcacagtttcccctattcttctggcttggcagcataggtgcatga

SEQ ID NO: 12076 - protein, 267 aa, Sorghum bicolor
  misc_feature: Ceres ANNOT ID no. 6053084
  misc_feature (34)..(263): Pfam Id: YIF1 Pfam Desc: YIF1
  misc_feature (1)..(267): NCBI GI: 38346458 NCBI Desc: osjnba0019g23.6 [oryza sativa (japonica cultivar-group)]
  misc_feature (1)..(267): NCBI GI: 90265113 NCBI Desc: h0806h05.8 [oryza sativa (indica cultivar-group)]
  misc_feature (1)..(265): NCBI GI: 30695009 NCBI Desc: integral membrane hrf1 family protein [arabidopsis thaliana]
  misc_feature (1)..(265): NCBI GI: 9755388 NCBI Desc: f17f8.24 [arabidopsis thaliana]
  misc_feature (1)..(265): NCBI GI: 115468982 NCBI Desc: os06g0620600 [oryza sativa (japonica cultivar-group)]
MYNNYGNPPGMQMPPQNSQPVQFDNPLYGASSGLIRSGIGVYGEKFLGSSSEFMQSNINRYLSNPQYYFHVNDQYVRNKLKIILFPFFHRGHWTRISEPVGGRLSYKPPIYDINAPDLYIPFMAFGSFIILSGFTLGFMGKFTPEAINLHFTRALIGWGFQLMLLKGLLYSMGGGEVPLLDLVAYGGYLFAGLSLAVVARLIWAYSYYVMMPWMSLCMGVFLVRTMKRVLFTEMRSSERHSSRQHYFLLFMAIAQFPLFFWLGSIGA

SEQ ID NO: 12077 - DNA, 1299 bp, Sorghum bicolor
  misc_feature: Ceres ANNOT ID no. 6053238
  misc_feature: Encodes the peptide sequence at SEQ ID NO 12078
atgctcctccgctgcggccgccgcgccgcgctcctcctcgccgcagccgccgcactctcgcgcggccgcgaccccgacacggccgtctacgcctcggtctccccgccacagacgctccgccaggccctcccaaccgccgcccccgccgccgaggggctccgctccggcgcccgcctcttctccccgtggctgctcccgtatccgtaccaagggtttccaatactaaataccttcgcgtctgcatcggtttcacctgctaacgacagagaccaaggttctgacggaagctcgtgtgattcaagatgctgcccagggtgtctaggcaggaattcgattgccaaggcggcatctgcagttggtcctgctgttgtaaacatttcttctatgcatgatatgcatggatgggtgcaagagcagagcatcggatctggaactataatagatccagatgggacgatattgacatgtgcacatgttgttgcagattttcaaagcacaaaagcaattgtgaggagaaaggttagtgtgactttacaagatggtcgtgaatttgaaggtgttgtccttaatgctgaccgtgtgtccgacatcgccgttgtgaagattaaatctgcgacccctttaccggctgccaggcttggatcgtcatctcgacttcagccaggtgattgggttgttgctgtgggctgtccactttctcttcagaacacagttaccgctggtattgtcagctgtgttgaccggaaaagcagtgatctgggtcttggaggattgcgaagggagtatctgcaaacagattgcgctattaataaggcaagaccgttgggaaattctggaggccctcttgtgaaccttgatggtgagattattggagttaatgtgatgaaagtttggaatgctgatggtttgagctttgcagtaccgattgactctgtcattaaaatagtagagaactttaagaaaaatgggagagttgtaaggccatggcttggtttaaagatgcttgacctgaatcccatgatcattgcacagctcaaagaaaaatcaagtacttttccagatgtaagaaaaggggtgcttgttcctatggttacaccagcatctccagctgaacaagcaggatttcgtcctggggatgtggttgttgaatttggtggcaaaccagttgagagcatcaaagagatcattgatatcatgggggacaaggtcggagtaccatttaaagttcttgtcaaaagagcgagcaatgtgacagtgaccttaactgtgataccagaggaggcagatgccagcagatga

SEQ ID NO: 12078 - protein, 432 aa, Sorghum bicolor
  misc_feature: Ceres ANNOT ID no. 6053238
  misc_feature (123)..(316): Pfam Id: Trypsin Pfam Desc: Trypsin
  misc_feature (43)..(242): NCBI GI: 115484931 NCBI Desc: os11g0246600 [oryza sativa (japonica cultivar-group)]
  misc_feature (59)..(431): NCBI GI: 124360020 NCBI Desc: peptidase s1 and s6, chymotrypsin/hap [medicago truncatula]
  misc_feature (29)..(429): NCBI GI: 145358490 NCBI Desc: serine-type peptidase/ trypsin [arabidopsis thaliana]
  misc_feature (137)..(425): NCBI GI: 86607358 NCBI Desc: peptidase, s1c (protease do) family [cyanobacteria bacterium yellowstone a-prime]
  misc_feature (137)..(432): NCBI GI: 22298213 NCBI Desc: periplasmic serine proteinase [thermosynechococcus elongatus bp-1]
MLLRCGRRAALLLAAAAALSRGRDPDTAVYASVSPPQTLRQALPTAAPAAEGLRSGARLFSPWLLPYPYQGFPILNTFASASVSPANDRDQGSDGSSCDSRCCPGCLGRNSIAKAASAVGPAVVNISSMHDMHGWVQEQSIGSGTIIDPDGTILTCAHVVADFQSTKAIVRRKVSVTLQDGREFEGVVLNADRVSDIAVVKIKSATPLPAARLGSSSRLQPGDWVVAVGCPLSLQNTVTAGIVSCVDRKSSDLGLGGLRREYLQTDCAINKARPLGNSGGPLVNLDGEIIGVNVMKVWNADGLSFAVPIDSVIKIVENFKKNGRVVRPWLGLKMLDLNPMIIAQLKEKSSTFPDVRKGVLVPMVTPASPAEQAGFRPGDVVVEFGGKPVESIKEIIDIMGDKVGVPFKVLVKRASNVTVTLTVIPEEADASR
